(12) United States Patent
Brown et al.

(10) Patent No.: US 10,036,017 B2
(45) Date of Patent: Jul. 31, 2018

(54) METHODS AND COMPOSITIONS FOR THE SPECIFIC INHIBITION OF COMPLEMENT COMPONENT 5(C5) BY DOUBLE-STRANDED RNA

(71) Applicant: Dicerna Pharmaceuticals, Inc., Cambridge, MA (US)

(72) Inventors: Bob D. Brown, Littleton, MA (US); Henryk T. Dudek, Wellesley, MA (US)

(73) Assignee: Dicerna Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 15/044,538

(22) Filed: Feb. 16, 2016

(65) Prior Publication Data
US 2016/0237438 A1  Aug. 18, 2016

Related U.S. Application Data

(60) Provisional application No. 62/117,124, filed on Feb. 17, 2015.

(51) Int. Cl.
*C12N 15/113* (2010.01)
(52) U.S. Cl.
CPC ........ *C12N 15/113* (2013.01); *C12N 2310/14* (2013.01); *C12N 2320/11* (2013.01)
(58) Field of Classification Search
CPC .................................................. C12N 15/113
See application file for complete search history.

(56) References Cited

U.S. PATENT DOCUMENTS

| | | | |
|---|---|---|---|
| 8,084,599 B2 | 12/2011 | Rossi et al. | |
| 8,349,809 B2 | 1/2013 | Brown | |
| 8,513,207 B2 | 8/2013 | Brown | |
| 9,249,415 B2 * | 2/2016 | Fitzgerald | ............ C12N 15/113 |
| 2005/0255487 A1 | 11/2005 | Khvorova et al. | |
| 2005/0277610 A1 | 12/2005 | Rossi et al. | |
| 2007/0265220 A1 | 11/2007 | Rossi et al. | |
| 2016/0319363 A1 * | 11/2016 | Bentwich | .............. C12N 15/111 |

FOREIGN PATENT DOCUMENTS

WO    WO-2014160129 A2    10/2014

OTHER PUBLICATIONS

Hsu et al. Nucleic Acid Research 2006 34:D135-139.*
Brodsky. How I treat paroxysmal nocturnal hemoglobinuria. Blood. Jun. 2009; 25;113(26):6522-7.
Brodsky. Hematology: Basic Principles and Practice, Fifth Edition, Chapter 30: Paroxysmal Nocturnal Hemoglobinuria, 2009, pp. 385-394.

* cited by examiner

*Primary Examiner* — Brian A Whiteman
(74) *Attorney, Agent, or Firm* — Wolf, Greenfield & Sacks, P.C.

(57) ABSTRACT

This invention relates to compounds, compositions, and methods useful for reducing C5 target RNA and protein levels via use of dsRNAs, e.g., Dicer substrate siRNA (DsiRNA) agents.

24 Claims, 19 Drawing Sheets

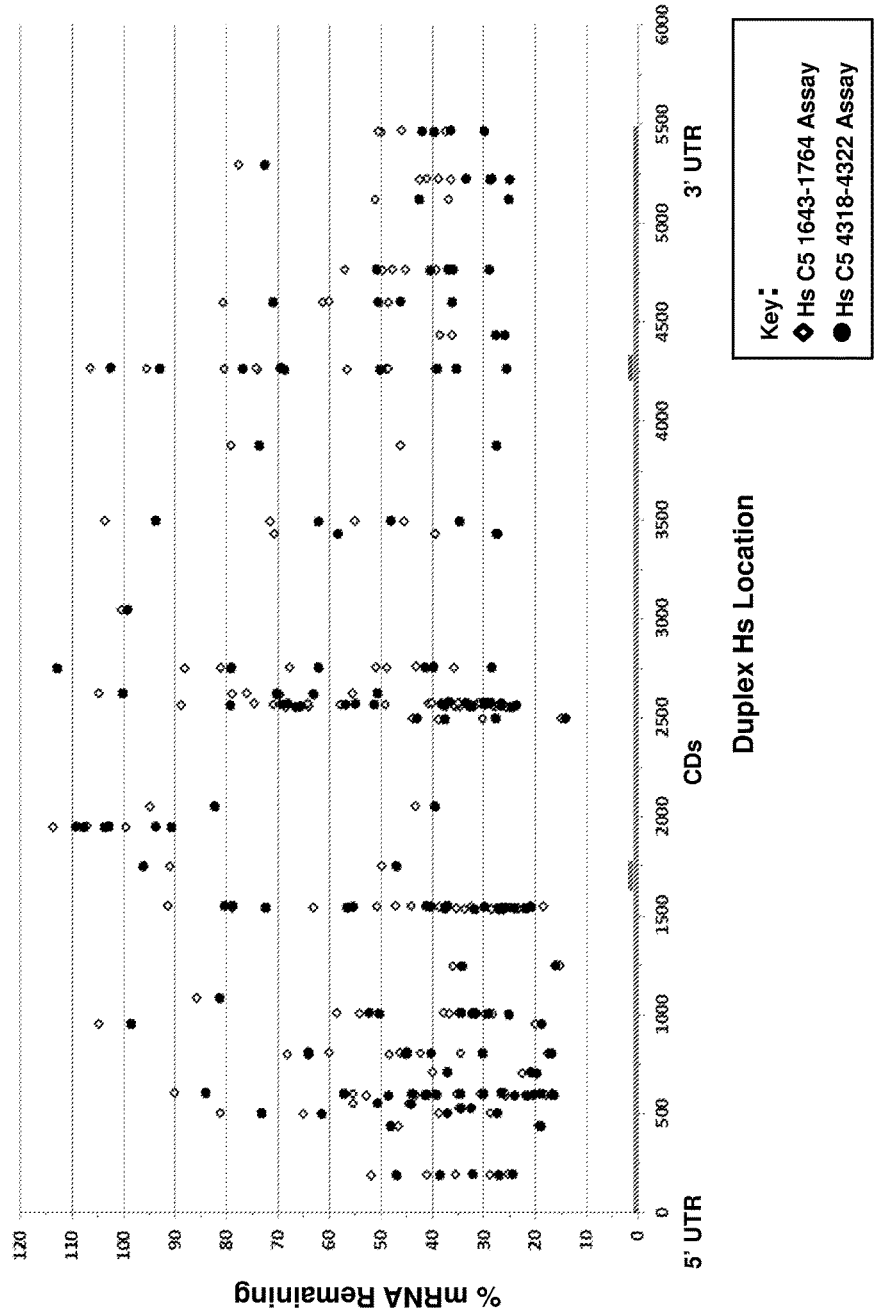

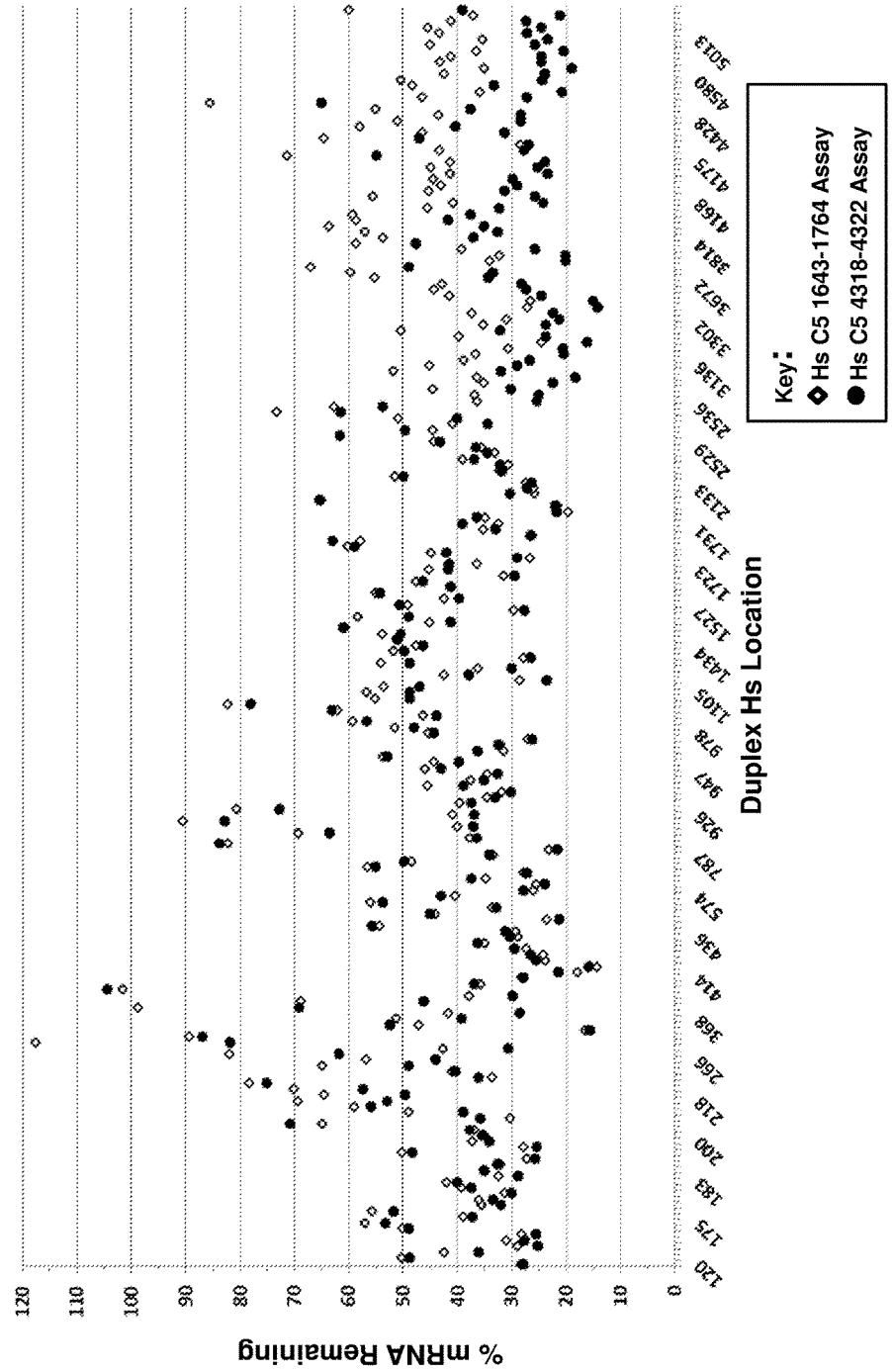

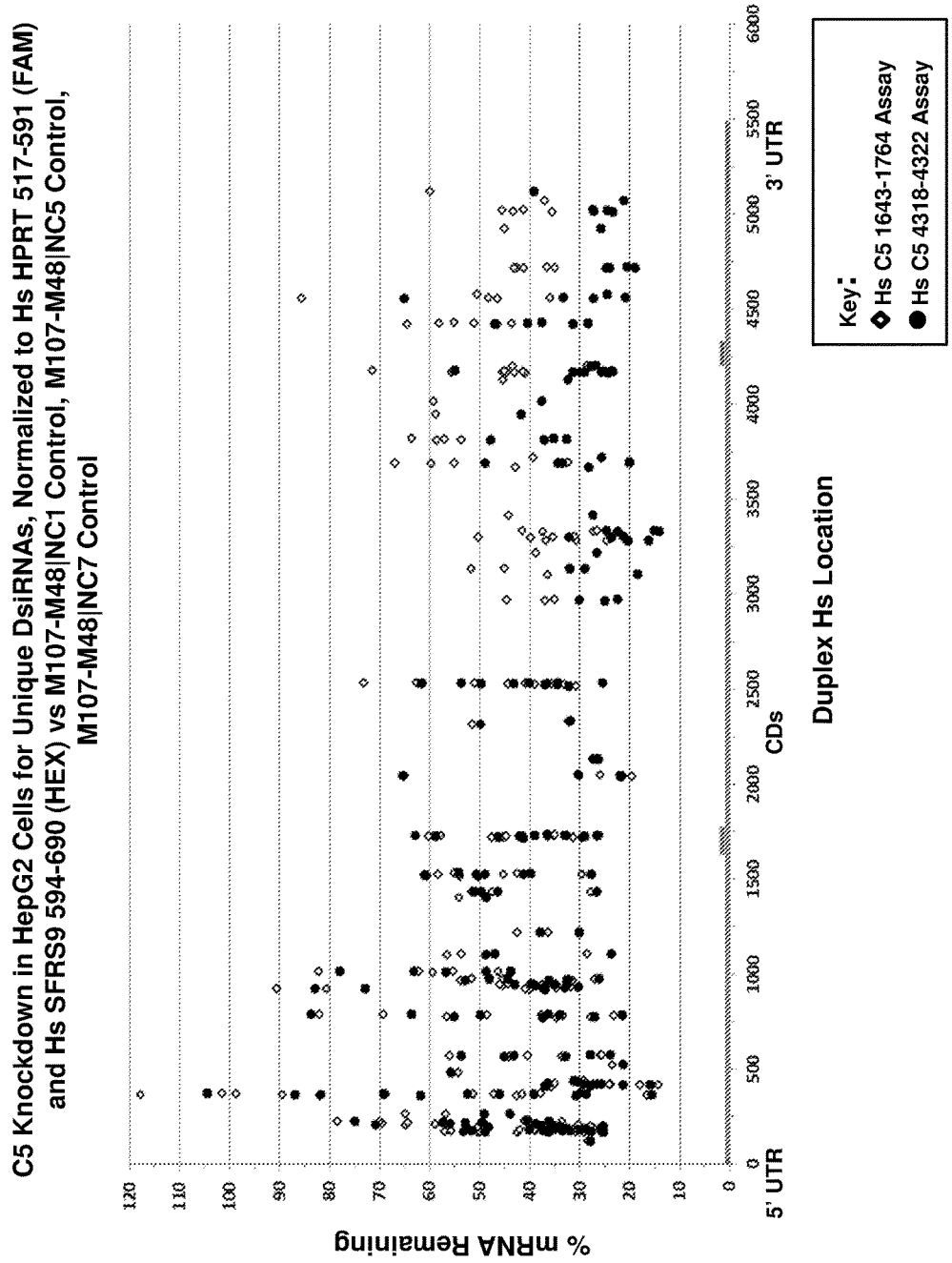

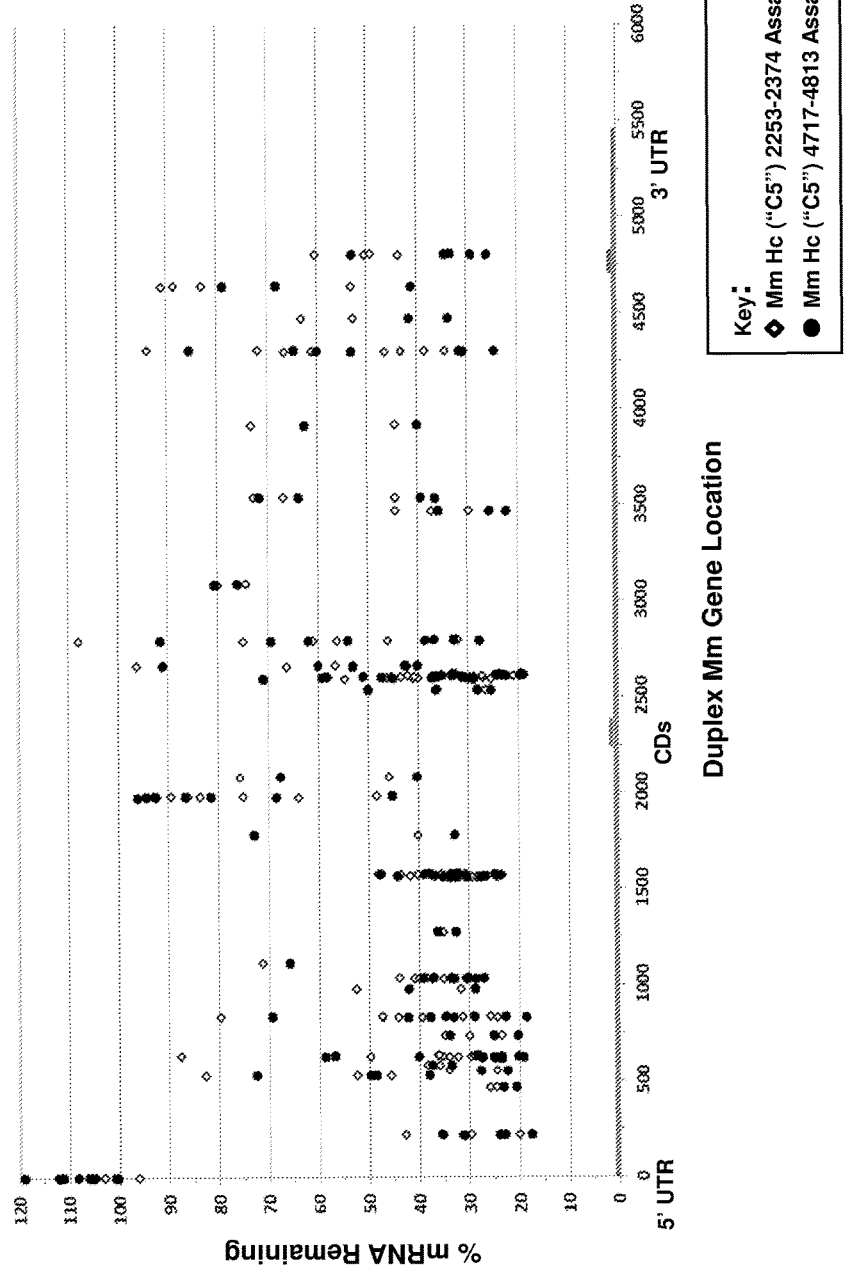

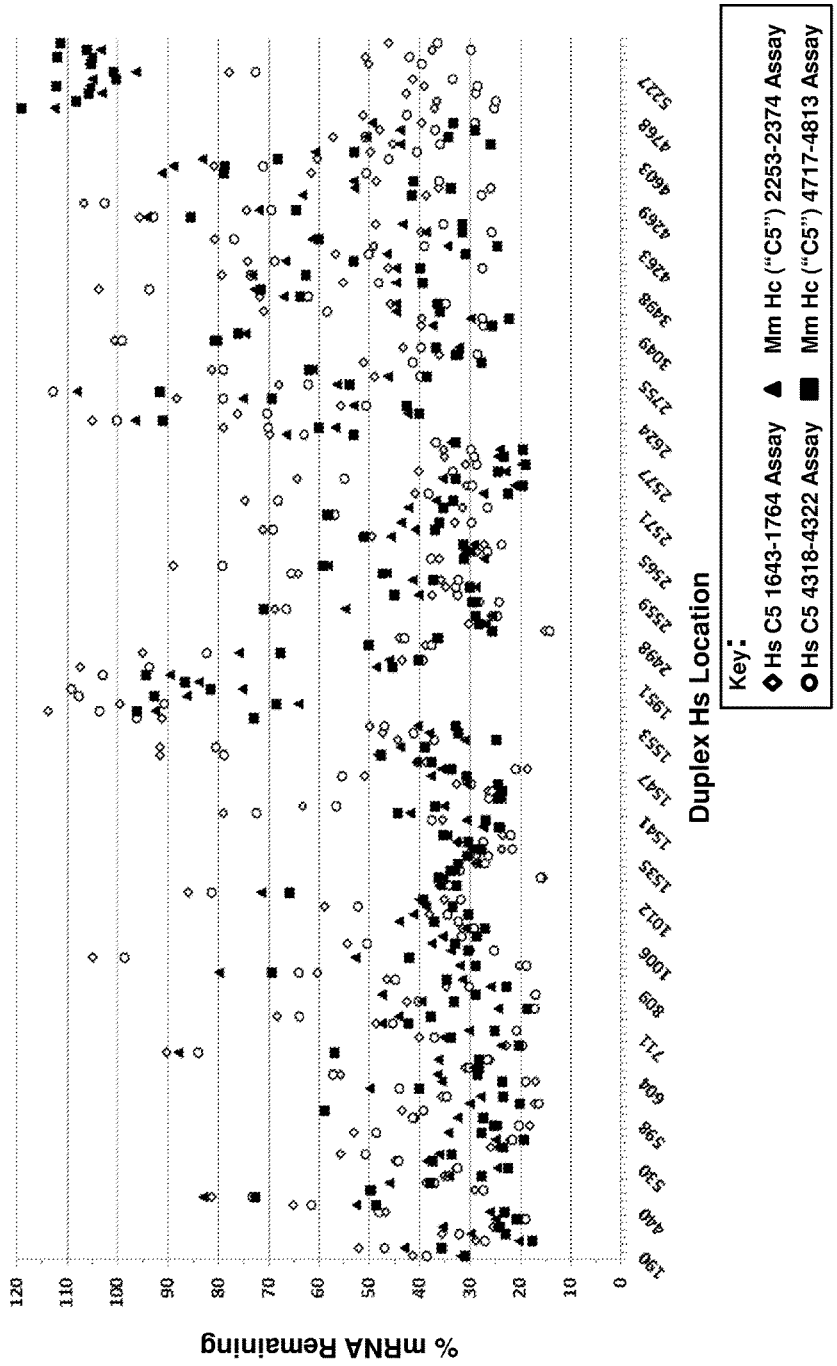

C5 Knockdown in HepG2 or LMTK– Cells for Common DsiRNAs, Normalized to Hs HPRT 517-591 (FAM) and Hs SFRS9 594-690 (HEX) or to Mm HPRT 576-664 (HEX) and Mm RPL23 139-249 (FAM) vs M107-M48|NC1 Control, M107-M48|NC5 Control, M107-M48|NC7 Control

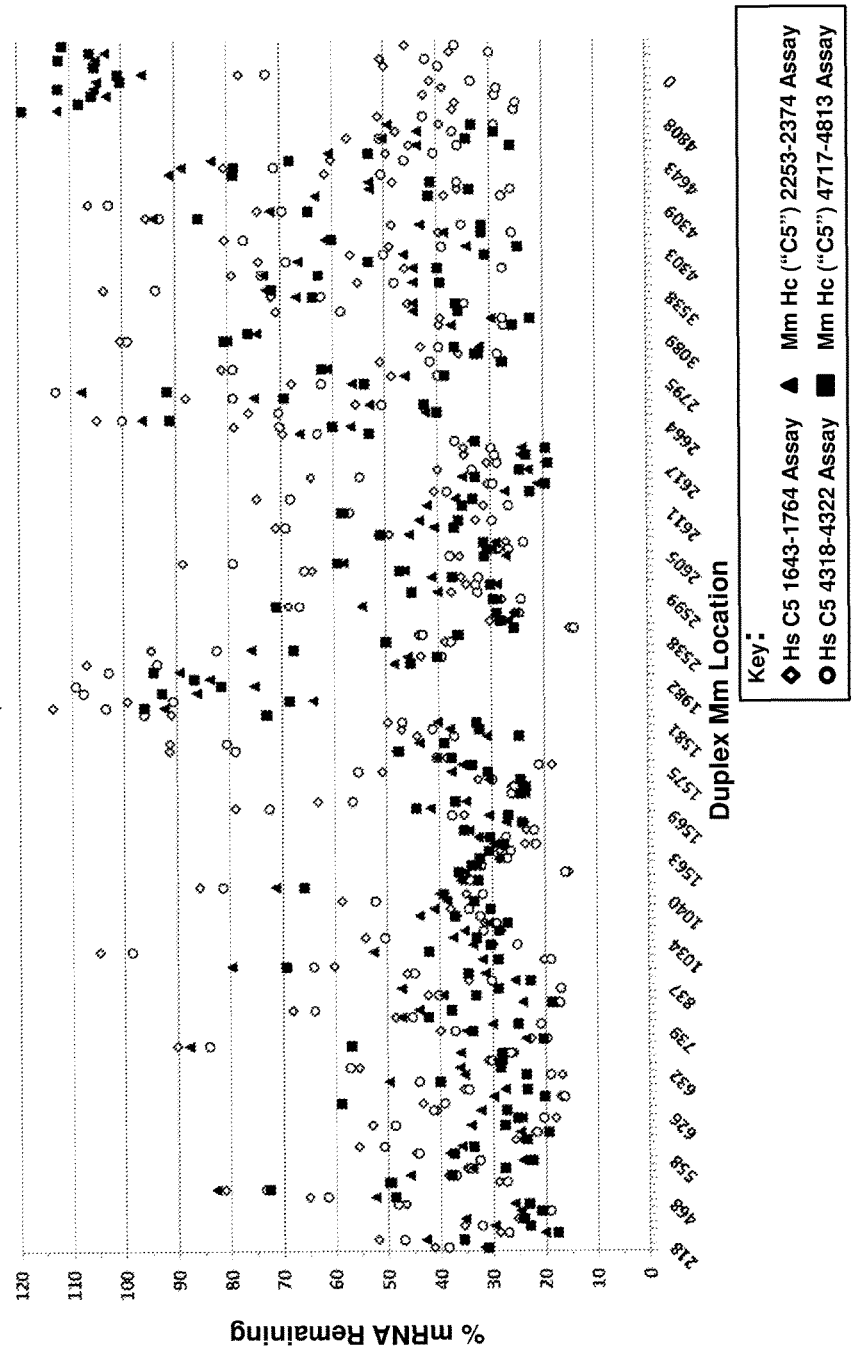

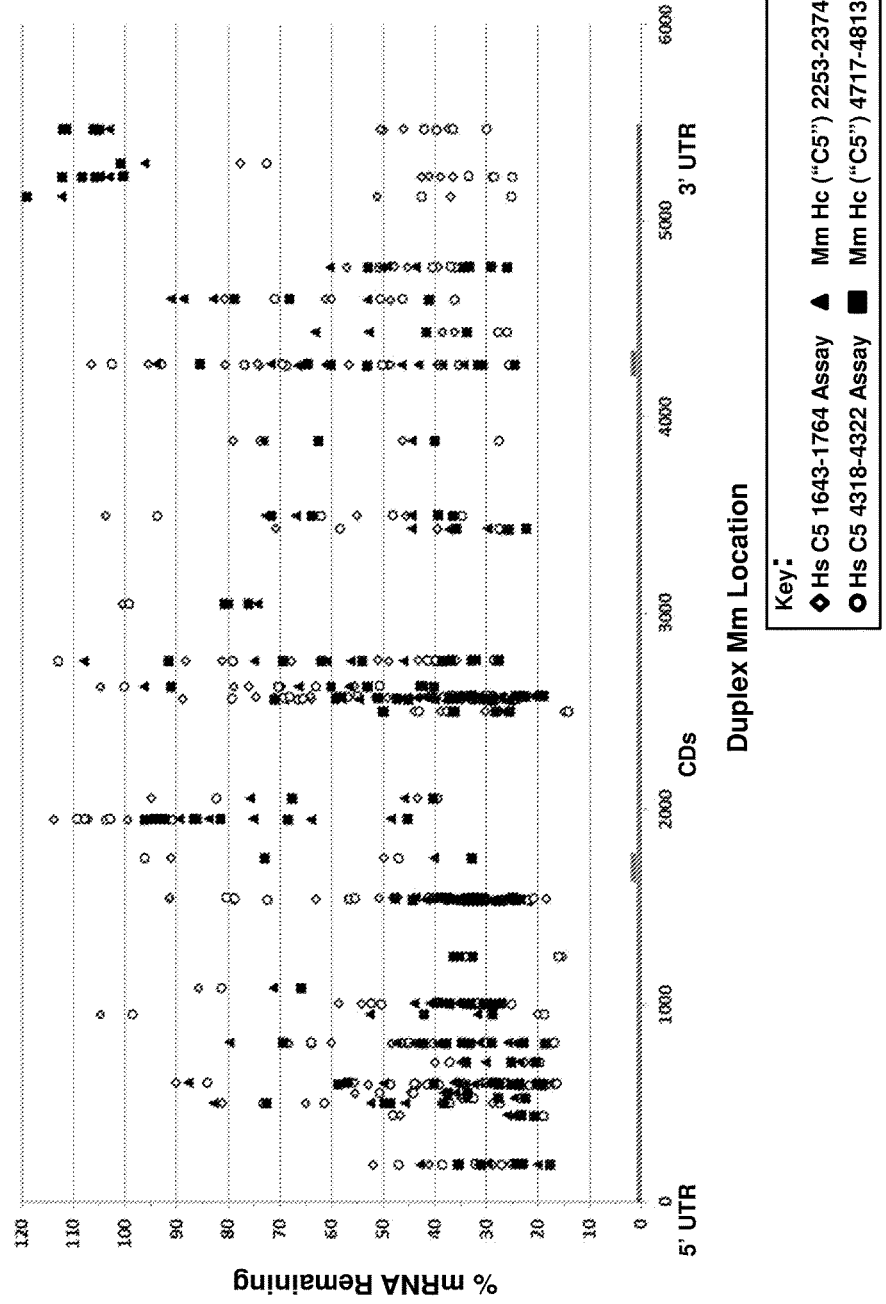

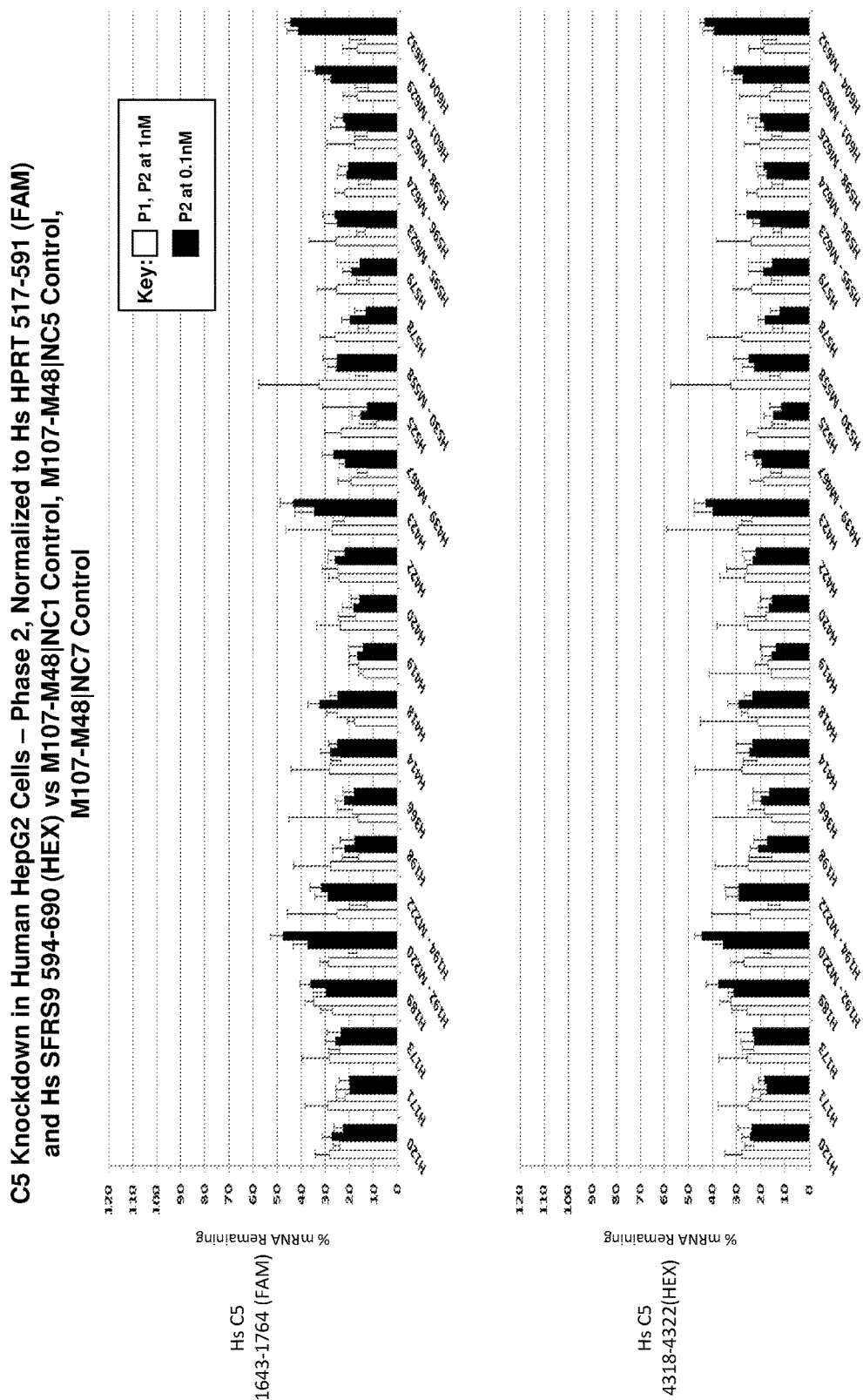

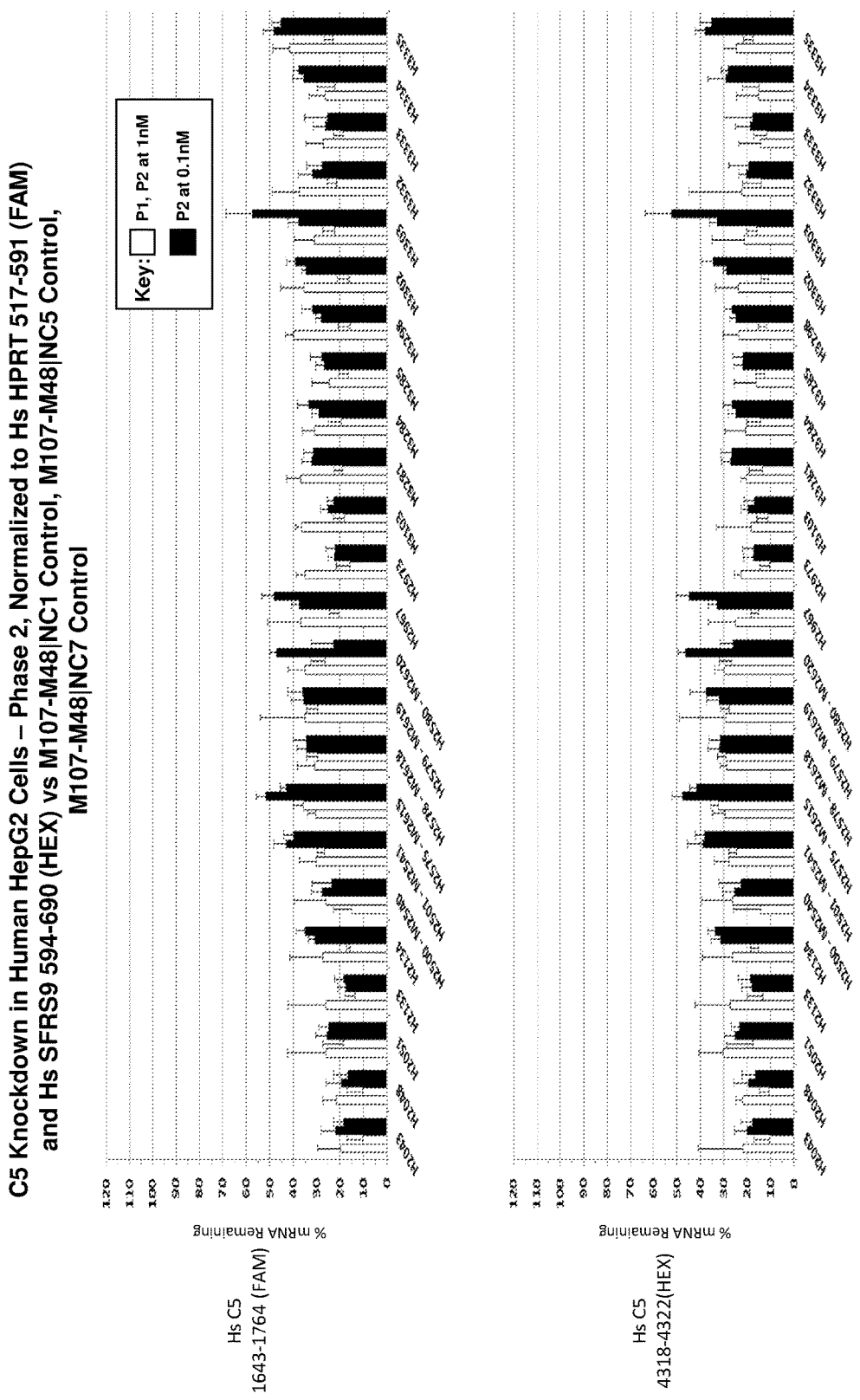

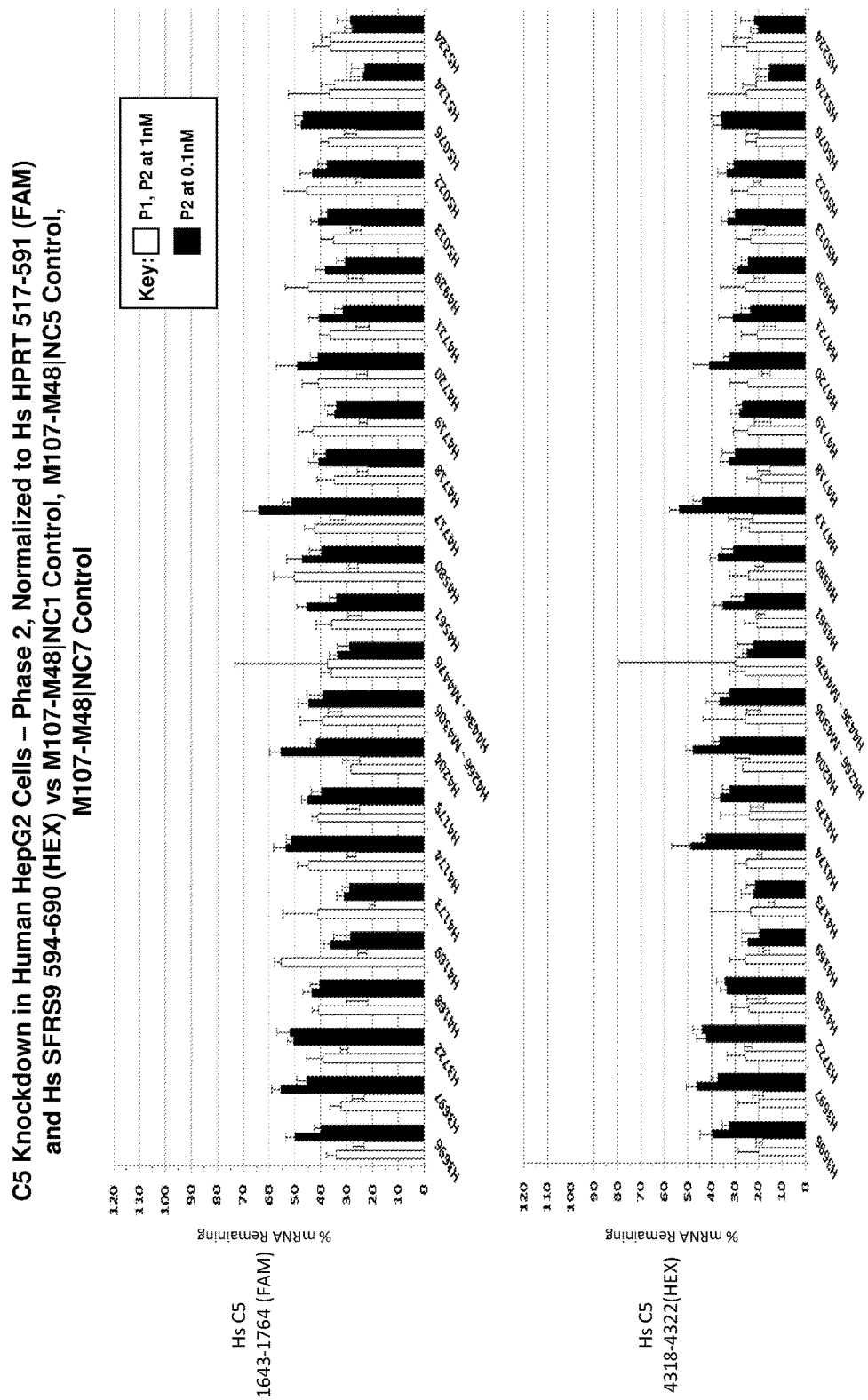

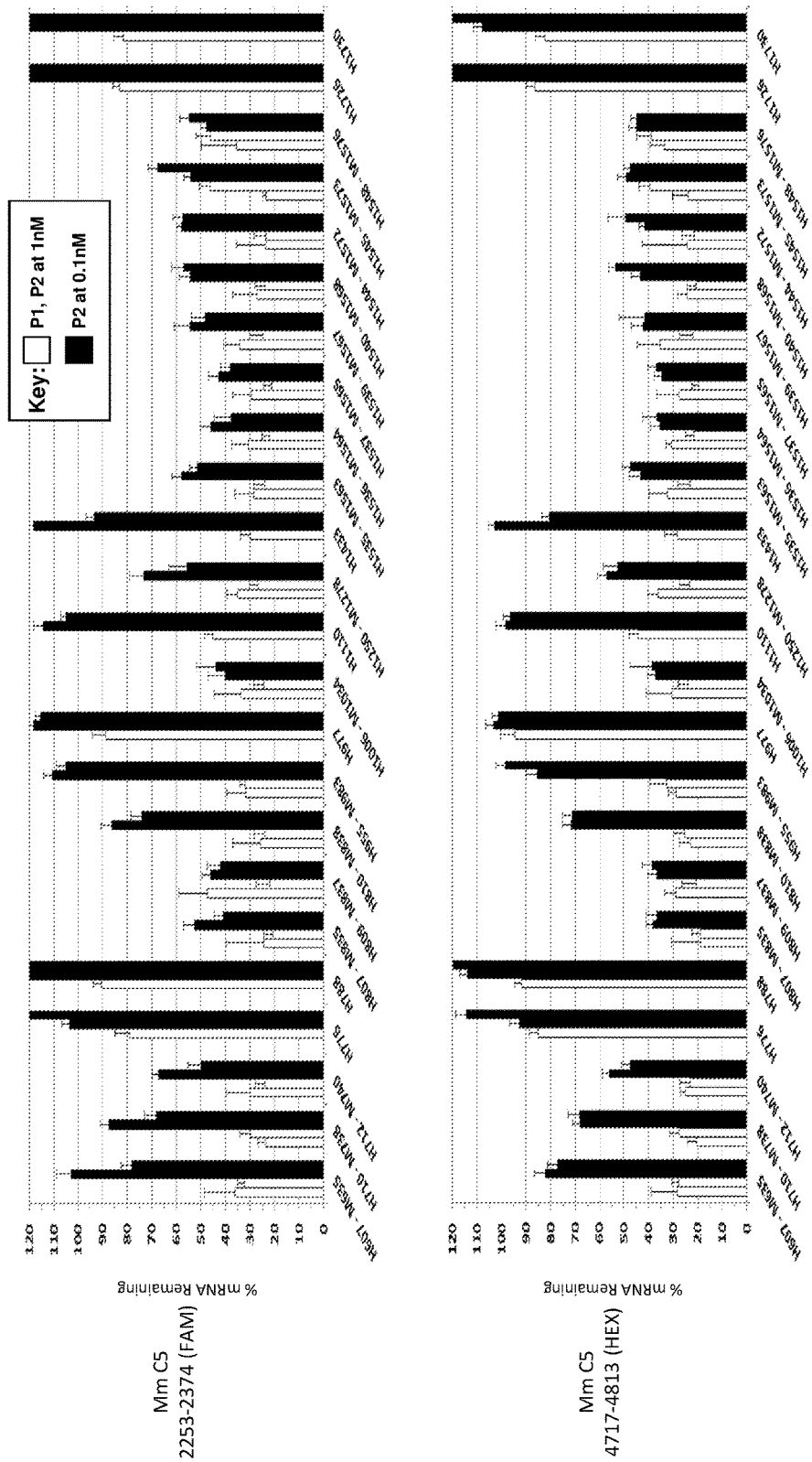

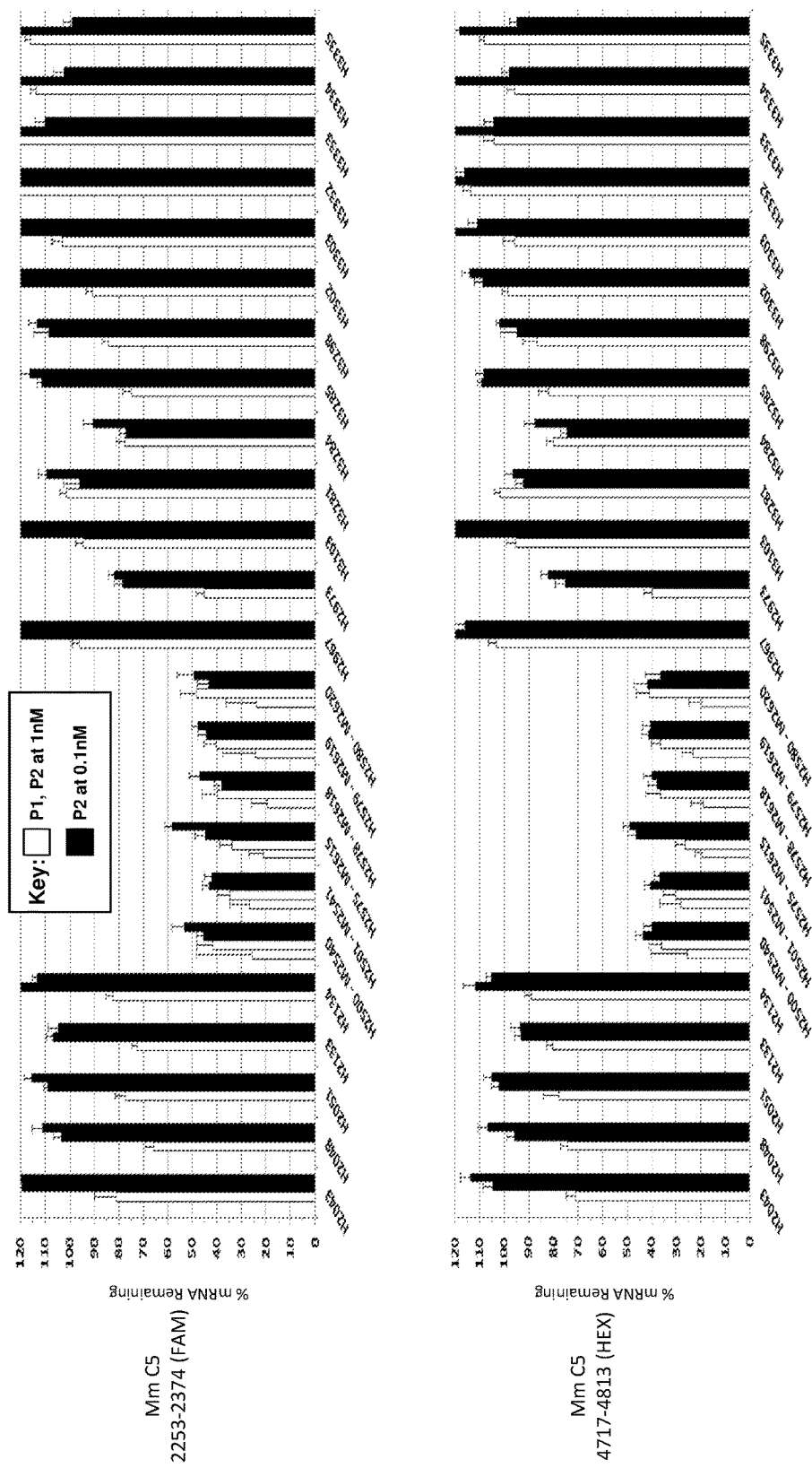

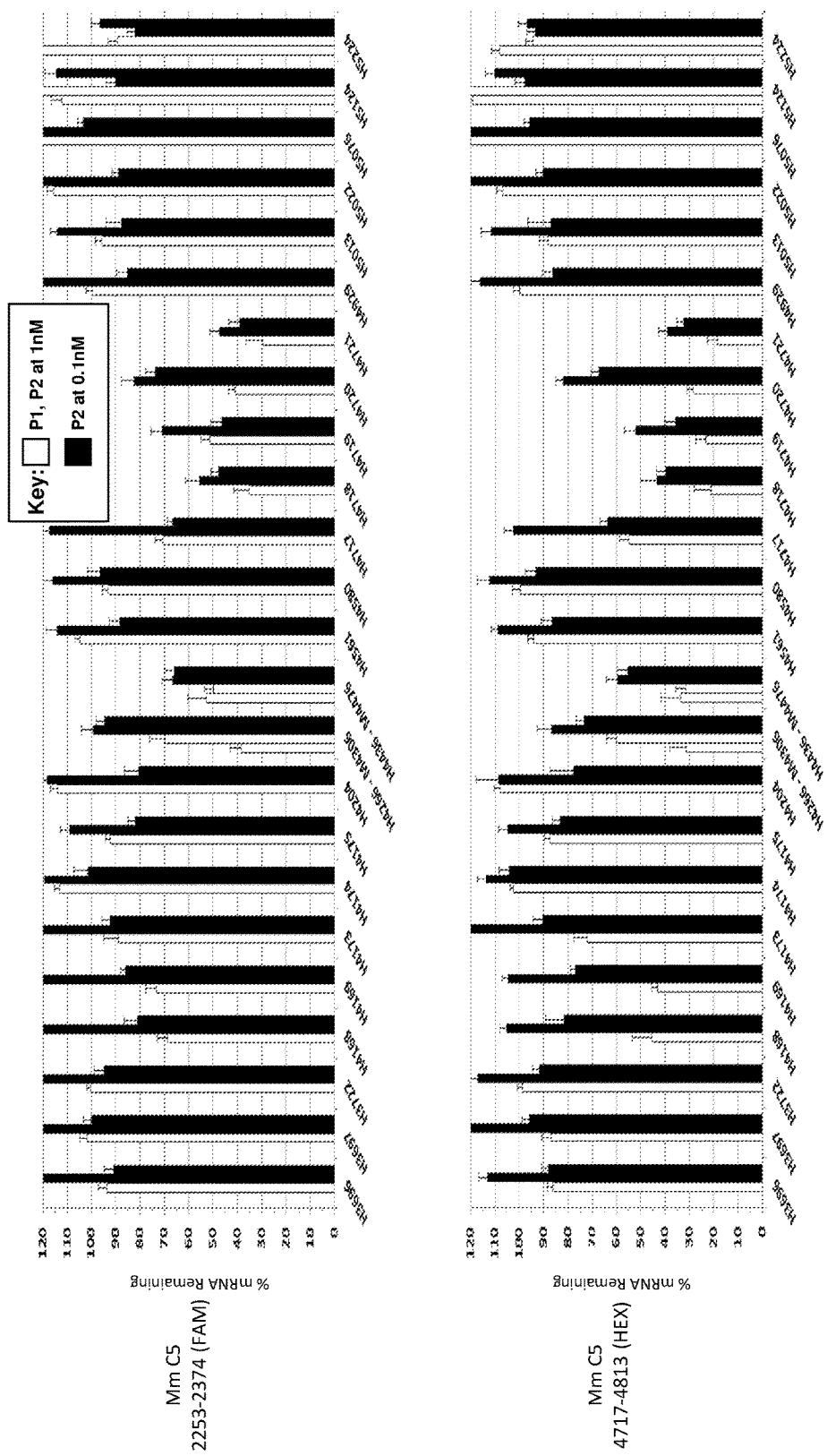

METHODS AND COMPOSITIONS FOR THE SPECIFIC INHIBITION OF COMPLEMENT COMPONENT 5(C5) BY DOUBLE-STRANDED RNA

CROSS-REFERENCE TO RELATED APPLICATIONS

This application is a U.S. utility patent application, which claims priority to, and the benefit under 35 U.S.C. § 119(e) of, U.S. provisional patent application No. 62/117,124, filed Feb. 17, 2015, entitled "Methods and Compositions for the Specific Inhibition of Complement Component 5(C5) by Double-Stranded RNA". The entire teachings of this application are incorporated herein by reference.

FIELD OF THE INVENTION

The present invention relates to compounds, compositions, and methods for the study, diagnosis, and treatment of traits, diseases and conditions that respond to the modulation of Complement Component 5 (C5) gene expression and/or activity.

SEQUENCE SUBMISSION

The present application is being filed along with a Sequence Listing in electronic format. The Sequence Listing is entitled "48292 513001US_seq_listing", was created on Feb. 16, 2016 and is 4.25 Mb in size. The information in the electronic format of the Sequence Listing is part of the present application and is incorporated herein by reference in its entirety.

BACKGROUND OF THE INVENTION

Paroxysmal nocturnal hemoglobinuria (PNH; also called Marchiafava-Micheli syndrome) is a rare, generally acquired (Luzzatto, L. *Blood* 122 (7): 1099-1100), life-threatening disease of the blood characterized by complement-induced intravascular hemolytic anemia (anemia due to destruction of red blood cells in the bloodstream), red urine (due to the appearance of hemoglobin in the urine) and thrombosis.

PNH is the only hemolytic anemia which is most often caused by an acquired (rather than inherited) intrinsic defect in the cell membrane (deficiency of glycophosphatidylinositol leading to absence of protective proteins on the membrane; Kumar Vinay et al. Robbins Basic Pathology (8th ed.). Saunders Elsevier. p. 432). It may develop on its own ("primary PNH") or in the context of other bone marrow disorders such as aplastic anemia ("secondary PNH"). Only a minority (26%) have the telltale red urine in the morning that originally gave the condition its name (Parker et al. *Blood* 106 (12): 3699-709). Allogeneic bone marrow transplantation is the only curative therapy, but has significant rates of both mortality and ongoing morbidity.

The monoclonal antibody eculizumab (Soliris) has been found to be effective at reducing the need for blood transfusions, improving quality of life, and reducing the risk of thrombosis (Brodsky, R A *Blood* 113 (26): 6522-7). Eculizumab specifically binds to the terminal Complement component 5, or C5, which acts at a late stage in the complement cascade. When activated, C5 is involved in activating host cells, thereby attracting pro-inflammatory immune cells, while also destroying cells by triggering pore formation. By inhibiting the complement cascade at this point, the normal, disease-preventing functions of proximal complement system are largely preserved, while the properties of C5 that promote inflammation and cell destruction are impeded (Brodsky et al. (2009) Hematology: Basic Principles and Practice (Philadelphia, Pa.: Churchill Livingstone): 385-395).

A need exists for additional therapies that target C5, for use either as a substitute or in combination with eculizumab.

Double-stranded RNA (dsRNA) agents possessing strand lengths of 25 to 35 nucleotides have been described as effective inhibitors of target gene expression in mammalian cells (Rossi et al., U.S. Pat. No. 8,084,599 and U.S. Patent Application No. 2005/0277610). dsRNA agents of such length are believed to be processed by the Dicer enzyme of the RNA interference (RNAi) pathway, leading such agents to be termed "Dicer substrate siRNA" ("DsiRNA") agents. Additional modified structures of DsiRNA agents were previously described (Rossi et al., U.S. Patent Application No. 2007/0265220). Effective extended forms of Dicer substrates have also recently been described (Brown, U.S. Pat. No. 8,349,809 and U.S. Pat. No. 8,513,207).

BRIEF SUMMARY OF THE INVENTION

The present invention is based, at least in part, upon the identification of C5 as an attractive target for dsRNA-based knockdown therapies. In particular, provided herein are nucleic acid agents that target and reduce expression of C5. Such compositions contain nucleic acids such as double stranded RNA ("dsRNA"), and methods for preparing them. The nucleic acids of the invention are capable of reducing the expression of a target C5 gene in a cell, either in vitro or in a mammalian subject.

In one aspect, the invention provides a nucleic acid possessing an oligonucleotide strand of 15-80 nucleotides in length, where the oligonucleotide strand is sufficiently complementary to a target C5 mRNA sequence of SEQ ID NOs: 1921-2304 along at least 15 nucleotides of the oligonucleotide strand length to reduce C5 target mRNA expression when the nucleic acid is introduced into a mammalian cell.

Another aspect of the invention provides a nucleic acid possessing an oligonucleotide strand of 19-80 nucleotides in length, where the oligonucleotide strand is sufficiently complementary to a target C5 mRNA sequence of SEQ ID NOs: 1921-2304 along at least 19 nucleotides of the oligonucleotide strand length to reduce C5 target mRNA expression when the nucleic acid is introduced into a mammalian cell.

In one embodiment, the oligonucleotide strand is 19-35 nucleotides in length.

An additional aspect of the invention provides a double stranded nucleic acid (dsNA) possessing first and second nucleic acid strands including RNA, where the first strand is 15-66 nucleotides in length and the second strand of the dsNA is 19-66 nucleotides in length, where the second oligonucleotide strand is sufficiently complementary to a target C5 mRNA sequence of SEQ ID NOs: 1921-2304 along at least 15 nucleotides of the second oligonucleotide strand length to reduce C5 target mRNA expression when the double stranded nucleic acid is introduced into a mammalian cell.

Another aspect of the invention provides a double stranded nucleic acid (dsNA) possessing first and second nucleic acid strands, where the first strand is 15-66 nucleotides in length and the second strand of the dsNA is 19-66 nucleotides in length, where the second oligonucleotide strand is sufficiently complementary to a target C5 mRNA sequence of SEQ ID NOs: 1921-2304 along at least 19 nucleotides of the second oligonucleotide strand length to reduce C5 target mRNA expression when the double stranded nucleic acid is introduced into a mammalian cell.

A further aspect of the invention provides a double stranded nucleic acid (dsNA) possessing first and second nucleic acid strands, where the first strand is 15-66 nucleotides in length and the second strand of the dsNA is 19-66 nucleotides in length, where the second oligonucleotide strand is sufficiently complementary to a target C5 mRNA sequence of SEQ ID NOs: 1921-2304 along at least 19 nucleotides of the second oligonucleotide strand length to reduce C5 target mRNA expression, and where, starting from the 5' end of the C5 mRNA sequence of SEQ ID NOs: 1921-2304 (position 1), mammalian Ago2 cleaves the mRNA at a site between positions 9 and 10 of the sequence, when the double stranded nucleic acid is introduced into a mammalian cell.

Another aspect of the invention provides a dsNA molecule, consisting of: (a) a sense region and an antisense region, where the sense region and the antisense region together form a duplex region consisting of 25-66 base pairs and the antisense region includes a sequence that is the complement of a sequence of SEQ ID NOs: 1921-2304; and (b) from zero to two 3' overhang regions, where each overhang region is six or fewer nucleotides in length, and where, starting from the 5' end of the C5 mRNA sequence of SEQ ID NOs: 1921-2304 (position 1), mammalian Ago2 cleaves the mRNA at a site between positions 9 and 10 of the sequence, when the double stranded nucleic acid is introduced into a mammalian cell.

An additional aspect of the invention provides a double stranded nucleic acid (dsNA) possessing first and second nucleic acid strands and a duplex region of at least 25 base pairs, where the first strand is 25-65 nucleotides in length and the second strand of the dsNA is 26-66 nucleotides in length and includes 1-5 single-stranded nucleotides at its 3' terminus, where the second oligonucleotide strand is sufficiently complementary to a target C5 mRNA sequence of SEQ ID NOs: 1921-2304 along at least 19 nucleotides of the second oligonucleotide strand length to reduce C5 target gene expression when the double stranded nucleic acid is introduced into a mammalian cell.

Another aspect of the invention provides a double stranded nucleic acid (dsNA) possessing first and second nucleic acid strands and a duplex region of at least 25 base pairs, where the first strand is 25-65 nucleotides in length and the second strand of the dsNA is 26-66 nucleotides in length and includes 1-5 single-stranded nucleotides at its 3' terminus, where the 3' terminus of the first oligonucleotide strand and the 5' terminus of the second oligonucleotide strand form a blunt end, and the second oligonucleotide strand is sufficiently complementary to a target C5 sequence of SEQ ID NOs: 1921-2304 along at least 19 nucleotides of the second oligonucleotide strand length to reduce C5 mRNA expression when the double stranded nucleic acid is introduced into a mammalian cell.

In one embodiment, the first strand is 15-35 nucleotides in length.

In another embodiment, the second strand is 19-35 nucleotides in length.

In an additional embodiment, the dsNA possesses a duplex region of at least 25 base pairs; 19-21 base pairs or 21-25 base pairs.

Optionally, the second oligonucleotide strand includes 1-5 single-stranded nucleotides at its 3' terminus.

In one embodiment, the second oligonucleotide strand includes 5-35 single-stranded nucleotides at its 3' terminus.

In another embodiment, the single-stranded nucleotides include modified nucleotides. Optionally, the single-stranded nucleotides include 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2)2-O-2'-bridge, 2'-LNA, 2'-amino and/or 2'-O—(N-methylcarbamate) modified nucleotides.

In certain embodiments, the single-stranded nucleotides include ribonucleotides. Optionally, the single-stranded nucleotides include deoxyribonucleotides.

In certain embodiments, the 3' end of the first strand and the 5' end of the second strand of a dsNA or hybridization complex of the invention are joined by a polynucleotide sequence that includes ribonucleotides, deoxyribonucleotides or both, optionally the polynucleotide sequence includes a tetraloop sequence.

In one embodiment, the first strand is 25-35 nucleotides in length. Optionally, the second strand is 25-35 nucleotides in length.

In one embodiment, the second oligonucleotide strand is complementary to target C5 cDNA sequence GenBank Accession No. NM_001735.2 along at most 27 nucleotides of the second oligonucleotide strand length.

In another embodiment, starting from the first nucleotide (position 1) at the 3' terminus of the first oligonucleotide strand, position 1, 2 and/or 3 is substituted with a modified nucleotide.

Optionally, the first strand and the 5' terminus of the second strand form a blunt end.

In one embodiment, the first strand is 25 nucleotides in length and the second strand is 27 nucleotides in length.

In another embodiment, starting from the 5' end of a C5 mRNA sequence of SEQ ID NOs: 1921-2304 (position 1), mammalian Ago2 cleaves the mRNA at a site between positions 9 and 10 of the sequence, thereby reducing C5 target mRNA expression when the double stranded nucleic acid is introduced into a mammalian cell.

In one embodiment, the second strand includes a sequence of SEQ ID NOs: 385-768. In an additional embodiment, the first strand includes a sequence of SEQ ID NOs: 1-384.

In another embodiment, the dsNA of the invention possesses a pair of first strand/second strand sequences of Table 2.

Optionally, the modified nucleotide residue of the 3' terminus of the first strand is a deoxyribonucleotide, an acyclonucleotide or a fluorescent molecule.

In one embodiment, position 1 of the 3' terminus of the first oligonucleotide strand is a deoxyribonucleotide.

In another embodiment, the nucleotides of the 1-5 or 5-35 single-stranded nucleotides of the 3' terminus of the second strand comprise a modified nucleotide.

In one embodiment, the modified nucleotide of the 1-5 or 5-35 single-stranded nucleotides of the 3' terminus of the second strand is a 2'-O-methyl ribonucleotide.

In an additional embodiment, all nucleotides of the 1-5 or 5-35 single-stranded nucleotides of the 3' terminus of the second strand are modified nucleotides.

In another embodiment, the dsNA includes a modified nucleotide. Optionally, the modified nucleotide residue is 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2)2-O-2'-bridge, 2'-LNA, 2'-amino or 2'-O—(N-methylcarbamate).

In one embodiment, the 1-5 or 5-35 single-stranded nucleotides of the 3' terminus of the second strand are 1-3 nucleotides in length, optionally 1-2 nucleotides in length.

In another embodiment, the 1-5 or 5-35 single-stranded nucleotides of the 3' terminus of the second strand is two nucleotides in length and includes a 2'-O-methyl modified ribonucleotide.

In one embodiment, the second oligonucleotide strand includes a modification pattern of AS-M1 to AS-M96, AS-M101, AS-M104 to AS-M117, AS-M120 to AS-M164, AS-M210 to AS-M255, AS-M1* to AS-M96*, AS-M101*, AS-M104* to AS-M117*, AS-M120* to AS-M164*, or AS-M210* to AS-M255*.

In another embodiment, the first oligonucleotide strand includes a modification pattern of SM1 to SM130, SM133 to SM138, SM140 to SM160, SM250, SM253, SM255 to SM271, SM275 to SM289 and SM300 to SM310.

In an additional embodiment, each of the first and the second strands has a length which is at least 26 and at most 30 nucleotides.

In one embodiment, the dsNA is cleaved endogenously in the cell by Dicer.

In another embodiment, the amount of the nucleic acid sufficient to reduce expression of the target gene is of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of the cell.

In one embodiment, the dsNA possesses greater potency than a 21mer siRNA directed to the identical at least 19 nucleotides of the target C5 mRNA in reducing target C5 mRNA expression when assayed in vitro in a mammalian cell at an effective concentration in the environment of a cell of 1 nanomolar or less.

In an additional embodiment, the nucleic acid or dsNA is sufficiently complementary to the target C5 mRNA sequence to reduce C5 target mRNA expression by an amount (expressed by %) of at least 10%, at least 50%, at least 80-90%, at least 95%, at least 98%, or at least 99% when the double stranded nucleic acid is introduced into a mammalian cell.

In one embodiment, the first and second strands are joined by a chemical linker.

In another embodiment, the 3' terminus of the first strand and the 5' terminus of the second strand are joined by a chemical linker.

In an additional embodiment, a nucleotide of the second or first strand is substituted with a modified nucleotide that directs the orientation of Dicer cleavage.

In one embodiment, the nucleic acid, dsNA or hybridization complex possesses a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC) and a monophosphate nucleotide of 2',3'-didehydro-2',3'-dideoxythymidine (d4T), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, or a locked nucleic acid modified nucleotide.

In another embodiment, the nucleic acid, dsNA or hybridization complex includes a phosphonate, a phosphorothioate or a phosphotriester phosphate backbone modification.

In one embodiment, the nucleic acid, dsNA or hybridization complex includes a morpholino nucleic acid or a peptide nucleic acid (PNA).

In an additional embodiment, the nucleic acid, dsNA or hybridization complex is attached to a dynamic polyconjugate (DPC).

In one embodiment, the nucleic acid, dsNA or hybridization complex is administered with a DPC, where the dsNA and DPC are optionally not attached.

In another embodiment, the nucleic acid, dsNA or hybridization complex is attached to a GalNAc moiety, a cholesterol and/or a cholesterol targeting ligand.

Another aspect of the invention provides a composition of the following:

a dsNA possessing first and second nucleic acid strands, where the first strand is 15-35 nucleotides in length and the second strand of the dsNA is 19-35 nucleotides in length, where the second oligonucleotide strand is sufficiently complementary to a target C5 mRNA sequence of SEQ ID NOs: 1921-2304 along at least 19 nucleotides of the second oligonucleotide strand length to reduce C5 target mRNA expression when the double stranded nucleic acid is introduced into a mammalian cell;

a dsNA possessing first and second nucleic acid strands, where the first strand is 15-35 nucleotides in length and the second strand of the dsNA is 19-35 nucleotides in length, where the second oligonucleotide strand is sufficiently complementary to a target C5 mRNA sequence of SEQ ID NOs: 1921-2304 along at least 19 nucleotides of the second oligonucleotide strand length to reduce C5 target mRNA expression, and where, starting from the 5' end of the C5 mRNA sequence of SEQ ID NOs: 1921-2304 (position 1), mammalian Ago2 cleaves the mRNA at a site between positions 9 and 10 of the sequence, when the double stranded nucleic acid is introduced into a mammalian cell;

a dsNA molecule, consisting of: (a) a sense region and an antisense region, where the sense region and the antisense region together form a duplex region consisting of 25-35 base pairs and the antisense region includes a sequence that is the complement of a sequence of SEQ ID NOs: 1921-2304; and (b) from zero to two 3' overhang regions, where each overhang region is six or fewer nucleotides in length, and where, starting from the 5' end of the C5 mRNA sequence of SEQ ID NOs: 1921-2304 (position 1), mammalian Ago2 cleaves the mRNA at a site between positions 9 and 10 of the sequence, when the double stranded nucleic acid is introduced into a mammalian cell;

a dsNA possessing first and second nucleic acid strands and a duplex region of at least 25 base pairs, where the first strand is 25-34 nucleotides in length and the second strand of the dsNA is 26-35 nucleotides in length and includes 1-5 single-stranded nucleotides at its 3' terminus, where the second oligonucleotide strand is sufficiently complementary to a target C5 mRNA sequence of SEQ ID NOs: 1921-2304 along at least 19 nucleotides of the second oligonucleotide strand length to reduce C5 target gene expression when the double stranded nucleic acid is introduced into a mammalian cell;

a dsNA possessing first and second nucleic acid strands and a duplex region of at least 25 base pairs, where the first strand is 25-34 nucleotides in length and the second strand of the dsNA is 26-35 nucleotides in length and includes 1-5 single-stranded nucleotides at its 3' terminus, where the 3' terminus of the first oligonucleotide strand and the 5' terminus of the second oligonucleotide strand form a blunt end, and the second oligonucleotide strand is sufficiently complementary to a target C5 sequence of SEQ ID NOs: 1921-2304 along at least 19 nucleotides of the second oligonucleotide strand length to reduce C5 mRNA expression when the double stranded nucleic acid is introduced into a mammalian cell;

a nucleic acid possessing an oligonucleotide strand of 19-35 nucleotides in length, where the oligonucleotide strand is sufficiently complementary to a target C5 mRNA sequence of SEQ ID NOs: 1921-2304 along at least 19 nucleotides of the oligonucleotide strand length to reduce C5 target mRNA expression when the nucleic acid is introduced into a mammalian cell;

a nucleic acid possessing an oligonucleotide strand of 15-35 nucleotides in length, where the oligonucleotide strand is hybridizable to a target C5 mRNA sequence of SEQ ID NOs: 1921-2304 along at least 15 nucleotides of the oligonucleotide strand length;

a dsNA possessing first and second nucleic acid strands possessing RNA, where the first strand is 15-35 nucleotides in length and the second strand of the dsNA is 19-35 nucleotides in length, where the second oligonucleotide strand is hybridizable to a target C5 mRNA sequence of SEQ ID NOs: 1921-2304 along at least 15 nucleotides of the second oligonucleotide strand length;

a dsNA possessing first and second nucleic acid strands possessing RNA, where the first strand is 15-35 nucleotides in length and the second strand of the dsNA is at least 35 nucleotides in length and optionally includes a sequence of at least 25 nucleotides in length of SEQ ID NOs: 385-768, where the second oligonucleotide strand is sufficiently complementary to a target C5 mRNA sequence of SEQ ID NOs: 1921-2304 along at least 15 nucleotides of the second oligonucleotide strand length to reduce C5 target mRNA expression when the double stranded nucleic acid is introduced into a mammalian cell;

a dsNA possessing a first oligonucleotide strand having a 5' terminus and a 3' terminus and a second oligonucleotide strand having a 5' terminus and a 3' terminus, where the first strand is 25 to 53 nucleotide residues in length, where starting from the first nucleotide (position 1) at the 5' terminus of the first strand, positions 1 to 23 of the first strand are ribonucleotides or modified ribonucleotides; the second strand is 27 to 53 nucleotide residues in length and includes 23 consecutive ribonucleotides or modified ribonucleotides that base pair with the ribonucleotides or ribonucleotides of positions 1 to 23 of the first strand to form a duplex; the 5' terminus of the first strand and the 3' terminus of the second strand form a structure of a blunt end, a 1-6 nucleotide 5' overhang and a 1-6 nucleotide 3' overhang; the 3' terminus of the first strand and the 5' terminus of the second strand form a structure of a blunt end, a 1-6 nucleotide 5' overhang and a 1-6 nucleotide 3' overhang; at least one of positions 24 to the 3' terminal nucleotide residue of the first strand is a deoxyribonucleotide or modified ribonucleotide that optionally base pairs with a deoxyribonucleotide of the second strand; and the second strand is sufficiently complementary to a target C5 mRNA sequence of SEQ ID NOs: 1921-2304 along at least 15 nucleotides of the second oligonucleotide strand length to reduce C5 target mRNA expression when the double stranded nucleic acid is introduced into a mammalian cell;

a dsNA possessing a first oligonucleotide strand having a 5' terminus and a 3' terminus and a second oligonucleotide strand having a 5' terminus and a 3' terminus, where the second strand is 27 to 53 nucleotide residues in length, where starting from the first nucleotide (position 1) at the 5' terminus of the second strand, positions 1 to 23 of the second strand are ribonucleotides or modified ribonucleotides; the first strand is 25 to 53 nucleotide residues in length and includes 23 consecutive ribonucleotides or modified ribonucleotides that base pair sufficiently with the ribonucleotides of positions 1 to 23 of the second strand to form a duplex; at least one of positions 24 to the 3' terminal nucleotide residue of the second strand is a deoxyribonucleotide or modified ribonucleotide, optionally that base pairs with a deoxyribonucleotide or modified ribonucleotide of the first strand; and the second strand is sufficiently complementary to a target C5 mRNA sequence of SEQ ID NOs: 1921-2304 along at least 15 nucleotides of the second oligonucleotide strand length to reduce C5 target mRNA expression when the double stranded nucleic acid is introduced into a mammalian cell;

a dsNA possessing a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the first strand (or the second strand) is 25-30 nucleotide residues in length, where starting from the 5' terminal nucleotide (position 1) positions 1 to 23 of the first strand (or the second strand) include at least 8 ribonucleotides; the second strand (or the first strand) is 36-66 nucleotide residues in length and, starting from the 3' terminal nucleotide, includes at least 8 ribonucleotides in the positions paired with positions 1-23 of the first strand to form a duplex; where at least the 3' terminal nucleotide of the second strand (or the first strand) is unpaired with the first strand (or the second strand), and up to 6 consecutive 3' terminal nucleotides are unpaired with the first strand (or the second strand), thereby forming a 3' single stranded overhang of 1-6 nucleotides; where the 5' terminus of the second strand (or the first strand) includes from 10-30 consecutive nucleotides which are unpaired with the first strand (or the second strand), thereby forming a 10-30 nucleotide single stranded 5' overhang; where at least the first strand (or the second strand) 5' terminal and 3' terminal nucleotides are base paired with nucleotides of the second strand (or first strand) when the first and second strands are aligned for maximum complementarity, thereby forming a substantially duplexed region between the first and second strands; and the second strand is sufficiently complementary to a target RNA along at least 19 ribonucleotides of the second strand length to reduce target gene expression when the double stranded nucleic acid is introduced into a mammalian cell;

a dsNA possessing a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the first strand is 25-35 nucleotide residues in length, where starting from the 5' terminal nucleotide (position 1) positions 1 to 25 of the second strand include at least 8 ribonucleotides; the second strand is 30-66 nucleotide residues in length and, starting from the 3' terminal nucleotide, includes at least 8 ribonucleotides in the positions paired with positions 1-25 of the first strand to form a duplex; where the 5' terminus of the second strand includes from 5-35 consecutive nucleotides which are unpaired with the first strand, thereby forming a 5-35 nucleotide single stranded 5' overhang; where at least the first strand 5' terminal and 3' terminal nucleotides are base paired with nucleotides of the second strand when the first and second strands are aligned for maximum complementarity, thereby forming a substantially duplexed region between the first and second strands; and the second strand is sufficiently complementary to a target C5 mRNA sequence of SEQ ID NOs: 1921-2304 along at least 15 nucleotides of the second oligonucleotide strand length to reduce C5 target mRNA expression when the double stranded nucleic acid is introduced into a mammalian cell;

a dsNA possessing a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the second strand is 19-30 nucleotide residues in length and optionally 25-30 nucleotide residues in length, where starting from the 5' terminal nucleotide (position 1) positions 1 to 17 (optionally positions 1 to 23) of the second strand include at least 8 ribonucleotides; the first strand is 24-66 nucleotide residues in length (optionally 30-66 nucleotide residues in length) and, starting from the 3' terminal nucleotide, includes at least 8 ribonucleotides in the positions paired with positions 1 to 17 (optionally positions 1 to 23) of the second strand to form a duplex; where the 3' terminus of the first strand and the 5' terminus of the second strand comprise a structure of a blunt end, a 3' overhang and a 5' overhang, optionally where the overhang is 1-6 nucleotides in length; where the 5' terminus of the first strand includes from 5-35 consecutive nucleotides which are unpaired with the second strand, thereby forming a 5-35 nucleotide single-stranded 5' overhang; where at least the second strand 5' terminal and 3' terminal nucleotides are base paired with nucleotides of the first strand when the first and second strands are aligned for maximum complementarity, thereby forming a substantially duplexed region between the first and second strands; and the second strand is sufficiently complementary to a target C5 mRNA sequence of SEQ ID NOs: 1921-2304 along at least 15 nucleotides of the second oligonucleotide strand length to reduce C5 target mRNA expression when the double stranded nucleic acid is introduced into a mammalian cell;

a dsNA possessing a first strand and a second strand, where the first strand and the second strand form a duplex region of 19-25 nucleotides in length, where the first strand includes a 3' region that extends beyond the first strand-second strand duplex region and includes a tetraloop, and the dsNA further includes a discontinuity between the 3' terminus of the first strand and the 5' terminus of the second strand, and the first or second strand is sufficiently complementary to a target C5 mRNA sequence of SEQ ID NOs: 1921-2304 along at least 15 nucleotides of the first or second strand length to reduce C5 target mRNA expression when the dsNA is introduced into a mammalian cell;

a dsNA possessing a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the first oligonucleotide strand is 25-53 nucleotides in length and the second is oligonucleotide strand is 25-53 nucleotides in length, and where the dsNA is sufficiently highly modified to substantially prevent dicer cleavage of the dsNA, optionally where the dsNA is cleaved by non-dicer nucleases to yield one or more 19-23 nucleotide strand length dsNAs capable of reducing LDH mRNA expression in a mammalian cell;

an in vivo hybridization complex within a cell of an exogenous nucleic acid sequence and a target C5 mRNA sequence of SEQ ID NOs: 1921-2304; and an in vitro hybridization complex within a cell of an exogenous nucleic acid sequence and a target C5 mRNA sequence of SEQ ID NOs: 1921-2304.

In one embodiment, a dsNA of the invention possesses a duplex region of at least 25 base pairs, where the dsNA possesses greater potency than a 21mer siRNA directed to the identical at least 19 nucleotides of the target C5 mRNA in reducing target C5 mRNA expression when assayed in vitro in a mammalian cell at an effective concentration in the environment of a cell of 1 nanomolar or less.

In another embodiment, the dsNA of the invention has a duplex region of at least 25 base pairs, where the dsNA possesses greater potency than a 21mer siRNA directed to the identical at least 19 nucleotides of the target C5 mRNA in reducing target C5 mRNA expression when assayed in vitro in a mammalian cell at a concentration of 1 nanomolar, 200 picomolar, 100 picomolar, 50 picomolar, 20 picomolar, 10 picomolar, 5 picomolar, 2, picomolar and 1 picomolar.

In an additional embodiment, the dsNA of the invention possesses four or fewer mismatched nucleic acid residues with respect to the target C5 mRNA sequence along 15 or 19 consecutive nucleotides of the at least 15 or 19 nucleotides of the second oligonucleotide strand when the 15 or 19 consecutive nucleotides of the second oligonucleotide are aligned for maximum complementarity with the target C5 mRNA sequence.

In another embodiment, the dsNA of the invention possesses three or fewer mismatched nucleic acid residues with respect to the target C5 mRNA sequence along 15 or 19 consecutive nucleotides of the at least 15 or 19 nucleotides of the second oligonucleotide strand when the 15 or 19 consecutive nucleotides of the second oligonucleotide are aligned for maximum complementarity with the target C5 mRNA sequence.

Optionally, the dsNA of the invention possesses two or fewer mismatched nucleic acid residues with respect to the target C5 mRNA sequence along 15 or 19 consecutive nucleotides of the at least 15 or 19 nucleotides of the second oligonucleotide strand when the 15 or 19 consecutive nucleotides of the second oligonucleotide are aligned for maximum complementarity with the target C5 mRNA sequence.

In certain embodiments, the dsNA of the invention possesses one mismatched nucleic acid residue with respect to the target C5 mRNA sequence along 15 or 19 consecutive nucleotides of the at least 15 or 19 nucleotides of the second oligonucleotide strand when the 15 or 19 consecutive nucleotides of the second oligonucleotide are aligned for maximum complementarity with the target C5 mRNA sequence.

In one embodiment, 15 or 19 consecutive nucleotides of the at least 15 or 19 nucleotides of the second oligonucleotide strand are completely complementary to the target C5 mRNA sequence when the 15 or 19 consecutive nucleotides of the second oligonucleotide are aligned for maximum complementarity with the target C5 mRNA sequence.

Optionally, a nucleic acid, dsNA or hybridization complex of the invention is isolated.

Another aspect of the invention provides a method for reducing expression of a target C5 gene in a mammalian cell involving contacting a mammalian cell in vitro with a nucleic acid, dsNA or hybridization complex of the invention in an amount sufficient to reduce expression of a target C5 mRNA in the cell.

Optionally, target C5 mRNA expression is reduced by an amount (expressed by %) of at least 10%, at least 50% and at least 80-90%.

In one embodiment, C5 mRNA levels are reduced by an amount (expressed by %) of at least 90% at least 8 days after the cell is contacted with the dsNA.

In another embodiment, C5 mRNA levels are reduced by an amount (expressed by %) of at least 70% at least 10 days after the cell is contacted with the dsNA.

A further aspect of the invention provides a method for reducing expression of a target C5 mRNA in a mammal possessing administering a nucleic acid, dsNA or hybridization complex of the invention to a mammal in an amount sufficient to reduce expression of a target C5 mRNA in the mammal.

In one embodiment, the nucleic acid, dsNA or hybridization complex is formulated in a lipid nanoparticle (LNP).

In another embodiment, the nucleic acid, dsNA or hybridization complex is administered at a dosage of 1 microgram to 5 milligrams per kilogram of the mammal per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, and 0.1 to 2.5 micrograms per kilogram.

In certain embodiments, the nucleic acid, dsNA or hybridization complex possesses greater potency than 21mer siRNAs directed to the identical at least 19 nucleotides of the target C5 mRNA in reducing target C5 mRNA expression when assayed in vitro in a mammalian cell at an effective concentration in the environment of a cell of 1 nanomolar or less.

In one embodiment, C5 mRNA levels are reduced in a tissue of the mammal by an amount (expressed by %) of at least 70% at least 3 days after the dsNA is administered to the mammal.

Optionally, the tissue is blood or bone marrow tissue.

In certain embodiments, the administering step involves intravenous injection, intramuscular injection, intraperitoneal injection, infusion, subcutaneous injection, transdermal, aerosol, rectal, vaginal, topical, oral or inhaled delivery.

Another aspect of the invention provides a method for treating or preventing a disease or disorder in a subject that involves administering to the subject an amount of a nucleic acid, dsNA or hybridization complex of the invention in an amount sufficient to treat or prevent the disease or disorder in the subject.

In one embodiment, the disease or disorder is paroxysmal nocturnal hemoglobinuria (PNH).

Optionally, the subject is human.

A further aspect of the invention provides a formulation that includes the nucleic acid, dsNA or hybridization complex of the invention, where the nucleic acid, dsNA or hybridization complex is present in an amount effective to reduce target C5 mRNA levels when the nucleic acid, dsNA or hybridization complex is introduced into a mammalian cell in vitro by an amount (expressed by %) of at least 10%, at least 50% and at least 80-90%.

In one embodiment, the effective amount is of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of the cell.

In another embodiment, the nucleic acid, dsNA or hybridization complex is present in an amount effective to reduce target C5 mRNA levels when the nucleic acid, dsNA or hybridization complex is introduced into a cell of a mammalian subject by an amount (expressed by %) of at least 10%, at least 50% and at least 80-90%.

Optionally, the effective amount is a dosage of 1 microgram to 5 milligrams per kilogram of the subject per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, or 0.1 to 2.5 micrograms per kilogram.

In another embodiment, the nucleic acid, dsNA or hybridization complex possesses greater potency than an 21mer siRNA directed to the identical at least 19 nucleotides of the target C5 mRNA in reducing target C5 mRNA levels when assayed in vitro in a mammalian cell at an effective concentration in the environment of a cell of 1 nanomolar or less.

A further aspect of the invention provides a mammalian cell containing the nucleic acid, dsNA or hybridization complex of the invention.

Another aspect of the invention provides a pharmaceutical composition that includes the nucleic acid, dsNA or hybridization complex of the invention and a pharmaceutically acceptable carrier.

An additional aspect of the invention provides a kit including the nucleic acid, dsNA or hybridization complex of the invention and instructions for its use.

A further aspect of the invention provides a composition possessing C5 inhibitory activity consisting essentially of a nucleic acid, dsNA or hybridization complex of the invention.

BRIEF DESCRIPTION OF THE DRAWINGS

FIGS. 2A to 2J present primary screen data showing DsiRNA-mediated knockdown of human C5 (FIGS. 2A and 2B show results for human-mouse common DsiRNAs, while FIGS. 2C and 2D show results for human unique DsiRNAs) and mouse Hc (corresponding to human C5; FIGS. 2E and 2F) in human (HepG2) and mouse (LMTK-) cells, respectively. FIGS. 2G and 2H show a compilation of knockdown data in both human and mouse cells, presented in relation to *Homo sapiens* C5 gene locations, while FIGS. 2I and 2J present composite knockdown data in both human and mouse cells, presented in relation to *Mus musculus* Hc gene locations. For each DsiRNA tested in human or mouse cells, two independent qPCR amplicons were assayed (amplicons "1643-1764" and "4318-4322" in humans, "2253-2374" and "4717-4813" in mice).

FIGS. 3A to 3H show histograms of human and mouse C5 inhibitory efficacies observed for indicated DsiRNAs. "P1" indicates phase 1 (primary screen), while "P2" indicates phase 2. In phase 1, DsiRNAs were tested at 1 nM in the environment of HepG2 cells (human cell assays; FIGS. 3A to 3D) or mouse LMTK- cells (LMTK- cell assays; FIGS. 3E to 3H). In phase 2, DsiRNAs were tested at 1 nM and 0.1 nM (in duplicate) in the environment of HepG2 cells or mouse LMTK- cells. Individual bars represent average human (FIGS. 3A to 3D) or mouse (FIGS. 3E to 3H) C5 levels observed in triplicate, with standard errors shown. Mouse C5 levels were normalized to HPRT and Rpl23 levels.

DETAILED DESCRIPTION OF THE INVENTION

Figure 1:
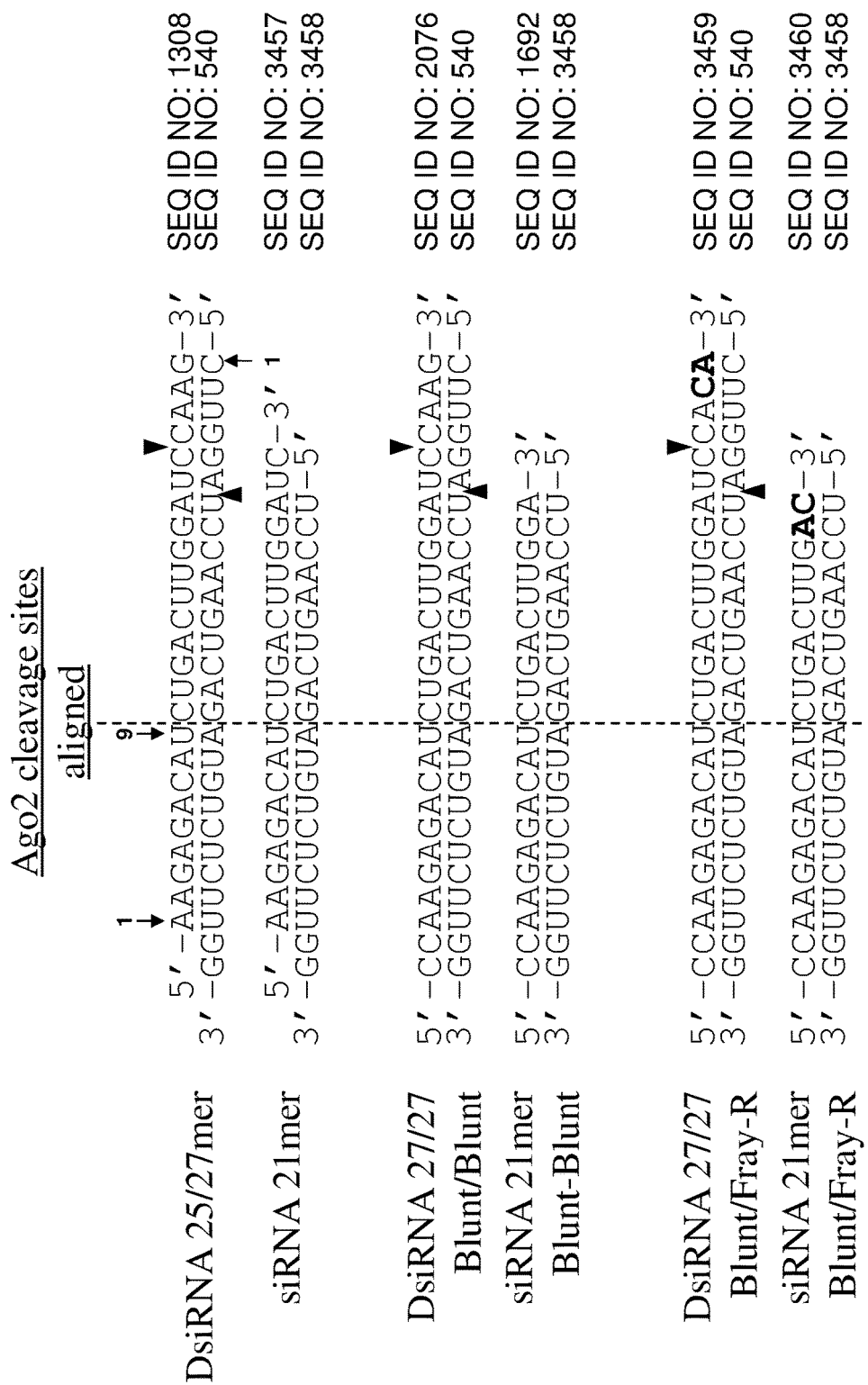
FIG. 1 shows the structures of exemplary DsiRNA agents of the invention targeting a site in the C5 RNA referred to herein as the "C5-1250" target site. UPPER case=unmodified RNA, lower case=DNA, Bold=mismatch base pair nucleotides; arrowheads indicate projected Dicer enzyme cleavage sites; dashed line indicates sense strand (top strand) sequences corresponding to the projected Argonaute 2 (Ago2) cleavage site within the targeted C5 sequence.
Figure 2A:
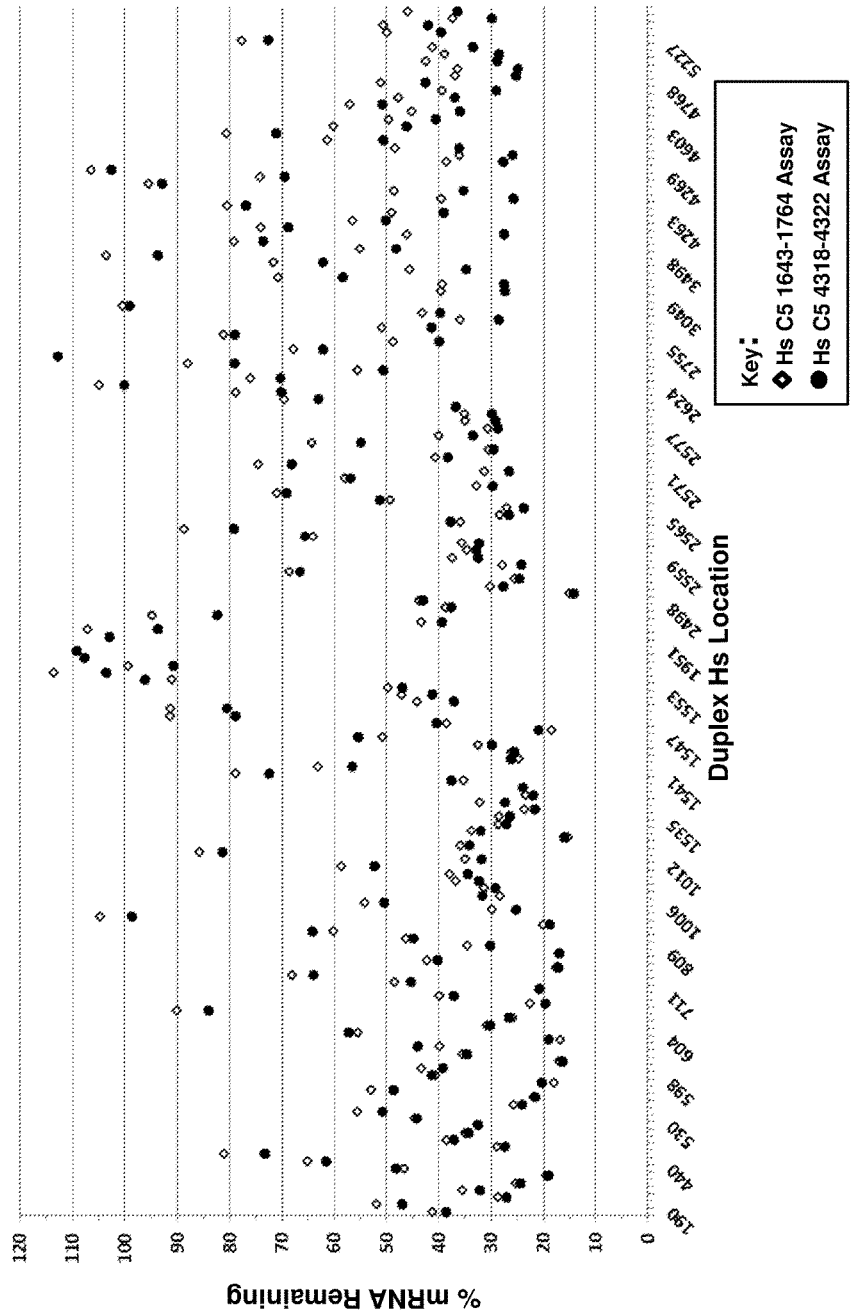
Figure 2E:
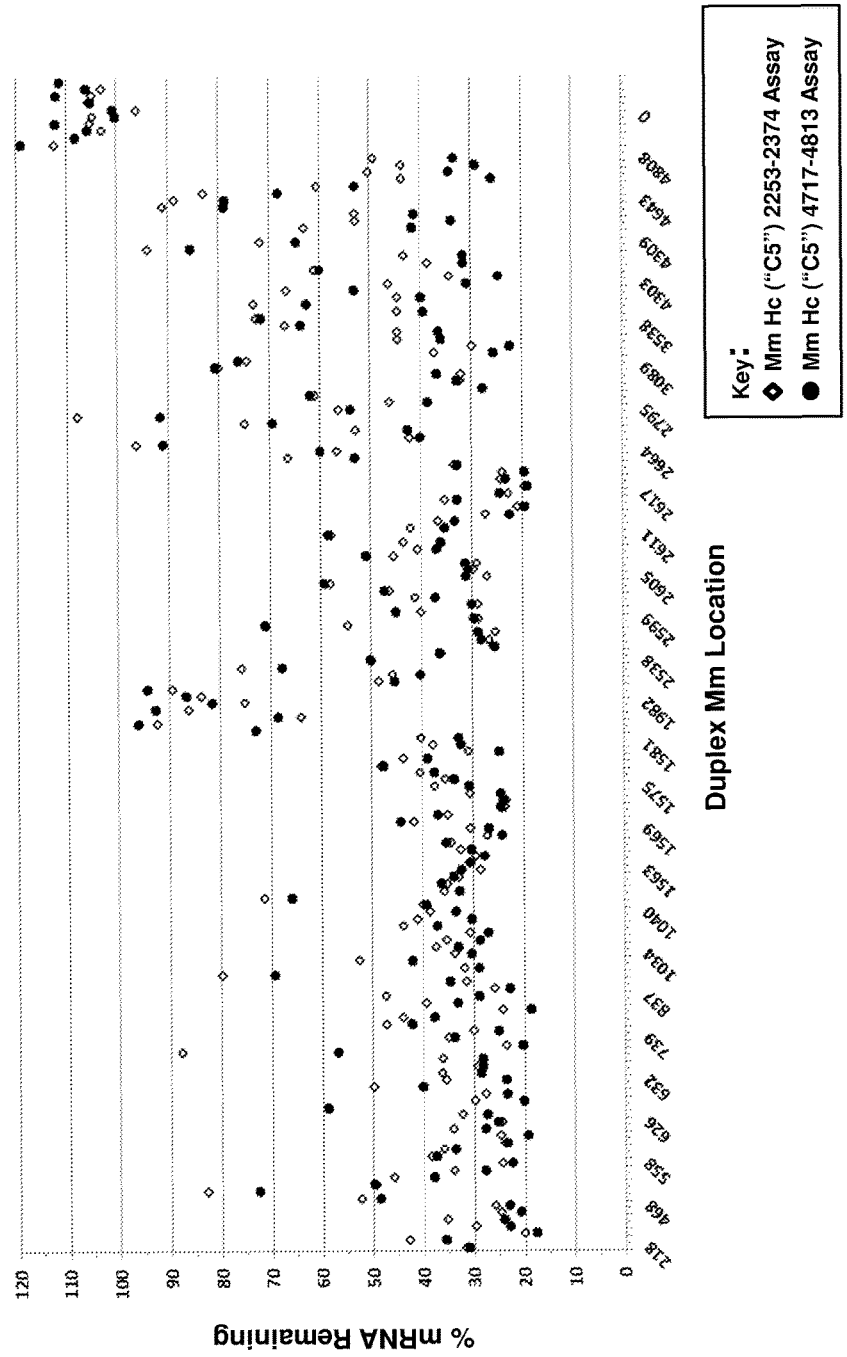
Figure 2H:
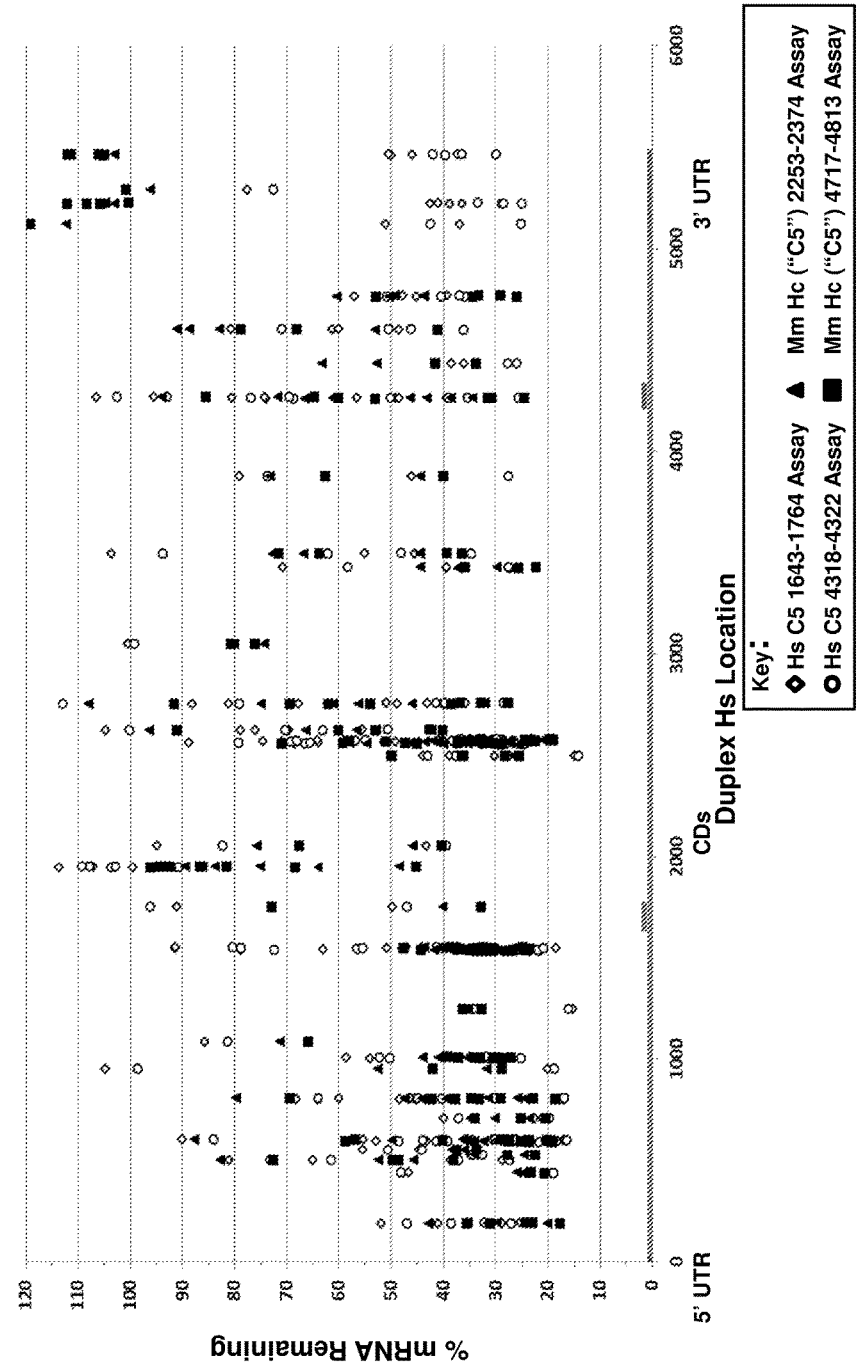
Figure 3B:
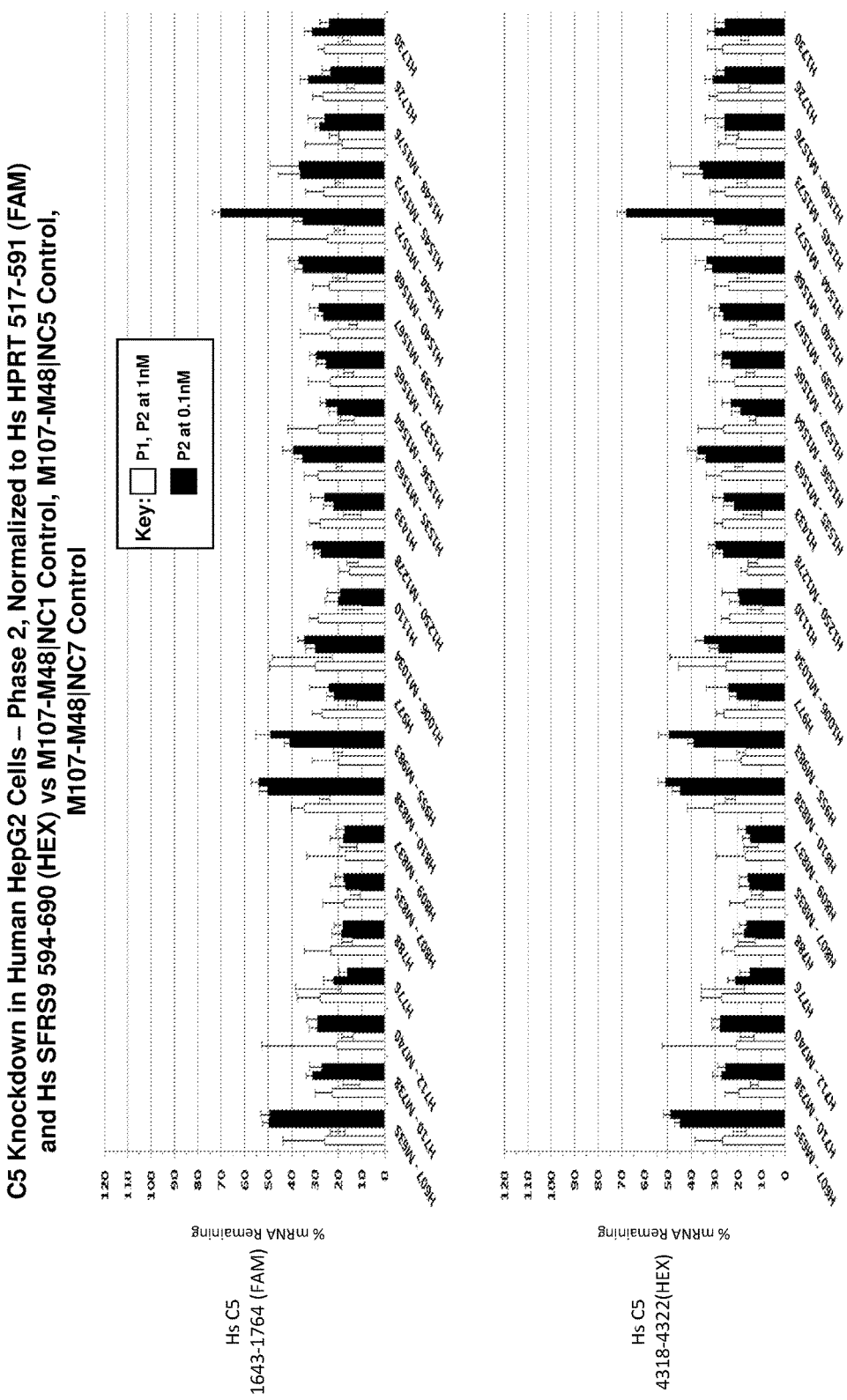
Figure 3E:
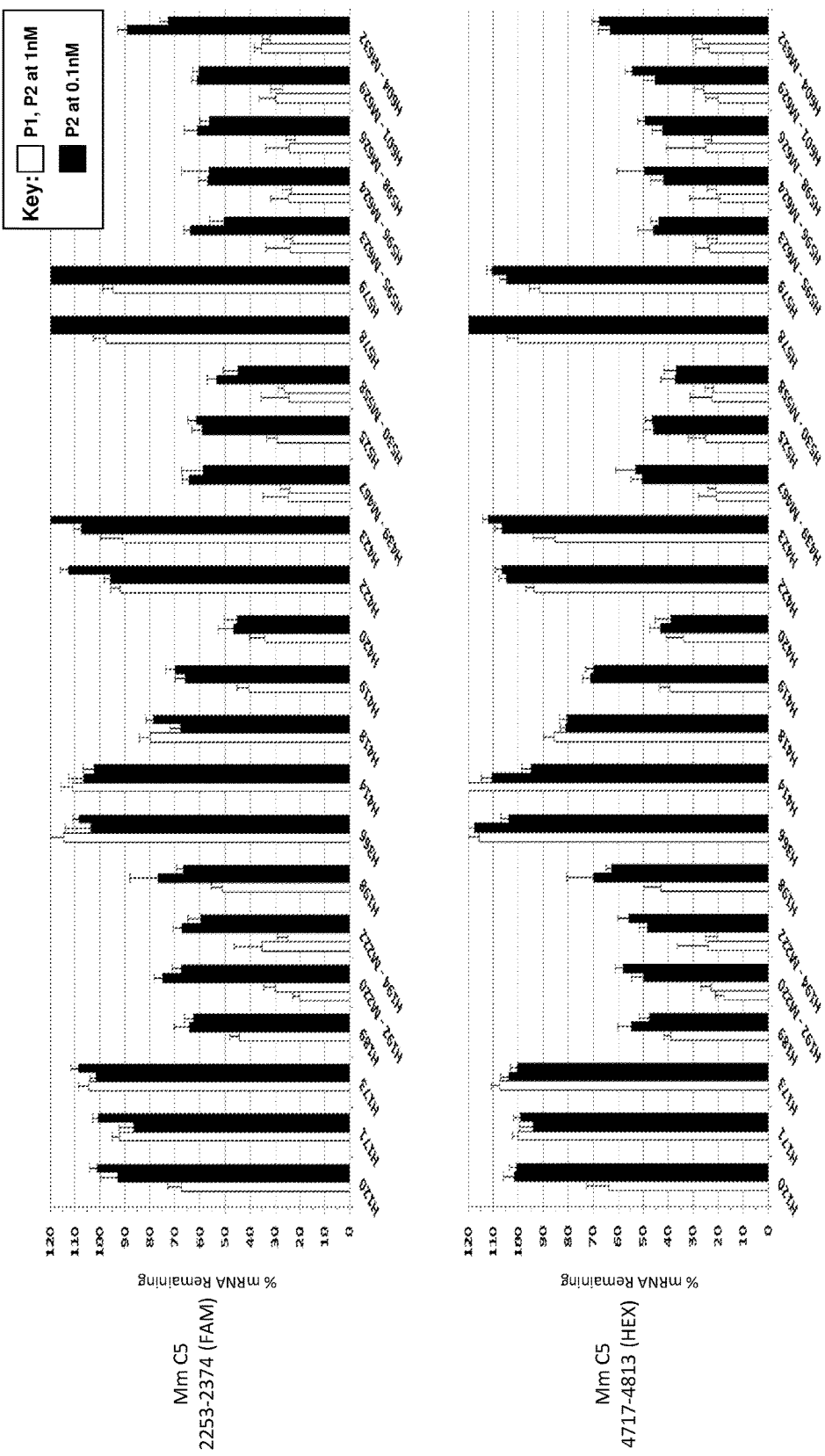

The present invention is directed to compositions that contain nucleic acids, for example double stranded RNA ("dsRNA"), and methods for preparing them, that are capable of reducing the level and/or expression of the complement component 5 (C5) gene in vivo or in vitro. One of the strands of the dsRNA contains a region of nucleotide sequence that has a length that ranges from 19 to 35 or more nucleotides that can direct the destruction and/or translational inhibition of the targeted C5 transcript.

Definitions

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). As used herein, the following terms have the meanings ascribed to them below, unless specified otherwise.

The present invention features one or more DsiRNA molecules that can modulate (e.g., inhibit) C5 expression. The DsiRNAs of the invention optionally can be used in combination with modulators of other genes and/or gene products associated with the maintenance or development of diseases or disorders associated with C5 misregulation (e.g., paroxysmal nocturnal hemoglobinuria (PNH), atypical hemolytic uremic syndrome (aHUS) or other disease or disorder associated with C5 misregulation). The DsiRNA agents of the invention modulate C5 RNAs such as those corresponding to the cDNA sequences referred to by GenBank Accession Nos. NM_001735.2 (human C5) and NM_010406.2 (mouse Hc, the mouse homologue of human C5), which are referred to herein generally as "Complement Component 5."

The below description of the various aspects and embodiments of the invention is provided with reference to exemplary C5 RNAs. However, such reference is meant to be exemplary only and the various aspects and embodiments of the invention are also directed to alternate C5 RNAs, such as mutant C5 RNAs or additional C5 splice variants. Certain aspects and embodiments are also directed to other genes involved in C5 pathways, including genes whose misregulation acts in association with that of C5 (or is affected or affects C5 regulation) to produce phenotypic effects that may be targeted for treatment (e.g., glyoxylate and/or oxalate overproduction). C5-convertase is an example of a gene that interacts with C5. Such additional genes, including those of pathways that act in coordination with C5, can be targeted using dsRNA and the methods described herein for use of C5-targeting dsRNAs. Thus, the inhibition or and the effects of such inhibition, or up-regulation and the effects of such, of the other genes can be performed as described herein.

The term "Complement Component 5" refers to nucleic acid sequences encoding a Complement Component 5 protein, peptide, or polypeptide (e.g., C5 transcripts, such as the sequences of C5 Genbank Accession Nos. NM_001735.2 and NM_010406.2). In certain embodiments, the term "Complement Component 5" is also meant to include other C5 encoding sequence, such as other C5 isoforms, mutant C5 genes, splice variants of C5 genes, and C5 gene polymorphisms. The term "Complement Component 5" is also used to refer to the polypeptide gene product of an C5 gene/transript, e.g., a C5 protein, peptide, or polypeptide, such as those encoded by C5 Genbank Accession Nos. NP_001726.2 and NP_034536.1.

As used herein, a "Complement Component 5-associated disease or disorder" refers to a disease or disorder known in the art to be associated with altered C5 expression, level and/or activity. Notably, a "Complement Component 5-associated disease or disorder" or "C5-associated disease or disorder" includes diseases or disorders of the blood, bone marrow and other organs including, but not limited to, paroxysmal nocturnal hemoglobinuria (PNH) and PNH-related/induced disorders (e.g., thrombosis and the effects thereof).

In certain embodiments, dsRNA-mediated inhibition of a C5 target sequence is assessed. In such embodiments, C5 RNA levels can be assessed by art-recognized methods (e.g., RT-PCR, Northern blot, expression array, etc.), optionally via comparison of C5 levels in the presence of an anti-C5 dsRNA of the invention relative to the absence of such an anti-C5 dsRNA. In certain embodiments, C5 levels in the presence of an anti-C5 dsRNA are compared to those observed in the presence of vehicle alone, in the presence of a dsRNA directed against an unrelated target RNA, or in the absence of any treatment.

It is also recognized that levels of C5 protein can be assessed and that C5 protein levels are, under different conditions, either directly or indirectly related to C5 RNA levels and/or the extent to which a dsRNA inhibits C5 expression, thus art-recognized methods of assessing C5 protein levels (e.g., Western blot, immunoprecipitation, other antibody-based methods, etc.) can also be employed to examine the inhibitory effect of a dsRNA of the invention.

An anti-C5 dsRNA of the invention is deemed to possess "C5 inhibitory activity" if a statistically significant reduction in C5 RNA (or when the C5 protein is assessed, C5 protein levels) is seen when an anti-C5 dsRNA of the invention is administered to a system (e.g., cell-free in vitro system), cell, tissue or organism, as compared to a selected control. The distribution of experimental values and the number of replicate assays performed will tend to dictate the parameters of what levels of reduction in C5 RNA (either as a % or in absolute terms) is deemed statistically significant (as assessed by standard methods of determining statistical significance known in the art). However, in certain embodiments, "C5 inhibitory activity" is defined based upon a % or absolute level of reduction in the level of C5 in a system, cell, tissue or organism. For example, in certain embodiments, a dsRNA of the invention is deemed to possess C5 inhibitory activity if at least a 5% reduction or at least a 10% reduction in C5 RNA is observed in the presence of a dsRNA of the invention relative to C5 levels seen for a suitable control. (For example, in vivo C5 levels in a tissue and/or subject can, in certain embodiments, be deemed to be inhibited by a dsRNA agent of the invention if, e.g., a 5% or 10% reduction in C5 levels is observed relative to a control.) In certain other embodiments, a dsRNA of the invention is deemed to possess C5 inhibitory activity if C5 RNA levels are observed to be reduced by at least 15% relative to a selected control, by at least 20% relative to a selected control, by at least 25% relative to a selected control, by at least 30% relative to a selected control, by at least 35% relative to a selected control, by at least 40% relative to a selected control, by at least 45% relative to a selected control, by at least 50% relative to a selected control, by at least 55% relative to a selected control, by at least 60% relative to a selected control, by at least 65% relative to a selected control, by at least 70% relative to a selected control, by at least 75% relative to a selected control, by at least 80% relative to a selected control, by at least 85% relative to a selected control, by at least 90% relative to a selected control, by at least 95% relative to a selected control, by at least 96% relative to a selected control, by at least 97% relative to a selected control, by at least 98% relative to a selected control or by at least 99% relative to a selected control. In some embodiments, complete inhibition of C5 is required for a dsRNA to be deemed to possess C5 inhibitory activity. In certain models (e.g., cell culture), a dsRNA is deemed to possess C5 inhibitory activity if at least a 50% reduction in C5 levels is observed relative to a suitable control. In certain other embodiments, a dsRNA is deemed to possess C5 inhibitory activity if at least an 80% reduction in C5 levels is observed relative to a suitable control.

By way of specific example, in Example 2 below, a series of DsiRNAs targeting C5 were tested for the ability to reduce C5 mRNA levels in human HepG2 or mouse LMTK- cells in vitro, at 1 nM concentrations in the environment of such cells and in the presence of a transfection agent (Lipofectamine™ RNAiMAX, Invitrogen). Within Example 2 below, C5 inhibitory activity was ascribed to those DsiRNAs that were observed to effect at least a 50% reduction of C5 mRNA levels under the assayed conditions. It is contemplated that C5 inhibitory activity could also be attributed to a dsRNA under either more or less stringent conditions than those employed for Example 2 below, even when the same or a similar assay and conditions are employed. For example, in certain embodiments, a tested dsRNA of the invention is deemed to possess C5 inhibitory activity if at least a 10% reduction, at least a 20% reduction, at least a 30% reduction, at least a 40% reduction, at least a 50% reduction, at least a 60% reduction, at least a 70% reduction, at least a 75% reduction, at least an 80% reduction, at least an 85% reduction, at least a 90% reduction, or at least a 95% reduction in C5 mRNA levels is observed in a mammalian cell line in vitro at 1 nM dsRNA concentration or lower in the environment of a cell, relative to a suitable control.

Use of other endpoints for determination of whether a double stranded RNA of the invention possesses C5 inhibitory activity is also contemplated. Specifically, in one embodiment, in addition to or as an alternative to assessing C5 mRNA levels, the ability of a tested dsRNA to reduce C5 protein levels (e.g., at 48 hours after contacting a mammalian cell in vitro or in vivo) is assessed, and a tested dsRNA is deemed to possess C5 inhibitory activity if at least a 10% reduction, at least a 20% reduction, at least a 30% reduction, at least a 40% reduction, at least a 50% reduction, at least a 60% reduction, at least a 70% reduction, at least a 75% reduction, at least an 80% reduction, at least an 85% reduction, at least a 90% reduction, or at least a 95% reduction in C5 protein levels is observed in a mammalian cell contacted with the assayed double stranded RNA in vitro or in vivo, relative to a suitable control. Additional endpoints contemplated include, e.g., assessment of a phenotype associated with reduction of C5 levels—e.g., impeding inflammation and cell destruction and/or reducing the need for blood transfusions, improving quality of life, and/or reducing the risk of thrombosis in PNH or other patients where C5 is a viable therapeutic target) throughout the body.

C5 inhibitory activity can also be evaluated over time (duration) and over concentration ranges (potency), with assessment of what constitutes a dsRNA possessing C5 inhibitory activity adjusted in accordance with concentrations administered and duration of time following administration. Thus, in certain embodiments, a dsRNA of the invention is deemed to possess C5 inhibitory activity if at least a 50% reduction in C5 activity is observed/persists at a duration of time of 2 hours, 5 hours, 10 hours, 1 day, 2 days, 3 days, 4 days, 5 days, 6 days, 7 days, 8 days, 9 days, 10 days or more after administration of the dsRNA to a cell or organism. In additional embodiments, a dsRNA of the invention is deemed to be a potent C5 inhibitory agent if C5 inhibitory activity (e.g., in certain embodiments, at least 50% inhibition of C5) is observed at a concentration of 1 nM or less, 500 pM or less, 200 pM or less, 100 pM or less, 50 pM or less, 20 pM or less, 10 pM or less, 5 pM or less, 2 pM or less or even 1 pM or less in the environment of a cell, for example, within an in vitro assay for C5 inhibitory activity as described herein. In certain embodiments, a potent C5 inhibitory dsRNA of the invention is defined as one that is capable of C5 inhibitory activity (e.g., in certain embodiments, at least 20% reduction of C5 levels) at a formulated concentration of 10 mg/kg or less when administered to a subject in an effective delivery vehicle (e.g., an effective lipid nanoparticle formulation). Optionally, a potent C5 inhibitory dsRNA of the invention is defined as one that is capable of C5 inhibitory activity (e.g., in certain embodiments, at least 50% reduction of C5 levels) at a formulated concentration of 5 mg/kg or less when administered to a subject in an effective delivery vehicle. In additional embodiments, a potent C5 inhibitory dsRNA of the invention is defined as one that is capable of C5 inhibitory activity (e.g., in certain embodiments, at least 50% reduction of C5 levels) at a formulated concentration of 5 mg/kg or less when administered to a subject in an effective delivery vehicle. Optionally, a potent C5 inhibitory dsRNA of the invention is defined as one that is capable of C5 inhibitory activity (e.g., in certain embodiments, at least 50% reduction of C5 levels) at a formulated concentration of 2 mg/kg or less, or even 1 mg/kg or less, when administered to a subject in an effective delivery vehicle.

In certain embodiments, potency of a dsRNA of the invention is determined in reference to the number of copies of a dsRNA present in the cytoplasm of a target cell that are required to achieve a certain level of target gene knockdown. For example, in certain embodiments, a potent dsRNA is one capable of causing 50% or greater knockdown of a target mRNA when present in the cytoplasm of a target cell at a copy number of 1000 or fewer RISC-loaded antisense strands per cell. More preferably, a potent dsRNA is one capable of producing 50% or greater knockdown of a target mRNA when present in the cytoplasm of a target cell at a copy number of 500 or fewer RISC-loaded antisense strands per cell. Optionally, a potent dsRNA is one capable of producing 50% or greater knockdown of a target mRNA when present in the cytoplasm of a target cell at a copy number of 300 or fewer RISC-loaded antisense strands per cell.

In further embodiments, the potency of a DsiRNA of the invention can be defined in reference to a 19 to 23mer dsRNA directed to the same target sequence within the same target gene. For example, a DsiRNA of the invention that possesses enhanced potency relative to a corresponding 19 to 23mer dsRNA can be a DsiRNA that reduces a target gene by an additional 5% or more, an additional 10% or more, an additional 20% or more, an additional 30% or more, an additional 40% or more, or an additional 50% or more as compared to a corresponding 19 to 23mer dsRNA, when assayed in an in vitro assay as described herein at a sufficiently low concentration to allow for detection of a potency difference (e.g., transfection concentrations at or below 1 nM in the environment of a cell, at or below 100 pM in the environment of a cell, at or below 10 pM in the environment of a cell, at or below 1 nM in the environment of a cell, in an in vitro assay as described herein; notably, it is recognized that potency differences can be best detected via performance of such assays across a range of concentrations—e.g., 0.1 pM to 10 nM—for purpose of generating a dose-response curve and identifying an $IC_{50}$ value associated with a DsiRNA/dsRNA).

C5 inhibitory levels and/or C5 levels may also be assessed indirectly, e.g., measurement of a reduction of PNH phenotype(s) in a subject may be used to assess C5 levels and/or C5 inhibitory efficacy of a double-stranded nucleic acid of the instant invention.

In certain embodiments, the phrase "consists essentially of" is used in reference to the anti-C5 dsRNAs of the invention. In some such embodiments, "consists essentially of" refers to a composition that comprises a dsRNA of the invention which possesses at least a certain level of C5 inhibitory activity (e.g., at least 50% C5 inhibitory activity) and that also comprises one or more additional components and/or modifications that do not significantly impact the C5 inhibitory activity of the dsRNA. For example, in certain embodiments, a composition "consists essentially of" a dsRNA of the invention where modifications of the dsRNA of the invention and/or dsRNA-associated components of the composition do not alter the C5 inhibitory activity (optionally including potency or duration of C5 inhibitory activity) by greater than 3%, greater than 5%, greater than 10%, greater than 15%, greater than 20%, greater than 25%, greater than 30%, greater than 35%, greater than 40%, greater than 45%, or greater than 50% relative to the dsRNA of the invention in isolation. In certain embodiments, a composition is deemed to consist essentially of a dsRNA of the invention even if more dramatic reduction of C5 inhibitory activity (e.g., 80% reduction, 90% reduction, etc. in efficacy, duration and/or potency) occurs in the presence of additional components or modifications, yet where C5 inhibitory activity is not significantly elevated (e.g., observed levels of C5 inhibitory activity are within 10% those observed for the isolated dsRNA of the invention) in the presence of additional components and/or modifications.

As used herein, the term "nucleic acid" refers to deoxyribonucleotides, ribonucleotides, or modified nucleotides, and polymers thereof in single- or double-stranded form. The term encompasses nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, 2-O-methyl ribonucleotides, peptide-nucleic acids (PNAs) and unlocked nucleic acids (UNAs; see, e.g., Jensen et al. *Nucleic Acids Symposium Series* 52: 133-4), and derivatives thereof.

As used herein, "nucleotide" is used as recognized in the art to include those with natural bases (standard), and modified bases well known in the art. Such bases are generally located at the 1' position of a nucleotide sugar moiety. Nucleotides generally comprise a base, sugar and a phosphate group. The nucleotides can be unmodified or modified at the sugar, phosphate and/or base moiety, (also referred to interchangeably as nucleotide analogs, modified nucleotides, non-natural nucleotides, non-standard nucleotides and other; see, e.g., Usman and McSwiggen, supra; Eckstein, et al., International PCT Publication No. WO 92/07065; Usman et al, International PCT Publication No. WO 93/15187; Uhlman & Peyman, supra, all are hereby incorporated by reference herein). There are several examples of modified nucleic acid bases known in the art as summarized by Limbach, et al, *Nucleic Acids Res.* 22:2183, 1994. Some of the non-limiting examples of base modifications that can be introduced into nucleic acid molecules include, hypoxanthine, purine, pyridin-4-one, pyridin-2-one, phenyl, pseudouracil, 2,4,6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine), propyne, and others (Burgin, et al., Biochemistry 35:14090, 1996; Uhlman & Peyman, supra). By "modified bases" in this aspect is meant nucleotide bases other than adenine, guanine, cytosine and uracil at 1' position or their equivalents.

As used herein, "modified nucleotide" refers to a nucleotide that has one or more modifications to the nucleoside, the nucleobase, pentose ring, or phosphate group. For example, modified nucleotides exclude ribonucleotides containing adenosine monophosphate, guanosine monophosphate, uridine monophosphate, and cytidine monophosphate and deoxyribonucleotides containing deoxyadenosine monophosphate, deoxyguanosine monophosphate, deoxythymidine monophosphate, and deoxycytidine monophosphate. Modifications include those naturally occuring that result from modification by enzymes that modify nucleotides, such as methyltransferases. Modified nucleotides also include synthetic or non-naturally occurring nucleotides. Synthetic or non-naturally occurring modifications in nucleotides include those with 2' modifications, e.g., 2'-methoxyethoxy, 2'-fluoro, 2'-allyl, 2'-O-[2-(methylamino)-2-oxoethyl], 4'-thio, 4'-$CH_2$—O-2'-bridge, 4'-$(CH_2)_2$—O-2'-bridge, 2'-LNA or other bicyclic or "bridged" nucleoside analog, and 2'-O—(N-methylcarbamate) or those comprising base analogs. In connection with 2'-modified nucleotides as described for the present disclosure, by "amino" is meant 2'-$NH_2$ or 2'-O—$NH_2$, which can be modified or unmodified. Such modified groups are described, e.g., in Eckstein et al., U.S. Pat. No. 5,672,695 and Matulic-Adamic et al., U.S. Pat. No. 6,248,878. "Modified nucleotides" of the instant invention can also include nucleotide analogs as described above.

In reference to the nucleic acid molecules of the present disclosure, modifications may exist upon these agents in patterns on one or both strands of the double stranded ribonucleic acid (dsRNA). As used herein, "alternating positions" refers to a pattern where every other nucleotide is a modified nucleotide or there is an unmodified nucleotide (e.g., an unmodified ribonucleotide) between every modified nucleotide over a defined length of a strand of the dsRNA (e.g., 5'-MNMNMN-3'; 3'-MNMNMN-5'; where M is a modified nucleotide and N is an unmodified nucleotide). The modification pattern starts from the first nucleotide position at either the 5' or 3' terminus according to a position numbering convention, e.g., as described herein (in certain embodiments, position 1 is designated in reference to the terminal residue of a strand following a projected Dicer cleavage event of a DsiRNA agent of the invention; thus, position 1 does not always constitute a 3' terminal or 5' terminal residue of a pre-processed agent of the invention). The pattern of modified nucleotides at alternating positions may run the full length of the strand, but in certain embodiments includes at least 4, 6, 8, 10, 12, 14 nucleotides containing at least 2, 3, 4, 5, 6 or 7 modified nucleotides, respectively. As used herein, "alternating pairs of positions" refers to a pattern where two consecutive modified nucleotides are separated by two consecutive unmodified nucleotides over a defined length of a strand of the dsRNA (e.g., 5'-MMNNMMNNMMNN-3'; 3'-MMNNMMNNMMNN-5'; where M is a modified nucleotide and N is an unmodified nucleotide). The modification pattern starts from the first nucleotide position at either the 5' or 3' terminus according to a position numbering convention such as those described herein. The pattern of modified nucleotides at alternating positions may run the full length of the strand, but preferably includes at least 8, 12, 16, 20, 24, 28 nucleotides containing at least 4, 6, 8, 10, 12 or 14 modified nucleotides, respectively. It is emphasized that the above modification patterns are exemplary and are not intended as limitations on the scope of the invention.

As used herein, "base analog" refers to a heterocyclic moiety which is located at the 1' position of a nucleotide sugar moiety in a modified nucleotide that can be incorporated into a nucleic acid duplex (or the equivalent position in a nucleotide sugar moiety substitution that can be incorporated into a nucleic acid duplex). In the dsRNAs of the invention, a base analog is generally either a purine or pyrimidine base excluding the common bases guanine (G), cytosine (C), adenine (A), thymine (T), and uracil (U). Base analogs can duplex with other bases or base analogs in dsRNAs. Base analogs include those useful in the compounds and methods of the invention, e.g., those disclosed in U.S. Pat. Nos. 5,432,272 and 6,001,983 to Benner and US Patent Publication No. 20080213891 to Manoharan, which are herein incorporated by reference. Non-limiting examples of bases include hypoxanthine (I), xanthine (X), 3β-D-ribofuranosyl-(2,6-diaminopyrimidine) (K), 3-β-D-ribofuranosyl-(1-methyl-pyrazolo[4,3-d]pyrimidine-5,7(4H,6H)-dione) (P), iso-cytosine (iso-C), iso-guanine (iso-G), 1-β-D-ribofuranosyl-(5-nitroindole), 1-β-D-ribofuranosyl-(3-nitropyrrole), 5-bromouracil, 2-aminopurine, 4-thio-dT, 7-(2-thienyl)-imidazo[4,5-b]pyridine (Ds) and pyrrole-2-carbaldehyde (Pa), 2-amino-6-(2-thienyl)purine (S), 2-oxopyridine (Y), difluorotolyl, 4-fluoro-6-methylbenzimidazole, 4-methylbenzimidazole, 3-methyl isocarbostyrilyl, 5-methyl isocarbostyrilyl, and 3-methyl-7-propynyl isocarbostyrilyl, 7-azaindolyl, 6-methyl-7-azaindolyl, imidizopyridinyl, 9-methyl-imidizopyridinyl, pyrrolopyrizinyl, isocarbostyrilyl, 7-propynyl isocarbostyrilyl, propynyl-7-azaindolyl, 2,4,5-trimethylphenyl, 4-methylindolyl, 4,6-dimethylindolyl, phenyl, napthalenyl, anthracenyl, phenanthracenyl, pyrenyl, stilbenzyl, tetracenyl, pentacenyl, and structural derivates thereof (Schweitzer et al., J. Org. Chem., 59:7238-7242 (1994); Berger et al., Nucleic Acids Research, 28(15):2911-2914 (2000); Moran et al., J. Am. Chem. Soc., 119:2056-2057 (1997); Morales et al., J. Am. Chem. Soc., 121:2323-2324 (1999); Guckian et al., J. Am. Chem. Soc., 118:8182-8183 (1996); Morales et al., J. Am. Chem. Soc., 122(6):1001-1007 (2000); McMinn et al., J. Am. Chem. Soc., 121:11585-11586 (1999); Guckian et al., J. Org. Chem., 63:9652-9656 (1998); Moran et al., Proc. Natl. Acad. Sci., 94:10506-10511 (1997); Das et al., J. Chem. Soc., Perkin Trans., 1:197-206 (2002); Shibata et al., J. Chem. Soc., Perkin Trans., 1: 1605-1611 (2001); Wu et al., J. Am. Chem. Soc., 122(32):7621-7632 (2000); O'Neill et al., J. Org. Chem., 67:5869-5875 (2002); Chaudhuri et al., J. Am. Chem. Soc., 117:10434-10442 (1995); and U.S. Pat. No. 6,218,108). Base analogs may also be a universal base.

As used herein, "universal base" refers to a heterocyclic moiety located at the 1' position of a nucleotide sugar moiety in a modified nucleotide, or the equivalent position in a nucleotide sugar moiety substitution, that, when present in a nucleic acid duplex, can be positioned opposite more than one type of base without altering the double helical structure (e.g., the structure of the phosphate backbone). Additionally, the universal base does not destroy the ability of the single stranded nucleic acid in which it resides to duplex to a target nucleic acid. The ability of a single stranded nucleic acid containing a universal base to duplex a target nucleic can be assayed by methods apparent to one in the art (e.g., UV absorbance, circular dichroism, gel shift, single stranded nuclease sensitivity, etc.). Additionally, conditions under which duplex formation is observed may be varied to determine duplex stability or formation, e.g., temperature, as melting temperature (Tm) correlates with the stability of nucleic acid duplexes. Compared to a reference single stranded nucleic acid that is exactly complementary to a target nucleic acid, the single stranded nucleic acid containing a universal base forms a duplex with the target nucleic acid that has a lower Tm than a duplex formed with the complementary nucleic acid. However, compared to a reference single stranded nucleic acid in which the universal base has been replaced with a base to generate a single mismatch, the single stranded nucleic acid containing the universal base forms a duplex with the target nucleic acid that has a higher Tm than a duplex formed with the nucleic acid having the mismatched base.

Some universal bases are capable of base pairing by forming hydrogen bonds between the universal base and all of the bases guanine (G), cytosine (C), adenine (A), thymine (T), and uracil (U) under base pair forming conditions. A universal base is not a base that forms a base pair with only one single complementary base. In a duplex, a universal base may form no hydrogen bonds, one hydrogen bond, or more than one hydrogen bond with each of G, C, A, T, and U opposite to it on the opposite strand of a duplex. Preferably, the universal bases does not interact with the base opposite to it on the opposite strand of a duplex. In a duplex, base pairing between a universal base occurs without altering the double helical structure of the phosphate backbone. A universal base may also interact with bases in adjacent nucleotides on the same nucleic acid strand by stacking interactions. Such stacking interactions stabilize the duplex, especially in situations where the universal base does not form any hydrogen bonds with the base positioned opposite to it on the opposite strand of the duplex. Non-limiting examples of universal-binding nucleotides include inosine, 1-β-D-ribofuranosyl-5-nitroindole, and/or 1-β-D-ribofuranosyl-3-nitropyrrole (US Pat. Appl. Publ. No. 20070254362 to Quay et al.; Van Aerschot et al., An acyclic 5-nitroindazole nucleoside analogue as ambiguous nucleoside. Nucleic Acids Res. 1995 Nov. 11; 23(21):4363-70; Loakes et al., 3-Nitropyrrole and 5-nitroindole as universal bases in primers for DNA sequencing and PCR. Nucleic Acids Res. 1995 Jul. 11; 23(13):2361-6; Loakes and Brown, 5-Nitroindole as an universal base analogue. Nucleic Acids Res. 1994 Oct. 11; 22(20):4039-43).

As used herein, "loop" refers to a structure formed by a single strand of a nucleic acid, in which complementary regions that flank a particular single stranded nucleotide region hybridize in a way that the single stranded nucleotide region between the complementary regions is excluded from duplex formation or Watson-Crick base pairing. A loop is a single stranded nucleotide region of any length. Examples of loops include the unpaired nucleotides present in such structures as hairpins, stem loops, or extended loops.

As used herein, "extended loop" in the context of a dsRNA refers to a single stranded loop and in addition 1, 2, 3, 4, 5, 6 or up to 20 base pairs or duplexes flanking the loop. In an extended loop, nucleotides that flank the loop on the 5' side form a duplex with nucleotides that flank the loop on the 3' side. An extended loop may form a hairpin or stem loop.

As used herein, "tetraloop" in the context of a dsRNA refers to a loop (a single stranded region) consisting of four nucleotides that forms a stable secondary structure that contributes to the stability of adjacent Watson-Crick hybridized nucleotides. Without being limited to theory, a tetraloop may stabilize an adjacent Watson-Crick base pair by stacking interactions. In addition, interactions among the four nucleotides in a tetraloop include but are not limited to non-Watson-Crick base pairing, stacking interactions, hydrogen bonding, and contact interactions (Cheong et al., Nature 1990 Aug. 16; 346(6285):680-2; Heus and Pardi, Science 1991 Jul. 12; 253(5016):191-4). A tetraloop confers an increase in the melting temperature (Tm) of an adjacent duplex that is higher than expected from a simple model loop sequence consisting of four random bases. For example, a tetraloop can confer a melting temperature of at least 55° C. in 10 mM $NaHPO_4$ to a hairpin comprising a duplex of at least 2 base pairs in length. A tetraloop may contain ribonucleotides, deoxyribonucleotides, modified nucleotides, and combinations thereof. Examples of RNA tetraloops include the UNCG family of tetraloops (e.g., UUCG), the GNRA family of tetraloops (e.g., GAAA), and the CUUG tetraloop. (Woese et al., Proc Natl Acad Sci USA. 1990 November; 87(21):8467-71; Antao et al., Nucleic Acids Res. 1991 Nov. 11; 19(21):5901-5). Examples of DNA tetraloops include the d(GNNA) family of tetraloops (e.g., d(GTTA), the d(GNRA)) family of tetraloops, the d(GNAB) family of tetraloops, the d(CNNG) family of tetraloops, the d(TNCG) family of tetraloops (e.g., d(TTCG)). (Nakano et al. Biochemistry, 41 (48), 14281-14292, 2002; SHINJI et al. Nippon Kagakkai Koen Yokoshu VOL. 78th; NO. 2; PAGE. 731 (2000).)

As used herein, the term "siRNA" refers to a double stranded nucleic acid in which each strand comprises RNA, RNA analog(s) or RNA and DNA. The siRNA comprises between 19 and 23 nucleotides or comprises 21 nucleotides. The siRNA typically has 2 bp overhangs on the 3' ends of each strand such that the duplex region in the siRNA comprises 17-21 nucleotides, or 19 nucleotides. Typically, the antisense strand of the siRNA is sufficiently complementary with the target sequence of the C5 gene/RNA.

In certain embodiments, an anti-C5 DsiRNA of the instant invention possesses strand lengths of at least 25 nucleotides. Accordingly, in certain embodiments, an anti-C5 DsiRNA contains one oligonucleotide sequence, a first sequence, that is at least 25 nucleotides in length and no longer than 35 or up to 50 or more (e.g., up to 80) nucleotides. In certain embodiments, this sequence of RNA can be between 26 and 35, 26 and 34, 26 and 33, 26 and 32, 26 and 31, 26 and 30, and 26 and 29 nucleotides in length. This sequence can be 27 or 28 nucleotides in length or 27 nucleotides in length. The second sequence of the DsiRNA agent can be a sequence that anneals to the first sequence under biological conditions, such as within the cytoplasm of a eukaryotic cell. Generally, the second oligonucleotide sequence will have at least 19 complementary base pairs with the first oligonucleotide sequence, more typically the second oligonucleotide sequence will have 21 or more complementary base pairs, or 25 or more complementary base pairs with the first oligonucleotide sequence. In one embodiment, the second sequence is the same length as the first sequence, and the DsiRNA agent is blunt ended. In another embodiment, the ends of the DsiRNA agent have one or more overhangs.

In certain embodiments, the first and second oligonucleotide sequences of the DsiRNA agent exist on separate oligonucleotide strands that can be and typically are chemically synthesized. In some embodiments, both strands are between 26 and 35 nucleotides in length. In other embodiments, both strands are between 25 and 30 or 26 and 30 nucleotides in length. In one embodiment, both strands are 27 nucleotides in length, are completely complementary and have blunt ends. In certain embodiments of the instant invention, the first and second sequences of an anti-C5 DsiRNA exist on separate RNA oligonucleotides (strands). In one embodiment, one or both oligonucleotide strands are capable of serving as a substrate for Dicer. In other embodiments, at least one modification is present that promotes Dicer to bind to the double-stranded RNA structure in an orientation that maximizes the double-stranded RNA structure's effectiveness in inhibiting gene expression. In certain embodiments of the instant invention, the anti-C5 DsiRNA agent is comprised of two oligonucleotide strands of differing lengths, with the anti-C5 DsiRNA possessing a blunt end at the 3' terminus of a first strand (sense strand) and a 3' overhang at the 3' terminus of a second strand (antisense strand). The DsiRNA can also contain one or more deoxyribonucleic acid (DNA) base substitutions.

Suitable DsiRNA compositions that contain two separate oligonucleotides can be chemically linked outside their annealing region by chemical linking groups. Many suitable chemical linking groups are known in the art and can be used. Suitable groups will not block Dicer activity on the DsiRNA and will not interfere with the directed destruction of the RNA transcribed from the target gene. Alternatively, the two separate oligonucleotides can be linked by a third oligonucleotide such that a hairpin structure is produced upon annealing of the two oligonucleotides making up the DsiRNA composition. The hairpin structure will not block Dicer activity on the DsiRNA and will not interfere with the directed destruction of the target RNA.

The dsRNA molecule can be designed such that every residue of the antisense strand is complementary to a residue in the target molecule. Alternatively, substitutions can be made within the molecule to increase stability and/or enhance processing activity of said molecule. Substitutions can be made within the strand or can be made to residues at the ends of the strand. In certain embodiments, substitutions and/or modifications are made at specific residues within a DsiRNA agent. Such substitutions and/or modifications can include, e.g., deoxy-modifications at one or more residues of positions 1, 2 and 3 when numbering from the 3' terminal position of the sense strand of a DsiRNA agent; and introduction of 2'-O-alkyl (e.g., 2'-O-methyl) modifications at the 3' terminal residue of the antisense strand of DsiRNA agents, with such modifications also being performed at overhang positions of the 3' portion of the antisense strand and at alternating residues of the antisense strand of the DsiRNA that are included within the region of a DsiRNA agent that is processed to form an active siRNA agent. The preceding modifications are offered as exemplary, and are not intended to be limiting in any manner. Further consideration of the structure of preferred DsiRNA agents, including further description of the modifications and substitutions that can be performed upon the anti-C5 DsiRNA agents of the instant invention, can be found below.

Where a first sequence is referred to as "substantially complementary" with respect to a second sequence herein, the two sequences can be fully complementary, or they may form one or more, but generally not more than 4, 3 or 2 mismatched base pairs upon hybridization, while retaining the ability to hybridize under the conditions most relevant to their ultimate application. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes of the invention.

The term "double-stranded RNA" or "dsRNA", as used herein, refers to a complex of ribonucleic acid molecules, having a duplex structure comprising two anti-parallel and substantially complementary, as defined above, nucleic acid strands. The two strands forming the duplex structure may be different portions of one larger RNA molecule, or they may be separate RNA molecules. Where separate RNA molecules, such dsRNA are often referred to as siRNA ("short interfering RNA") or DsiRNA ("Dicer substrate siRNAs"). Where the two strands are part of one larger molecule, and therefore are connected by an uninterrupted chain of nucleotides between the 3'-end of one strand and the 5' end of the respective other strand forming the duplex structure, the connecting RNA chain is referred to as a "hairpin loop", "short hairpin RNA" or "shRNA". Where the two strands are connected covalently by means other than an uninterrupted chain of nucleotides between the 3'-end of one strand and the 5'end of the respective other strand forming the duplex structure, the connecting structure is referred to as a "linker". The RNA strands may have the same or a different number of nucleotides. The maximum number of base pairs is the number of nucleotides in the shortest strand of the dsRNA minus any overhangs that are present in the duplex. In addition to the duplex structure, a dsRNA may comprise one or more nucleotide overhangs. In addition, as used herein, "dsRNA" may include chemical modifications to ribonucleotides, internucleoside linkages, end-groups, caps, and conjugated moieties, including substantial modifications at multiple nucleotides and including all types of modifications disclosed herein or known in the art. Any such modifications, as used in an siRNA- or DsiRNA-type molecule, are encompassed by "dsRNA" for the purposes of this specification and claims.

The phrase "duplex region" refers to the region in two complementary or substantially complementary oligonucleotides that form base pairs with one another, either by Watson-Crick base pairing or other manner that allows for a duplex between oligonucleotide strands that are complementary or substantially complementary. For example, an oligonucleotide strand having 21 nucleotide units can base pair with another oligonucleotide of 21 nucleotide units, yet only 19 bases on each strand are complementary or substantially complementary, such that the "duplex region" consists of 19 base pairs. The remaining base pairs may, for example, exist as 5' and 3' overhangs. Further, within the duplex region, 100% complementarity is not required; substantial complementarity is allowable within a duplex region. Substantial complementarity refers to complementarity between the strands such that they are capable of annealing under biological conditions. Techniques to empirically determine if two strands are capable of annealing under biological conditions are well know in the art. Alternatively, two strands can be synthesized and added together under biological conditions to determine if they anneal to one another.

Single-stranded nucleic acids that base pair over a number of bases are said to "hybridize." Hybridization is typically determined under physiological or biologically relevant conditions (e.g., intracellular: pH 7.2, 140 mM potassium ion; extracellular pH 7.4, 145 mM sodium ion). Hybridization conditions generally contain a monovalent cation and biologically acceptable buffer and may or may not contain a divalent cation, complex anions, e.g. gluconate from potassium gluconate, uncharged species such as sucrose, and inert polymers to reduce the activity of water in the sample, e.g. PEG. Such conditions include conditions under which base pairs can form.

Hybridization is measured by the temperature required to dissociate single stranded nucleic acids forming a duplex, i.e., (the melting temperature; Tm). Hybridization conditions are also conditions under which base pairs can form. Various conditions of stringency can be used to determine hybridization (see, e.g., Wahl, G. M. and S. L. Berger (1987) Methods Enzymol. 152:399; Kimmel, A. R. (1987) Methods Enzymol. 152:507). Stringent temperature conditions will ordinarily include temperatures of at least about 30° C., more preferably of at least about 37° C., and most preferably of at least about 42° C. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, Tm(° C.)=2(# of A+T bases)+4(# of G+C bases). For hybrids between 18 and 49 base pairs in length, Tm(° C.)=81.5+16.6(log 10[Na+])+0.41 (% G+C)−(600/N), where N is the number of bases in the hybrid, and [Na+] is the concentration of sodium ions in the hybridization buffer ([Na+] for 1×SSC=0.165 M). For example, a hybridization determination buffer is shown in Table 1.

TABLE 1

|  | final conc. | Vender | Cat# | Lot# | m.w./Stock | To make 50 mL solution |
| --- | --- | --- | --- | --- | --- | --- |
| NaCl | 100 mM | Sigma | S-5150 | 41K8934 | 5 M | 1 mL |
| KCl | 80 mM | Sigma | P-9541 | 70K0002 | 74.55 | 0.298 g |
| MgCl$_2$ | 8 mM | Sigma | M-1028 | 120K8933 | 1 M | 0.4 mL |
| sucrose | 2% w/v | Fisher | BP220-212 | 907105 | 342.3 | 1 g |
| Tris-HCl | 16 mM | Fisher | BP1757-500 | 12419 | 1 M | 0.8 mL |
| NaH$_2$PO$_4$ | 1 mM | Sigma | S-3193 | 52H-029515 | 120.0 | 0.006 g |
| EDTA | 0.02 mM | Sigma | E-7889 | 110K89271 | 0.5 M | 2 μL |
| H$_2$O |  | Sigma | W-4502 | 51K2359 |  | to 50 mL |
| pH = 7.0 at 20° C. | adjust with HCl |  |  |  |  |  |

Useful variations on hybridization conditions will be readily apparent to those skilled in the art. Hybridization techniques are well known to those skilled in the art and are described, for example, in Benton and Davis (Science 196:180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Antisense to Molecular Cloning Techniques, 1987, Academic Press, New York); and Sambrook et al., Molecular Cloning: A Laboratory Manual, Cold Spring Harbor Laboratory Press, New York.

As used herein, "oligonucleotide strand" is a single stranded nucleic acid molecule. An oligonucleotide may comprise ribonucleotides, deoxyribonucleotides, modified nucleotides (e.g., nucleotides with 2' modifications, synthetic base analogs, etc.) or combinations thereof. Such modified oligonucleotides can be preferred over native forms because of properties such as, for example, enhanced cellular uptake and increased stability in the presence of nucleases.

As used herein, the term "ribonucleotide" encompasses natural and synthetic, unmodified and modified ribonucleotides. Modifications include changes to the sugar moiety, to the base moiety and/or to the linkages between ribonucleotides in the oligonucleotide. As used herein, the term "ribonucleotide" specifically excludes a deoxyribonucleotide, which is a nucleotide possessing a single proton group at the 2' ribose ring position.

As used herein, the term "deoxyribonucleotide" encompasses natural and synthetic, unmodified and modified deoxyribonucleotides. Modifications include changes to the sugar moiety, to the base moiety and/or to the linkages between deoxyribonucleotide in the oligonucleotide. As used herein, the term "deoxyribonucleotide" also includes a modified ribonucleotide that does not permit Dicer cleavage of a dsRNA agent, e.g., a 2'-O-methyl ribonucleotide, a phosphorothioate-modified ribonucleotide residue, etc., that does not permit Dicer cleavage to occur at a bond of such a residue.

As used herein, the term "PS-NA" refers to a phosphorothioate-modified nucleotide residue. The term "PS-NA" therefore encompasses both phosphorothioate-modified ribonucleotides ("PS-RNAs") and phosphorothioate-modified deoxyribonucleotides ("PS-DNAs").

As used herein, "Dicer" refers to an endoribonuclease in the RNase III family that cleaves a dsRNA or dsRNA-containing molecule, e.g., double-stranded RNA (dsRNA) or pre-microRNA (miRNA), into double-stranded nucleic acid fragments 19-25 nucleotides long, usually with a two-base overhang on the 3' end. With respect to certain dsRNAs of the invention (e.g., "DsiRNAs"), the duplex formed by a dsRNA region of an agent of the invention is recognized by Dicer and is a Dicer substrate on at least one strand of the duplex. Dicer catalyzes the first step in the RNA interference pathway, which consequently results in the degradation of a target RNA. The protein sequence of human Dicer is provided at the NCBI database under accession number NP_085124, hereby incorporated by reference.

Dicer "cleavage" can be determined as follows (e.g., see Collingwood et al., Oligonucleotides 18:187-200 (2008)). In a Dicer cleavage assay, RNA duplexes (100 pmol) are incubated in 20 μL of 20 mM Tris pH 8.0, 200 mM NaCl, 2.5 mM MgCl2 with or without 1 unit of recombinant human Dicer (Stratagene, La Jolla, Calif.) at 37° C. for 18-24 hours. Samples are desalted using a Performa SR 96-well plate (Edge Biosystems, Gaithersburg, Md.). Electrospray-ionization liquid chromatography mass spectroscopy (ESI-LCMS) of duplex RNAs pre- and post-treatment with Dicer is done using an Oligo HTCS system (Novatia, Princeton, N.J.; Hail et al., 2004), which consists of a ThermoFinnigan TSQ7000, Xcalibur data system, ProMass data processing software and Paradigm MS4 HPLC (Michrom BioResources, Auburn, Calif.). In this assay, Dicer cleavage occurs where at least 5%, 10%, 20%, 30%, 40%, 50%, 60%, 70%, 80%, 90%, 95%, or even 100% of the Dicer substrate dsRNA, (i.e., 25-30 bp, dsRNA, preferably 26-30 bp dsRNA) is cleaved to a shorter dsRNA (e.g., 19-23 bp dsRNA, preferably, 21-23 bp dsRNA).

As used herein, "Dicer cleavage site" refers to the sites at which Dicer cleaves a dsRNA (e.g., the dsRNA region of a DsiRNA agent of the invention). Dicer contains two RNase III domains which typically cleave both the sense and antisense strands of a dsRNA. The average distance between the RNase III domains and the PAZ domain determines the length of the short double-stranded nucleic acid fragments it produces and this distance can vary (Macrae et al. (2006) Science 311: 195-8). As shown in FIG. 1, Dicer is projected to cleave certain double-stranded ribonucleic acids of the instant invention that possess an antisense strand having a 2 nucleotide 3' overhang at a site between the $21^{st}$ and $22^{nd}$ nucleotides removed from the 3' terminus of the antisense strand, and at a corresponding site between the $21^{st}$ and $22^{nd}$ nucleotides removed from the 5' terminus of the sense strand. The projected and/or prevalent Dicer cleavage site(s) for dsRNA molecules distinct from those depicted in FIG. 1 may be similarly identified via art-recognized methods, including those described in Macrae et al. While the Dicer cleavage events depicted in FIG. 1 generate 21 nucleotide siRNAs, it is noted that Dicer cleavage of a dsRNA (e.g., DsiRNA) can result in generation of Dicer-processed siRNA lengths of 19 to 23 nucleotides in length. Indeed, in certain embodiments, a double-stranded DNA region may be included within a dsRNA for purpose of directing prevalent Dicer excision of a typically non-preferred 19mer or 20mer siRNA, rather than a 21mer.

As used herein, "overhang" refers to unpaired nucleotides, in the context of a duplex having one or more free ends at the 5' terminus or 3' terminus of a dsRNA. In certain embodiments, the overhang is a 3' or 5' overhang on the antisense strand or sense strand. In some embodiments, the overhang is a 3' overhang having a length of between one and six nucleotides, optionally one to five, one to four, one to three, one to two, two to six, two to five, two to four, two to three, three to six, three to five, three to four, four to six, four to five, five to six nucleotides, or one, two, three, four, five or six nucleotides. "Blunt" or "blunt end" means that there are no unpaired nucleotides at that end of the dsRNA, i.e., no nucleotide overhang. For clarity, chemical caps or non-nucleotide chemical moieties conjugated to the 3' end or 5' end of an siRNA are not considered in determining whether an siRNA has an overhang or is blunt ended. In certain embodiments, the invention provides a dsRNA molecule for inhibiting the expression of the C5 target gene in a cell or mammal, wherein the dsRNA comprises an antisense strand comprising a region of complementarity which is complementary to at least a part of an mRNA formed in the expression of the C5 target gene, and wherein the region of complementarity is less than 35 nucleotides in length, optionally 19-24 nucleotides in length or 25-30 nucleotides in length, and wherein the dsRNA, upon contact with a cell expressing the C5 target gene, inhibits the expression of the C5 target gene by at least 10%, 25%, or 40%.

A dsRNA of the invention comprises two RNA strands that are sufficiently complementary to hybridize to form a duplex structure. One strand of the dsRNA (the antisense strand) comprises a region of complementarity that is substantially complementary, and generally fully complementary, to a target sequence, derived from the sequence of an mRNA formed during the expression of the C5 target gene, the other strand (the sense strand) comprises a region which is complementary to the antisense strand, such that the two strands hybridize and form a duplex structure when combined under suitable conditions. Generally, the duplex structure is between 15 and 80, or between 15 and 53, or between 15 and 35, optionally between 25 and 30, between 26 and 30, between 18 and 25, between 19 and 24, or between 19 and 21 base pairs in length. Similarly, the region of complementarity to the target sequence is between 15 and 35, optionally between 18 and 30, between 25 and 30, between 19 and 24, or between 19 and 21 nucleotides in length. The dsRNA of the invention may further comprise one or more single-stranded nucleotide overhang(s). It has been identified that dsRNAs comprising duplex structures of between 15 and 35 base pairs in length can be effective in inducing RNA interference, including DsiRNAs (generally of at least 25 base pairs in length) and siRNAs (in certain embodiments, duplex structures of siRNAs are between 20 and 23, and optionally, specifically 21 base pairs (Elbashir et al., *EMBO* 20: 6877-6888)). It has also been identified that dsRNAs possessing duplexes shorter than 20 base pairs can be effective as well (e.g., 15, 16, 17, 18 or 19 base pair duplexes). In certain embodiments, the dsRNAs of the invention can comprise at least one strand of a length of 19 nucleotides or more. In certain embodiments, it can be reasonably expected that shorter dsRNAs comprising a sequence complementary to one of the sequences of Tables 4, 6, 8 or 10, minus only a few nucleotides on one or both ends may be similarly effective as compared to the dsRNAs described above and in Tables 2, 3, 5, 7 and 9. Hence, dsRNAs comprising a partial sequence of at least 15, 16, 17, 18, 19, 20, or more contiguous nucleotides sufficiently complementary to one of the sequences of Tables 4, 6, 8 or 10, and differing in their ability to inhibit the expression of the C5 target gene in an assay as described herein by not more than 5, 10, 15, 20, 25, or 30% inhibition from a dsRNA comprising the full sequence, are contemplated by the invention. In one embodiment, at least one end of the dsRNA has a single-stranded nucleotide overhang of 1 to 5, optionally 1 to 4, in certain embodiments, 1 or 2 nucleotides. Certain dsRNA structures having at least one nucleotide overhang possess superior inhibitory properties as compared to counterparts possessing base-paired blunt ends at both ends of the dsRNA molecule.

As used herein, the term "RNA processing" refers to processing activities performed by components of the siRNA, miRNA or RNase H pathways (e.g., Drosha, Dicer, Argonaute2 or other RISC endoribonucleases, and RNaseH), which are described in greater detail below (see "RNA Processing" section below). The term is explicitly distinguished from the post-transcriptional processes of 5' capping of RNA and degradation of RNA via non-RISC- or non-RNase H-mediated processes. Such "degradation" of an RNA can take several forms, e.g. deadenylation (removal of a 3' poly(A) tail), and/or nuclease digestion of part or all of the body of the RNA by one or more of several endo- or exo-nucleases (e.g., RNase III, RNase P, RNase T1, RNase A (1, 2, 3, 4/5), oligonucleotidase, etc.).

By "homologous sequence" is meant a nucleotide sequence that is shared by one or more polynucleotide sequences, such as genes, gene transcripts and/or non-coding polynucleotides. For example, a homologous sequence can be a nucleotide sequence that is shared by two or more genes encoding related but different proteins, such as different members of a gene family, different protein epitopes, different protein isoforms or completely divergent genes, such as a cytokine and its corresponding receptors. A homologous sequence can be a nucleotide sequence that is shared by two or more non-coding polynucleotides, such as noncoding DNA or RNA, regulatory sequences, introns, and sites of transcriptional control or regulation. Homologous sequences can also include conserved sequence regions shared by more than one polynucleotide sequence. Homology does not need to be perfect homology (e.g., 100%), as partially homologous sequences are also contemplated by the instant invention (e.g., 99%, 98%, 97%, 96%, 95%, 94%, 93%, 92%, 91%, 90%, 89%, 88%, 87%, 86%, 85%, 84%, 83%, 82%, 81%, 80% etc.). Indeed, design and use of the dsRNA agents of the instant invention contemplates the possibility of using such dsRNA agents not only against target RNAs of C5 possessing perfect complementarity with the presently described dsRNA agents, but also against target C5 RNAs possessing sequences that are, e.g., only 99%, 98%, 97%, 96%, 95%, 94%, 93%, 92%, 91%, 90%, 89%, 88%, 87%, 86%, 85%, 84%, 83%, 82%, 81%, 80% etc. complementary to said dsRNA agents. Similarly, it is contemplated that the presently described dsRNA agents of the instant invention might be readily altered by the skilled artisan to enhance the extent of complementarity between said dsRNA agents and a target C5 RNA, e.g., of a specific allelic variant of C5 (e.g., an allele of enhanced therapeutic interest). Indeed, dsRNA agent sequences with insertions, deletions, and single point mutations relative to the target C5 sequence can also be effective for inhibition. Alternatively, dsRNA agent sequences with nucleotide analog substitutions or insertions can be effective for inhibition.

Sequence identity may be determined by sequence comparison and alignment algorithms known in the art. To determine the percent identity of two nucleic acid sequences (or of two amino acid sequences), the sequences are aligned for comparison purposes (e.g., gaps can be introduced in the first sequence or second sequence for optimal alignment). The nucleotides (or amino acid residues) at corresponding nucleotide (or amino acid) positions are then compared. When a position in the first sequence is occupied by the same residue as the corresponding position in the second sequence, then the molecules are identical at that position. The percent identity between the two sequences is a function of the number of identical positions shared by the sequences (i.e., % homology=# of identical positions/total # of positions×100), optionally penalizing the score for the number of gaps introduced and/or length of gaps introduced.

The comparison of sequences and determination of percent identity between two sequences can be accomplished using a mathematical algorithm. In one embodiment, the alignment generated over a certain portion of the sequence aligned having sufficient identity but not over portions having low degree of identity (i.e., a local alignment). A preferred, non-limiting example of a local alignment algorithm utilized for the comparison of sequences is the algorithm of Karlin and Altschul (1990) *Proc. Natl. Acad. Sci. USA* 87:2264-68, modified as in Karlin and Altschul (1993) *Proc. Natl. Acad. Sci. USA* 90:5873-77. Such an algorithm is incorporated into the BLAST programs (version 2.0) of Altschul, et al. (1990) *J. Mol. Biol.* 215:403-10.

In another embodiment, a gapped alignment, the alignment is optimized by introducing appropriate gaps, and percent identity is determined over the length of the aligned sequences (i.e., a gapped alignment). To obtain gapped alignments for comparison purposes, Gapped BLAST can be utilized as described in Altschul et al., (1997) Nucleic Acids Res. 25(17):3389-3402. In another embodiment, a global alignment the alignment is optimized by introducing appropriate gaps, and percent identity is determined over the entire length of the sequences aligned. (i.e., a global alignment). A preferred, non-limiting example of a mathematical algorithm utilized for the global comparison of sequences is the algorithm of Myers and Miller, CABIOS (1989). Such an algorithm is incorporated into the ALIGN program (version 2.0) which is part of the GCG sequence alignment software package. When utilizing the ALIGN program for comparing amino acid sequences, a PAM 120 weight residue table, a gap length penalty of 12, and a gap penalty of 4 can be used.

Greater than 80% sequence identity, e.g., 80%, 81%, 82%, 83%, 84%, 85%, 86%, 87%, 88%, 89%, 90%, 91%, 92%, 93%, 94%, 95%, 96%, 97%, 98%, 99% or even 100% sequence identity, between the dsRNA antisense strand and the portion of the C5 RNA sequence is preferred. Alternatively, the dsRNA may be defined functionally as a nucleotide sequence (or oligonucleotide sequence) that is capable of hybridizing with a portion of the C5 RNA (e.g., 400 mM NaCl, 40 mM PIPES pH 6.4, 1 mM EDTA, 50° C. or 70° C. hybridization for 12-16 hours; followed by washing). Additional preferred hybridization conditions include hybridization at 70° C. in 1×SSC or 50° C. in 1×SSC, 50% formamide followed by washing at 70° C. in 0.3×SSC or hybridization at 70° C. in 4×SSC or 50° C. in 4×SSC, 50% formamide followed by washing at 67° C. in 1×SSC. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, Tm(° C.)=2(# of A+T bases)+4(# of G+C bases). For hybrids between 18 and 49 base pairs in length, Tm(° C.)=81.5+16.6(log 10[Na+])+0.41 (% G+C)−(600/N), where N is the number of bases in the hybrid, and [Na+] is the concentration of sodium ions in the hybridization buffer ([Na+] for 1×SSC=0.165 M). Additional examples of stringency conditions for polynucleotide hybridization are provided in Sambrook, J., E. F. Fritsch, and T. Maniatis, 1989, Molecular Cloning: A Laboratory Manual, Cold Spring Harbor Laboratory Press, Cold Spring Harbor, N.Y., chapters 9 and 11, and Current Protocols in Molecular Biology, 1995, F. M. Ausubel et al., eds., John Wiley & Sons, Inc., sections 2.10 and 6.3-6.4. The length of the identical nucleotide sequences may be at least 10, 12, 15, 17, 20, 22, 25, 27 or 30 bases.

By "conserved sequence region" is meant, a nucleotide sequence of one or more regions in a polynucleotide does not vary significantly between generations or from one biological system, subject, or organism to another biological system, subject, or organism. The polynucleotide can include both coding and non-coding DNA and RNA.

By "sense region" is meant a nucleotide sequence of a dsRNA molecule having complementarity to an antisense region of the dsRNA molecule. In addition, the sense region of a dsRNA molecule can comprise a nucleic acid sequence having homology with a target nucleic acid sequence.

By "antisense region" is meant a nucleotide sequence of a dsRNA molecule having complementarity to a target nucleic acid sequence. In addition, the antisense region of a dsRNA molecule comprises a nucleic acid sequence having complementarity to a sense region of the dsRNA molecule.

As used herein, "antisense strand" refers to a single stranded nucleic acid molecule which has a sequence complementary to that of a target RNA. When the antisense strand contains modified nucleotides with base analogs, it is not necessarily complementary over its entire length, but must at least hybridize with a target RNA.

As used herein, "sense strand" refers to a single stranded nucleic acid molecule which has a sequence complementary to that of an antisense strand. When the antisense strand contains modified nucleotides with base analogs, the sense strand need not be complementary over the entire length of the antisense strand, but must at least duplex with the antisense strand.

As used herein, "guide strand" refers to a single stranded nucleic acid molecule of a dsRNA or dsRNA-containing molecule, which has a sequence sufficiently complementary to that of a target RNA to result in RNA interference. After cleavage of the dsRNA or dsRNA-containing molecule by Dicer, a fragment of the guide strand remains associated with RISC, binds a target RNA as a component of the RISC complex, and promotes cleavage of a target RNA by RISC. As used herein, the guide strand does not necessarily refer to a continuous single stranded nucleic acid and may comprise a discontinuity, preferably at a site that is cleaved by Dicer. A guide strand is an antisense strand.

As used herein, "passenger strand" refers to an oligonucleotide strand of a dsRNA or dsRNA-containing molecule, which has a sequence that is complementary to that of the guide strand. As used herein, the passenger strand does not necessarily refer to a continuous single stranded nucleic acid and may comprise a discontinuity, preferably at a site that is cleaved by Dicer. A passenger strand is a sense strand.

By "target nucleic acid" is meant a nucleic acid sequence whose expression, level or activity is to be modulated. The target nucleic acid can be DNA or RNA. For agents that target C5, in certain embodiments, the target nucleic acid is C5 RNA, e.g., in certain embodiments, C5 mRNA. C5 RNA target sites can also interchangeably be referenced by corresponding cDNA sequences. Levels of C5 may also be targeted via targeting of upstream effectors of C5, or the effects of modulated or misregulated C5 may also be modulated by targeting of molecules downstream of C5 in the C5 signalling pathway.

By "complementarity" is meant that a nucleic acid can form hydrogen bond(s) with another nucleic acid sequence by either traditional Watson-Crick or other non-traditional types. In reference to the nucleic molecules of the present invention, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al., 1987, CSH Symp. Quant. Biol. LII pp. 123-133; Frier et al., 1986, Proc. Nat. Acad. Sci. USA 83:9373-9377; Turner et al., 1987, J. Am. Chem. Soc. 109:3783-3785). A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9, or 10 nucleotides out of a total of 10 nucleotides in the first oligonucleotide being based paired to a second nucleic acid sequence having 10 nucleotides represents 50%, 60%, 70%, 80%, 90%, and 100% complementary respectively). "Perfectly complementary" means that all the contiguous residues of a nucleic acid sequence will hydrogen bond with the same number of contiguous residues in a second nucleic acid sequence. In one embodiment, a dsRNA molecule of the invention comprises 19 to 30 (e.g., 19, 20, 21, 22, 23, 24, 25, 26, 27, 28, 29, or 30 or more) nucleotides that are complementary to one or more target nucleic acid molecules or a portion thereof.

As used herein, a dsNA, e.g., DsiRNA or siRNA, having a sequence "sufficiently complementary" to a target RNA or cDNA sequence (e.g., C5 mRNA) means that the dsNA has a sequence sufficient to trigger the destruction of the target RNA (where a cDNA sequence is recited, the RNA sequence corresponding to the recited cDNA sequence) by the RNAi machinery (e.g., the RISC complex) or process. For example, a dsNA that is "sufficiently complementary" to a target RNA or cDNA sequence to trigger the destruction of the target RNA by the RNAi machinery or process can be identified as a dsNA that causes a detectable reduction in the level of the target RNA in an appropriate assay of dsNA activity (e.g., an in vitro assay as described in Example 2 below), or, in further examples, a dsNA that is sufficiently complementary to a target RNA or cDNA sequence to trigger the destruction of the target RNA by the RNAi machinery or process can be identified as a dsNA that produces at least a 5%, at least a 10%, at least a 15%, at least a 20%, at least a 25%, at least a 30%, at least a 35%, at least a 40%, at least a 45%, at least a 50%, at least a 55%, at least a 60%, at least a 65%, at least a 70%, at least a 75%, at least a 80%, at least a 85%, at least a 90%, at least a 95%, at least a 98% or at least a 99% reduction in the level of the target RNA in an appropriate assay of dsNA activity. In additional examples, a dsNA that is sufficiently complementary to a target RNA or cDNA sequence to trigger the destruction of the target RNA by the RNAi machinery or process can be identified based upon assessment of the duration of a certain level of inhibitory activity with respect to the target RNA or protein levels in a cell or organism. For example, a dsNA that is sufficiently complementary to a target RNA or cDNA sequence to trigger the destruction of the target RNA by the RNAi machinery or process can be identified as a dsNA capable of reducing target mRNA levels by at least 20% at least 48 hours post-administration of said dsNA to a cell or organism. Preferably, a dsNA that is sufficiently complementary to a target RNA or cDNA sequence to trigger the destruction of the target RNA by the RNAi machinery or process is identified as a dsNA capable of reducing target mRNA levels by at least 40% at least 72 hours post-administration of said dsNA to a cell or organism, by at least 40% at least four, five or seven days post-administration of said dsNA to a cell or organism, by at least 50% at least 48 hours post-administration of said dsNA to a cell or organism, by at least 50% at least 72 hours post-administration of said dsNA to a cell or organism, by at least 50% at least four, five or seven days post-administration of said dsNA to a cell or organism, by at least 80% at least 48 hours post-administration of said dsNA to a cell or organism, by at least 80% at least 72 hours post-administration of said dsNA to a cell or organism, or by at least 80% at least four, five or seven days post-administration of said dsNA to a cell or organism.

In certain embodiments, a nucleic acid of the invention (e.g., a DsiRNA or siRNA) possesses a sequence "sufficiently complementary to hybridize" to a target RNA or cDNA sequence, thereby achieving an inhibitory effect upon the target RNA. Hybridization, and conditions available for determining whether one nucleic acid is sufficiently complementary to another nucleic acid to allow the two sequences to hybridize, is described in greater detail below.

As will be clear to one of ordinary skill in the art, "sufficiently complementary" (contrasted with, e.g., "100% complementary") allows for one or more mismatches to exist between a dsNA of the invention and the target RNA or cDNA sequence (e.g., C5 mRNA), provided that the dsNA possesses complementarity sufficient to trigger the destruction of the target RNA by the RNAi machinery (e.g., the RISC complex) or process. In certain embodiments, a "sufficiently complementary" dsNA of the invention can harbor one, two, three or even four or more mismatches between the dsNA sequence and the target RNA or cDNA sequence (e.g., in certain such embodiments, the antisense strand of the dsRNA harbors one, two, three, four, five or even six or more mismatches when aligned with the target RNA or cDNA sequence for maximum complementarity). Additional consideration of the preferred location of such mismatches within certain dsRNAs of the instant invention is considered in greater detail below.

In one embodiment, dsRNA molecules of the invention that down regulate or reduce C5 gene expression are used for treating, preventing or reducing C5-related diseases or disorders (e.g., PNH) in a subject or organism.

In one embodiment of the present invention, each sequence of a DsiRNA molecule of the invention is independently 25 to 35 nucleotides in length, in specific embodiments 25, 26, 27, 28, 29, 30, 31, 32, 33, 34 or 35 nucleotides in length. In another embodiment, the DsiRNA duplexes of the invention independently comprise 25 to 30 base pairs (e.g., 25, 26, 27, 28, 29, or 30). In another embodiment, one or more strands of the DsiRNA molecule of the invention independently comprises 19 to 35 nucleotides (e.g., 19, 20, 21, 22, 23, 24, 25, 26, 27, 28, 29, 30, 31, 32, 33, 34 or 35) that are complementary to a target (C5) nucleic acid molecule. In certain embodiments, a DsiRNA molecule of the invention possesses a length of duplexed nucleotides between 25 and 66 nucleotides, optionally between 25 and 49 nucleotides in length (e.g., 25, 26, 27, 28, 29, 30, 31, 32, 33, 34, 35, 36, 37, 38, 39, 40, 41, 42, 43, 44, 45, 46, 47, 48 or 49, 50, 51, 52, 53, 54, 55, 56, 57, 58, 59, 60, 61, 62, 63, 64, 65, 66 nucleotides in length; optionally, all such nucleotides base pair with cognate nucleotides of the opposite strand). (Exemplary DsiRNA molecules of the invention are shown in FIG. 1, and below.)

In related embodiments, a dsNA of the invention possesses strand lengths that are, independently, between 19 and 66 nucleotides in length, optionally between 25 and 53 nucleotides in length, e.g., 19, 20, 21, 22, 23, 24, 25, 26, 27, 28, 29, 30, 31, 32, 33, 34, 35, 36, 37, 38, 39, 40, 41, 42, 43, 44, 45, 46, 47, 48 or 49, 50, 51, 52, 53, 54, 55, 56, 57, 58, 59, 60, 61, 62, 63, 64, 65, 66 nucleotides in length. In certain embodiments, one strand length is 19-35 nucleotides in length, while the other strand length is 30-66 nucleotides in length and at least one strand has a 5' overhang of at least 5 nucleotides in length relative to the other strand. In certain related embodiments, the 3' end of the first strand and the 5' end of the second strand form a structure that is a blunt end or a 1-6 nucleotide 3' overhang, while the 5' end of the first strand forms a 5-35 nucleotide overhang with respect to the 3' end of the second strand. Optionally, between one and all nucleotides of the 5-35 nucleotide overhang are modified nucleotides (optionally, deoxyribonucleotides and/or modified ribonucleotides, or otherwise modified as described elsewhere herein).

In some embodiments, a dsNA of the invention has a first or second strand that has at least 8 contiguous ribonucleotides. In certain embodiments, a dsNA of the invention has 9, 10, 11, 12, 13, 14, 15, 16, 17, 18, 19, 20, 21, 22, 23 or more (e.g., 24, 25, 26, 27, 28, 29, 30, 31, 32, 33, 34, 35, 26, or more, up to the full length of the strand) ribonucleotides, optionally including modified ribonucleotides (2'-O-methyl ribonucleotides, phosphorothioate linkages, etc.). In certain embodiments, the ribonucleotides or modified ribonucleotides are contiguous.

In certain embodiments of the invention, tetraloop- and modified nucleotide-containing dsNAs are contemplated as described, e.g., in US 2011/0288147. In certain such embodiments, a dsNA of the invention possesses a first strand and a second strand, where the first strand and the second strand form a duplex region of 19-25 nucleotides in length, wherein the first strand comprises a 3' region that extends beyond the first strand-second strand duplex region and comprises a tetraloop, and the dsNA comprises a discontinuity between the 3' terminus of the first strand and the 5' terminus of the second strand. Optionally, the discontinuity is positioned at a projected dicer cleavage site of the tetraloop-containing dsNA. It is contemplated that, as for any of the other duplexed oligonucleotides of the invention, tetraloop-containing duplexes of the invention can possess any range of modifications disclosed herein or otherwise known in the art, including, e.g., 2'-O-methyl, 2'-fluoro, inverted base, GalNAc moieties, etc.

In certain embodiments, a dsNA comprising a first strand and a second strand, each strand, independently, having a 5' terminus and a 3' terminus, and having, independently, respective strand lengths of 25-53 nucleotides in length, is sufficiently highly modified (e.g., at least 10% or more, at least 20% or more, at least 30% or more, at least 40% or more, at least 50% or more, at least 60% or more, at least 70% or more, at least 80% or more, at least 90% or more, at least 95% or more residues of one and/or both strands are modified such that dicer cleavage of the dsNA is prevented (optionally, modified residues occur at and/or flanking one or all predicted dicer cleavage sites of the dsNA). Such non-dicer-cleaved dsNAs retain C5 inhibition activity and are optionally cleaved by non-dicer nucleases to yield, e.g., 15-30, or in particular embodiments, 19-23 nucleotide strand length dsNAs capable of inhibiting C5 in a mammalian cell. In certain related embodiments, dsNAs possessing sufficiently extensive modification to block dicer cleavage of such dsNAs optionally possess regions of unmodified nucleotide residues (e.g., one or two or more consecutive nucleotides, forming a "gap" or "window" in a modification pattern) that allow for and/or promote cleavage of such dsNAs by non-Dicer nucleases. In other embodiments, Dicer-cleaved dsNAs of the invention can include extensive modification patterns that possess such "windows" or "gaps" in modification such that Dicer cleavage preferentially occurs at such sites (as compared to heavily modified regions within such dsNAs).

In certain embodiments of the present invention, an oligonucleotide is provided (optionally, as a free antisense oligonucleotide or as an oligonucleotide of a double-stranded or other multiple-stranded structure) that includes a sequence complementary to the C5 target as described elsewhere herein and that is 15 to 80 nucleotides in length, e.g., in specific embodiments 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79 or 80 nucleotides in length.

In certain additional embodiments of the present invention, each oligonucleotide of a DsiRNA molecule of the invention is independently 25 to 53 nucleotides in length, in specific embodiments 25, 26, 27, 28, 29, 30, 31, 32, 33, 34, 35, 36, 37, 38, 39, 40, 41, 42, 43, 44, 45, 46, 47, 48, 49, 50, 51, 52 or 53 nucleotides in length. For DsiRNAs possessing a strand that exceeds 30 nucleotides in length, available structures include those where only one strand exceeds 30 nucleotides in length (see, e.g., U.S. Pat. No. 8,349,809), or those where both strands exceed 30 nucleotides in length (see, e.g., WO 2010/080129). Stabilizing modifications (e.g., 2'-O-Methyl, phosphorothioate, deoxyribonucleotides, including dNTP base pairs, 2'-F, etc.) can be incorporated within any double stranded nucleic acid of the invention, and can be used in particular within DsiRNAs possessing one or both strands exceeding 30 nucleotides in length. While the guide strand of a double stranded nucleic acid of the invention must possess a sequence of, e.g., 15, 16, 17, 18 or 19 nucleotides that are complementary to a target RNA (e.g., mRNA), additional sequence(s) of the guide strand need not be complementary to the target RNA. The end structures of double stranded nucleic acids possessing at least one strand length in excess of 30 nucleotides can also be varied while continuing to yield functional dsNAs—e.g. the 5' end of the guide strand and the 3' end of the passenger strand may form a 5'-overhang, a blunt end or a 3' overhang (for certain dsNAs, e.g., "single strand extended" dsNAs, the length of such a 5' or 3' overhang can be 1-4, 1-5, 1-6, 1-10, 1-15, 1-20 or even 1-25 or more nucleotides); similarly, the 3' end of the guide strand and the 5' end of the passenger strand may form a 5'-overhang, a blunt end or a 3' overhang (for certain dsNAs, e.g., "single strand extended" dsNAs, the length of such a 5' or 3' overhang can be 1-4, 1-5, 1-6, 1-10, 1-15, 1-20 or even 1-25 or more nucleotides). In certain embodiments, the 5' end of the passenger strand includes a 5'-overhang relative to the 3' end of the guide strand, such that a one to fifteen or more nucleotide single strand extension exists. Optionally, such single strand extensions of the dsNAs of the invention (whether present on the passenger or the guide strand) can be modified, e.g., with phosphorothioate (PS), 2'-F, 2'-O-methyl and/or other forms of modification contemplated herein or known in the art, including conjugation to, e.g., GalNAc moieties, inverted abasic residues, etc. In some embodiments, the guide strand of a single-strand extended duplex of the invention is between 35 and 50 nucleotides in length, while the duplex presents a single-strand extension that is seven to twenty nucleotides in length. In certain embodiments, the guide strand of a duplex is between 37 and 42 nucleotides in length and the duplex possesses a 5' single-stranded overhang of the passenger strand that is approximately five to fifteen single-stranded nucleotides in length (optionally, 6, 7, 8, 9, 10, 11, 12, 13, or 14 nucleotides in length). In related embodiments, the passenger strand of the duplex is about 25 to about 30 nucleotides in length. In certain embodiments, the extended region of the duplex can optionally be extensively modified, e.g., with one or more of 2'-O-methyl, 2'-Fluoro, GalNAc moieties, phosphorothioate internucleotide linkages, inverted abasic residues, etc. In certain embodiments, the length of the passenger strand is 31-49 nucleotides while the length of the guide strand is 31-53 nucleotides, optionally while the 5' end of the guide strand forms a blunt end (optionally, a base-paired blunt end) with the 3' end of the passenger strand, optionally, with the 3' end of the guide strand and the 5' end of the passenger strand forming a 3' overhang of 1-4 nucleotides in length.

Exemplary "extended" Dicer substrate structures are set forth, e.g., in US 2010/0173974 and U.S. Pat. No. 8,349,809, both of which are incorporated herein by reference. In certain embodiments, one or more strands of the dsNA molecule of the invention independently comprises 19 to 35 nucleotides (e.g., 19, 20, 21, 22, 23, 24, 25, 26, 27, 28, 29, 30, 31, 32, 33, 34 or 35) that are complementary to a target (C5) nucleic acid molecule. In certain embodiments, a DsiRNA molecule of the invention possesses a length of duplexed nucleotides between 25 and 49 nucleotides in length (e.g., 25, 26, 27, 28, 29, 30, 31, 32, 33, 34, 35, 36, 37, 38, 39, 40, 41, 42, 43, 44, 45, 46, 47, 48 or 49 nucleotides in length; optionally, all such nucleotides base pair with cognate nucleotides of the opposite strand).

In a further embodiment of the present invention, each oligonucleotide of a DsiRNA molecule of the invention is independently 19 to 66 nucleotides in length, in specific embodiments 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65 or 66 nucleotides in length. For dsNAs possessing a strand that exceeds 30 nucleotides in length, available structures include those where only one strand exceeds 30 nucleotides in length (see, e.g., U.S. Pat. No. 8,349,809, where an exemplary double stranded nucleic acid possesses a first oligonucleotide strand having a 5' terminus and a 3' terminus and a second oligonucleotide strand having a 5' terminus and a 3' terminus, where each of the 5' termini has a 5' terminal nucleotide and each of the 3' termini has a 3' terminal nucleotide, where the first strand (or the second strand) is 25-30 nucleotide residues in length, where starting from the 5' terminal nucleotide (position 1) positions 1 to 23 of the first strand (or the second strand) include at least 8 ribonucleotides; the second strand (or the first strand) is 36-66 nucleotide residues in length and, starting from the 3' terminal nucleotide, includes at least 8 ribonucleotides in the positions paired with positions 1-23 of the first strand to form a duplex; where at least the 3' terminal nucleotide of the second strand (or the first strand) is unpaired with the first strand (or the second strand), and up to 6 consecutive 3' terminal nucleotides are unpaired with the first strand (or the second strand), thereby forming a 3' single stranded overhang of 1-6 nucleotides; where the 5' terminus of the second strand (or the first strand) includes from 10-30 consecutive nucleotides which are unpaired with the first strand (or the second strand), thereby forming a 10-30 nucleotide single stranded 5' overhang; where at least the first strand (or the second strand) 5' terminal and 3' terminal nucleotides are base paired with nucleotides of the second strand (or first strand) when the first and second strands are aligned for maximum complementarity, thereby forming a substantially duplexed region between the first and second strands; and the second strand is sufficiently complementary to a target RNA along at least 19 ribonucleotides of the second strand length to reduce target gene expression when the double stranded nucleic acid is introduced into a mammalian cell), or those where both strands exceed 30 nucleotides in length (see, e.g., U.S. Pat. No. 8,513,207, where an exemplary double stranded nucleic acid (dsNA) possesses a first oligonucleotide strand having a 5' terminus and a 3' terminus and a second oligonucleotide strand having a 5' terminus and a 3' terminus, where the first strand is 31 to 49 nucleotide residues in length, where starting from the first nucleotide (position 1) at the 5' terminus of the first strand, positions 1 to 23 of the first strand are ribonucleotides; the second strand is 31 to 53 nucleotide residues in length and includes 23 consecutive ribonucleotides that base pair with the ribonucleotides of positions 1 to 23 of the first strand to form a duplex; the 5' terminus of the first strand and the 3' terminus of said second strand form a blunt end or a 1-4 nucleotide 3' overhang; the 3' terminus of the first strand and the 5' terminus of said second strand form a duplexed blunt end, a 5' overhang or a 3' overhang; optionally, at least one of positions 24 to the 3' terminal nucleotide residue of the first strand is a deoxyribonucleotide, optionally, that base pairs with a deoxyribonucleotide of said second strand; and the second strand is sufficiently complementary to a target RNA along at least 19 ribonucleotides of the second strand length to reduce target gene expression when the double stranded nucleic acid is introduced into a mammalian cell).

In certain embodiments, an active dsNA of the invention can possess a 5' overhang of the first strand (optionally, the passenger strand) with respect to the second strand (optionally, the guide strand) of 2-50 nucleotides (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50) or more in length. In related embodiments, the duplex region formed by the first and second strands of such a dsNA is 15, 16, 17, 18, 19, 20, 21, 22, 23, 24, 25 or more base pairs in length. The 5' overhang "extended" region of the first strand is optionally modified at one or more residues (optionally, at alternating residues, all residues, or any other selection of residues).

In certain embodiments, an active dsNA of the invention can possess a 3' overhang of the first strand (optionally, the passenger strand) with respect to the second strand (optionally, the guide strand) of 2-50 nucleotides (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50) or more in length. In related embodiments, the duplex region formed by the first and second strands of such a dsNA is 15, 16, 17, 18, 19, 20, 21, 22, 23, 24, 25 or more base pairs in length. The 3' overhang "extended" region of the first strand is optionally modified at one or more residues (optionally, at alternating residues, all residues, or any other selection of residues).

In additional embodiments, an active dsNA of the invention can possess a 5' overhang of the second strand (optionally, the guide strand) with respect to the first strand (optionally, the passenger strand) of 2-50 nucleotides (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50) or more in length. In related embodiments, the duplex region formed by the first and second strands of such a dsNA is 15, 16, 17, 18, 19, 20, 21, 22, 23, 24, 25 or more base pairs in length. The 5' overhang "extended" region of the second strand is optionally modified at one or more residues (optionally, at alternating residues, all residues, or any other selection of residues).

In further embodiments, an active dsNA of the invention can possess a 3' overhang of the second strand (optionally, the guide strand) with respect to the first strand (optionally, the passenger strand) of 2-50 nucleotides (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50) or more in length. In related embodiments, the duplex region formed by the first and second strands of such a dsNA is 15, 16, 17, 18, 19, 20, 21, 22, 23, 24, 25 or more base pairs in length. The 3' overhang "extended" region of the second strand is optionally modified at one or more residues (optionally, at alternating residues, all residues, or any other selection of residues).

In another embodiment of the present invention, each sequence of a DsiRNA molecule of the invention is independently 25 to 35 nucleotides in length, in specific embodiments 25, 26, 27, 28, 29, 30, 31, 32, 33, 34 or 35 nucleotides in length. In another embodiment, the DsiRNA duplexes of the invention independently comprise 25 to 30 base pairs (e.g., 25, 26, 27, 28, 29, or 30). In another embodiment, one or more strands of the DsiRNA molecule of the invention independently comprises 19 to 35 nucleotides (e.g., 19, 20, 21, 22, 23, 24, 25, 26, 27, 28, 29, 30, 31, 32, 33, 34 or 35) that are complementary to a target (C5) nucleic acid molecule. In certain embodiments, a DsiRNA molecule of the invention possesses a length of duplexed nucleotides between 25 and 34 nucleotides in length (e.g., 25, 26, 27, 28, 29, 30, 31, 32, 33 or 34 nucleotides in length; optionally, all such nucleotides base pair with cognate nucleotides of the opposite strand). (Exemplary DsiRNA molecules of the invention are shown in FIG. 1, and below.)

In certain embodiments, at least 10%, at least 20%, at least 30%, at least 35%, at least 40%, at least 45%, at least 50%, at least 55%, at least 60%, at least 65%, at least 70%, at least 75%, at least 80%, at least 85%, at least 90%, at least 95% or more of the nucleotide residues of a nucleic acid of the instant invention are modified residues. For a dsNA of the invention, at least 10%, at least 20%, at least 30%, at least 35%, at least 40%, at least 45%, at least 50%, at least 55%, at least 60%, at least 65%, at least 70%, at least 75%, at least 80%, at least 85%, at least 90%, at least 95% or more of the nucleotide residues of the first strand are modified residues. Additionally and/or alternatively for a dsNA of the invention, at least 10%, at least 20%, at least 30%, at least 35%, at least 40%, at least 45%, at least 50%, at least 55%, at least 60%, at least 65%, at least 70%, at least 75%, at least 80%, at least 85%, at least 90%, at least 95% or more of the nucleotide residues of the second strand are modified residues. For the dsNAs of the invention, modifications of both duplex (double-stranded) regions and overhang (single-stranded) regions are contemplated. Thus, in certain embodiments, at least 10%, at least 20%, at least 30%, at least 35%, at least 40%, at least 45%, at least 50%, at least 55%, at least 60%, at least 65%, at least 70%, at least 75%, at least 80%, at least 85%, at least 90%, at least 95% or more (e.g., all) duplex nucleotide residues are modified residues. Additionally and/or alternatively, at least 10%, at least 20%, at least 30%, at least 35%, at least 40%, at least 45%, at least 50%, at least 55%, at least 60%, at least 65%, at least 70%, at least 75%, at least 80%, at least 85%, at least 90%, at least 95% or more (e.g., all) overhang nucleotide residues of one or both strands are modified residues. Optionally, the modifications of the dsNAs of the invention do not include an inverted abasic (e.g., inverted deoxy abasic) or inverted dT end-protecting group. Alternatively, a dsNA of the invention includes a terminal cap moiety (e.g., an inverted deoxy abasic and/or inverted dT end-protecting group). Optionally, such a terminal cap moiety is located at the 5' end, at the 3' end, or at both the 5' end and the 3' end of the first strand, of the second strand, or of both first and second strands.

As used herein "cell" is used in its usual biological sense, and does not refer to an entire multicellular organism, e.g., specifically does not refer to a human. The cell can be present in an organism, e.g., birds, plants and mammals such as humans, cows, sheep, apes, monkeys, swine, dogs, and cats. The cell can be prokaryotic (e.g., bacterial cell) or eukaryotic (e.g., mammalian or plant cell). The cell can be of somatic or germ line origin, totipotent or pluripotent, dividing or non-dividing. The cell can also be derived from or can comprise a gamete or embryo, a stem cell, or a fully differentiated cell. Within certain aspects, the term "cell" refers specifically to mammalian cells, such as human cells, that contain one or more isolated dsRNA molecules of the present disclosure. In particular aspects, a cell processes dsRNAs or dsRNA-containing molecules resulting in RNA interference of target nucleic acids, and contains proteins and protein complexes required for RNAi, e.g., Dicer and RISC.

In certain embodiments, dsRNAs of the invention are Dicer substrate siRNAs ("DsiRNAs"). DsiRNAs can possess certain advantages as compared to inhibitory nucleic acids that are not dicer substrates ("non-DsiRNAs"). Such advantages include, but are not limited to, enhanced duration of effect of a DsiRNA relative to a non-DsiRNA, as well as enhanced inhibitory activity of a DsiRNA as compared to a non-DsiRNA (e.g., a 19-23mer siRNA) when each inhibitory nucleic acid is suitably formulated and assessed for inhibitory activity in a mammalian cell at the same concentration (in this latter scenario, the DsiRNA would be identified as more potent than the non-DsiRNA). Detection of the enhanced potency of a DsiRNA relative to a non-DsiRNA is often most readily achieved at a formulated concentration (e.g., transfection concentration of the dsRNA) that results in the DsiRNA eliciting approximately 30-70% knockdown activity upon a target RNA (e.g., a mRNA). For active DsiRNAs, such levels of knockdown activity are most often achieved at in vitro mammalian cell DsiRNA transfection concentrations of 1 nM or less of as suitably formulated, and in certain instances are observed at DsiRNA transfection concentrations of 200 pM or less, 100 pM or less, 50 pM or less, 20 pM or less, 10 pM or less, 5 pM or less, or even 1 pM or less. Indeed, due to the variability among DsiRNAs of the precise concentration at which 30-70% knockdown of a target RNA is observed, construction of an $IC_{50}$ curve via assessment of the inhibitory activity of DsiRNAs and non-DsiRNAs across a range of effective concentrations is a preferred method for detecting the enhanced potency of a DsiRNA relative to a non-DsiRNA inhibitory agent.

In certain embodiments, a DsiRNA (in a state as initially formed, prior to dicer cleavage) is more potent at reducing C5 target gene expression in a mammalian cell than a 19, 20, 21, 22 or 23 base pair sequence that is contained within it. In certain such embodiments, a DsiRNA prior to dicer cleavage is more potent than a 19-21mer contained within it. Optionally, a DsiRNA prior to dicer cleavage is more potent than a 19 base pair duplex contained within it that is synthesized with symmetric dTdT overhangs (thereby forming a siRNA possessing 21 nucleotide strand lengths having dTdT overhangs). In certain embodiments, the DsiRNA is more potent than a 19-23mer siRNA (e.g., a 19 base pair duplex with dTdT overhangs) that targets at least 19 nucleotides of the 21 nucleotide target sequence that is recited for a DsiRNA of the invention (without wishing to be bound by theory, the identity of a such a target site for a DsiRNA is identified via identification of the Ago2 cleavage site for the DsiRNA; once the Ago2 cleavage site of a DsiRNA is determined for a DsiRNA, identification of the Ago2 cleavage site for any other inhibitory dsRNA can be performed and these Ago2 cleavage sites can be aligned, thereby determining the alignment of projected target nucleotide sequences for multiple dsRNAs). In certain related embodiments, the DsiRNA is more potent than a 19-23mer siRNA that targets at least 20 nucleotides of the 21 nucleotide target sequence that is recited for a DsiRNA of the invention. Optionally, the DsiRNA is more potent than a 19-23mer siRNA that targets the same 21 nucleotide target sequence that is recited for a DsiRNA of the invention. In certain embodiments, the DsiRNA is more potent than any 21mer siRNA that targets the same 21 nucleotide target sequence that is recited for a DsiRNA of the invention. Optionally, the DsiRNA is more potent than any 21 or 22mer siRNA that targets the same 21 nucleotide target sequence that is recited for a DsiRNA of the invention. In certain embodiments, the DsiRNA is more potent than any 21, 22 or 23mer siRNA that targets the same 21 nucleotide target sequence that is recited for a DsiRNA of the invention. As noted above, such potency assessments are most effectively performed upon dsRNAs that are suitably formulated (e.g., formulated with an appropriate transfection reagent) at a concentration of 1 nM or less. Optionally, an $IC_{50}$ assessment is performed to evaluate activity across a range of effective inhibitory concentrations, thereby allowing for robust comparison of the relative potencies of dsRNAs so assayed.

The dsRNA molecules of the invention are added directly, or can be complexed with lipids (e.g., cationic lipids), packaged within liposomes, or otherwise delivered to target cells or tissues. The nucleic acid or nucleic acid complexes can be locally administered to relevant tissues ex vivo, or in vivo through direct dermal application, transdermal application, or injection, with or without their incorporation in biopolymers. In particular embodiments, the nucleic acid molecules of the invention comprise sequences shown in FIG. 1, and the below exemplary structures. Examples of such nucleic acid molecules consist essentially of sequences defined in these figures and exemplary structures. Furthermore, where such agents are modified in accordance with the below description of modification patterning of DsiRNA agents, chemically modified forms of constructs described in FIG. 1, and the below exemplary structures can be used in all uses described for the DsiRNA agents of FIG. 1, and the below exemplary structures.

In another aspect, the invention provides mammalian cells containing one or more dsRNA molecules of this invention. The one or more dsRNA molecules can independently be targeted to the same or different sites.

By "RNA" is meant a molecule comprising at least one, and preferably at least 4, 8 and 12 ribonucleotide residues. The at least 4, 8 or 12 RNA residues may be contiguous. By "ribonucleotide" is meant a nucleotide with a hydroxyl group at the 2' position of a β-D-ribofuranose moiety. The terms include double-stranded RNA, single-stranded RNA, isolated RNA such as partially purified RNA, essentially pure RNA, synthetic RNA, recombinantly produced RNA, as well as altered RNA that differs from naturally occurring RNA by the addition, deletion, substitution and/or alteration of one or more nucleotides. Such alterations can include addition of non-nucleotide material, such as to the end(s) of the dsRNA or internally, for example at one or more nucleotides of the RNA. Nucleotides in the RNA molecules of the instant invention can also comprise non-standard nucleotides, such as non-naturally occurring nucleotides or chemically synthesized nucleotides or deoxynucleotides. These altered RNAs can be referred to as analogs or analogs of naturally-occurring RNA.

By "subject" is meant an organism, which is a donor or recipient of explanted cells or the cells themselves. "Subject" also refers to an organism to which the dsRNA agents of the invention can be administered. A subject can be a mammal or mammalian cells, including a human or human cells.

The phrase "pharmaceutically acceptable carrier" refers to a carrier for the administration of a therapeutic agent. Exemplary carriers include saline, buffered saline, dextrose, water, glycerol, ethanol, and combinations thereof. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract. The pharmaceutically acceptable carrier of the disclosed dsRNA compositions may be micellar structures, such as a liposomes, capsids, capsoids, polymeric nanocapsules, or polymeric microcapsules.

Polymeric nanocapsules or microcapsules facilitate transport and release of the encapsulated or bound dsRNA into the cell. They include polymeric and monomeric materials, especially including polybutylcyanoacrylate. A summary of materials and fabrication methods has been published (see Kreuter, 1991). The polymeric materials which are formed from monomeric and/or oligomeric precursors in the polymerization/nanoparticle generation step, are per se known from the prior art, as are the molecular weights and molecular weight distribution of the polymeric material which a person skilled in the field of manufacturing nanoparticles may suitably select in accordance with the usual skill.

Various methodologies of the instant invention include step that involves comparing a value, level, feature, characteristic, property, etc. to a "suitable control", referred to interchangeably herein as an "appropriate control". A "suitable control" or "appropriate control" is a control or standard familiar to one of ordinary skill in the art useful for comparison purposes. In one embodiment, a "suitable control" or "appropriate control" is a value, level, feature, characteristic, property, etc. determined prior to performing an RNAi methodology, as described herein. For example, a transcription rate, mRNA level, translation rate, protein level, biological activity, cellular characteristic or property, genotype, phenotype, etc. can be determined prior to introducing an RNA silencing agent (e.g., DsiRNA) of the invention into a cell or organism. In another embodiment, a "suitable control" or "appropriate control" is a value, level, feature, characteristic, property, etc. determined in a cell or organism, e.g., a control or normal cell or organism, exhibiting, for example, normal traits. In yet another embodiment, a "suitable control" or "appropriate control" is a predefined value, level, feature, characteristic, property, etc.

The term "in vitro" has its art recognized meaning, e.g., involving purified reagents or extracts, e.g., cell extracts. The term "in vivo" also has its art recognized meaning, e.g., involving living cells, e.g., immortalized cells, primary cells, cell lines, and/or cells in an organism.

"Treatment", or "treating" as used herein, is defined as the application or administration of a therapeutic agent (e.g., a dsRNA agent or a vector or transgene encoding same) to a patient, or application or administration of a therapeutic agent to an isolated tissue or cell line from a patient, who has a disorder with the purpose to cure, heal, alleviate, relieve, alter, remedy, ameliorate, improve or affect the disease or disorder, or symptoms of the disease or disorder. The term "treatment" or "treating" is also used herein in the context of administering agents prophylactically. The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. The term "patient" includes human and other mammalian subjects that receive either prophylactic or therapeutic treatment.

Structures of Anti-C5 DsiRNA Agents

In certain embodiments, the anti-C5 DsiRNA agents of the invention can have the following structures:

In one such embodiment. the DsiRNA comprises:

```
5'-XXXXXXXXXXXXXXXXXXXXXXXXX-3'

3'-YXXXXXXXXXXXXXXXXXXXXXXXX-5'
``` wherein "X", RNA and "Y" is an overhang domain comprised of 1-4 RNA monomers that are optionally 2'-O-methyl RNA monomers. In a related embodiment, the DsiRNA comprises:

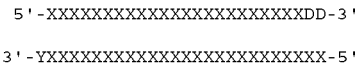

wherein "X", RNA, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand.

DsiRNAs of the invention can carry a broad range of modification patterns (e.g., 2'-O-methyl RNA patterns, e.g., within extended DsiRNA agents). Certain modification patterns of the second strand of DsiRNAs of the invention are presented below.

In one embodiment, the DsiRNA comprises:

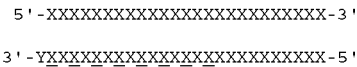

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

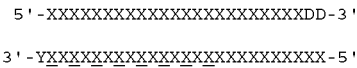

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers, and "D"=DNA. The top strand is the sense strand, and the bottom strand is the antisense strand.

In another such embodiment, the DsiRNA comprises:

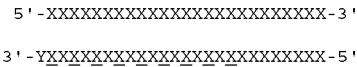

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In another such embodiment, the DsiRNA comprises:

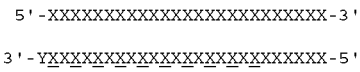

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

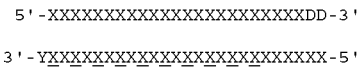

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In further embodiments, the DsiRNA comprises:

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

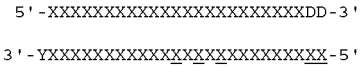

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

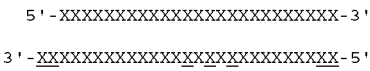

wherein "X"=RNA and "X"=2'-O-methyl RNA. In a further related embodiment, the DsiRNA comprises:

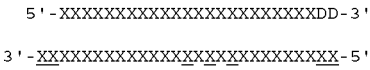

wherein "X"=RNA, "X"=2'-O-methyl RNA, and "D"=DNA. The top strand is the sense strand, and the bottom strand is the antisense strand. This modification pattern is also referred to herein as the "AS-M7" or "M7" modification pattern.

In additional embodiments, the DsiRNA comprises:

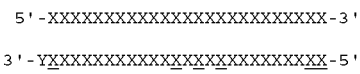

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. The top strand is the sense strand, and the bottom strand is the antisense strand. In another related embodiment, the DsiRNA comprises:

wherein "X"=RNA and "X"=2'-O-methyl RNA. The top strand is the sense strand, and the bottom strand is the antisense strand. In a further related embodiment, the DsiRNA comprises:

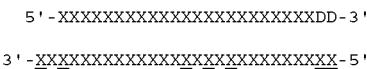

wherein "X"=RNA, "X"=2'-O-methyl RNA, and "D"=DNA. The top strand is the sense strand, and the bottom strand is the antisense strand. This modification pattern is also referred to herein as the "AS-M6" or "M6" modification pattern.

In other embodiments, the DsiRNA comprises:

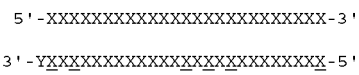

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

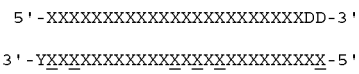

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

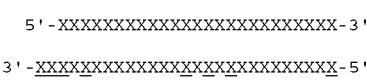

wherein "X"=RNA and "X"=2'-O-methyl RNA. The top strand is the sense strand, and the bottom strand is the antisense strand. In another related embodiment, the DsiRNA comprises:

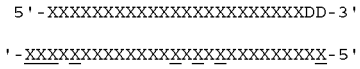

wherein "X"=RNA, "X"=2'-O-methyl RNA, and "D"=DNA. The top strand is the sense strand, and the bottom strand is the antisense strand. This modification pattern is also referred to herein as the "AS-M5" or "M5" modification pattern.

In further embodiments, the DsiRNA comprises:

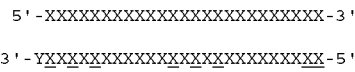

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

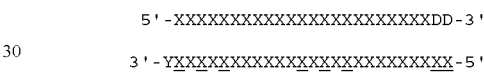

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

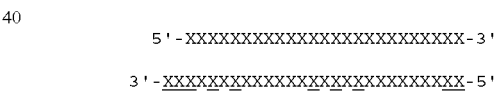

wherein "X"=RNA and "X"=2'-O-methyl RNA. The top strand is the sense strand, and the bottom strand is the antisense strand. In a further related embodiment, the DsiRNA comprises:

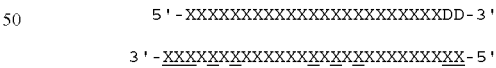

wherein "X"=RNA, "X"=2'-O-methyl RNA, and "D"=DNA. The top strand is the sense strand, and the bottom strand is the antisense strand. This modification pattern is also referred to herein as the "AS-M4" or "M4" modification pattern.

In additional embodiments, the DsiRNA comprises:

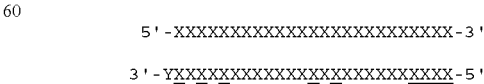

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M8" or "M8" modification pattern.

In other embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M3" or "M3" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXXXDD-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M2" or "M2" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M1" or "M1" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M9" or "M9" modification pattern.

In other embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M10" or "M10" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M11" or "M11" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M12" or "M12" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M13" or "M13" modification pattern.

In other embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In another related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M21" or "M21" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M14" or "M14" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M15" or "M15" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

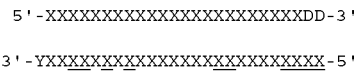

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

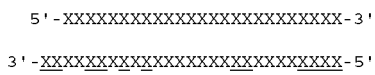

wherein "X"=RNA and "X"=2'-O-methyl RNA. The top strand is the sense strand, and the bottom strand is the antisense strand. In a further related embodiment, the DsiRNA comprises:

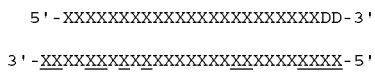

wherein "X"=RNA, "X"=2'-O-methyl RNA, and "D"=DNA. The top strand is the sense strand, and the bottom strand is the antisense strand. This modification pattern is also referred to herein as the "AS-M16" or "M16" modification pattern.

In additional embodiments, the DsiRNA comprises:

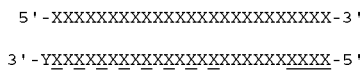

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

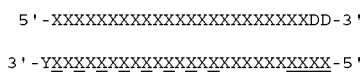

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

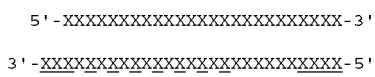

wherein "X"=RNA and "X"=2'-O-methyl RNA. The top strand is the sense strand, and the bottom strand is the antisense strand. In a further related embodiment, the DsiRNA comprises:

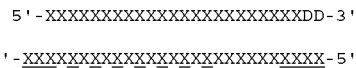

wherein "X"=RNA, "X"=2'-O-methyl RNA, and "D"=DNA. The top strand is the sense strand, and the bottom strand is the antisense strand. This modification pattern is also referred to herein as the "AS-M17" or "M17" modification pattern.

In further embodiments, the DsiRNA comprises:

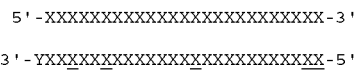

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

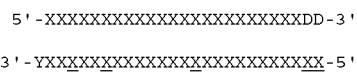

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

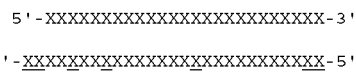

wherein "X"=RNA and "X"=2'-O-methyl RNA. The top strand is the sense strand, and the bottom strand is the antisense strand. In a further related embodiment, the DsiRNA comprises:

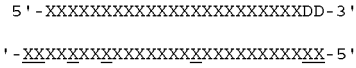

wherein "X"=RNA, "X"=2'-O-methyl RNA, and "D"=DNA. The top strand is the sense strand, and the bottom strand is the antisense strand. This modification pattern is also referred to herein as the "AS-M18" or "M18" modification pattern.

In additional embodiments, the DsiRNA comprises:

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M19" or "M19" modification pattern.

In further embodiments, the DsiRNA comprises:

```
5'-XXXXXXXXXXXXXXXXXXXXXXX-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M20" or "M20" modification pattern.

In additional embodiments, the DsiRNA comprises:

```
5'-XXXXXXXXXXXXXXXXXXXXXXX-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M22" or "M22" modification pattern.

In further embodiments, the DsiRNA comprises:

```
5'-XXXXXXXXXXXXXXXXXXXXXXX-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'
3'-YXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M24" or "M24" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'
3'-YXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M25" or "M25" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'
3'-YXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M26" or "M26" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M27" or "M27" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M28" or "M28" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M29" or "M29" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

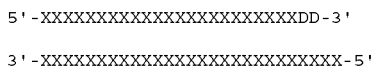

wherein "X"=RNA, "X"=2'-O-methyl RNA, and "D"=DNA. The top strand is the sense strand, and the bottom strand is the antisense strand. This modification pattern is also referred to herein as the "AS-M30" or "M30" modification pattern.

In further embodiments, the DsiRNA comprises:

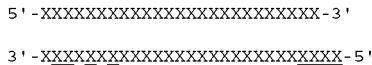

wherein "X"=RNA and "X"=2'-O-methyl RNA. The top strand is the sense strand, and the bottom strand is the antisense strand. In a further related embodiment, the DsiRNA comprises:

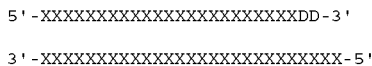

wherein "X"=RNA, "X"=2'-O-methyl RNA, and "D"=DNA. The top strand is the sense strand, and the bottom strand is the antisense strand. This modification pattern is also referred to herein as the "AS-M31" or "M31" modification pattern.

In additional embodiments, the DsiRNA comprises:

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M32" or "M32" modification pattern.

In further embodiments, the DsiRNA comprises:

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

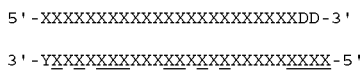

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

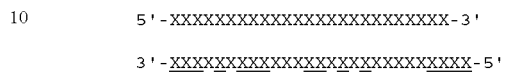

wherein "X"=RNA and "X"=2'-O-methyl RNA. The top strand is the sense strand, and the bottom strand is the antisense strand. In a further related embodiment, the DsiRNA comprises:

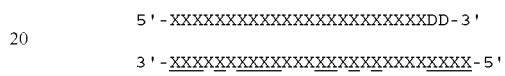

wherein "X"=RNA, "X"=2'-O-methyl RNA, and "D"=DNA. The top strand is the sense strand, and the bottom strand is the antisense strand. This modification pattern is also referred to herein as the "AS-M34" or "M34" modification pattern.

In additional embodiments, the DsiRNA comprises:

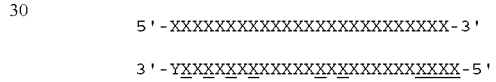

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

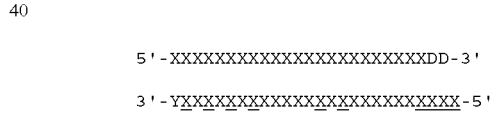

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

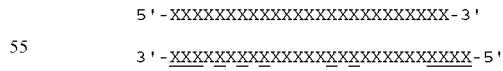

wherein "X"=RNA and "X"=2'-O-methyl RNA. The top strand is the sense strand, and the bottom strand is the antisense strand. In a further related embodiment, the DsiRNA comprises:

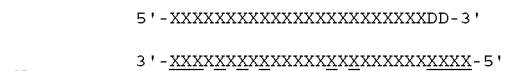

wherein "X"=RNA, "X"=2'-O-methyl RNA, and "D"=DNA. The top strand is the sense strand, and the bottom strand is the antisense strand. This modification pattern is also referred to herein as the "AS-M35" or "M35" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M37" or "M37" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M38" or "M38" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M40" or "M40" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M41" or "M41" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M36" or "M36" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M42" or "M42" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

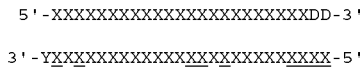

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

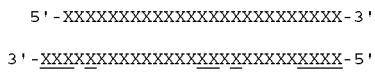

wherein "X"=RNA and "X̲"=2'-O-methyl RNA. The top strand is the sense strand, and the bottom strand is the antisense strand. In a further related embodiment, the DsiRNA comprises:

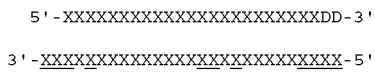

wherein "X"=RNA, "X̲"=2'-O-methyl RNA, and "D"=DNA. The top strand is the sense strand, and the bottom strand is the antisense strand. This modification pattern is also referred to herein as the "AS-M43" or "M43" modification pattern.

In additional embodiments, the DsiRNA comprises:

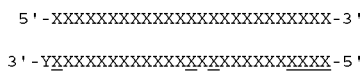

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

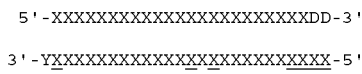

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

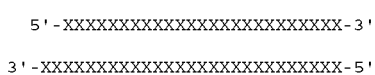

wherein "X"=RNA and "X̲"=2'-O-methyl RNA. The top strand is the sense strand, and the bottom strand is the antisense strand. In a further related embodiment, the DsiRNA comprises:

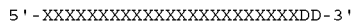
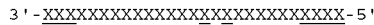

wherein "X"=RNA, "X̲"=2'-O-methyl RNA, and "D"=DNA. The top strand is the sense strand, and the bottom strand is the antisense strand. This modification pattern is also referred to herein as the "AS-M44" or "M44" modification pattern.

In further embodiments, the DsiRNA comprises:

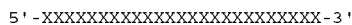

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

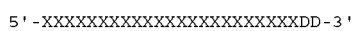
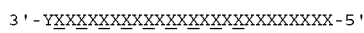

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

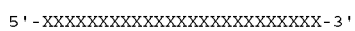
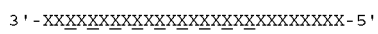

wherein "X"=RNA and "X̲"=2'-O-methyl RNA. The top strand is the sense strand, and the bottom strand is the antisense strand. In a further related embodiment, the DsiRNA comprises:

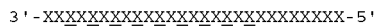

wherein "X"=RNA, "X̲"=2'-O-methyl RNA, and "D"=DNA. The top strand is the sense strand, and the bottom strand is the antisense strand. This modification pattern is also referred to herein as the "AS-M45" or "M45" modification pattern.

In additional embodiments, the DsiRNA comprises:

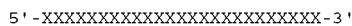

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

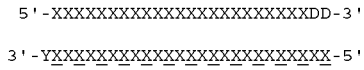

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

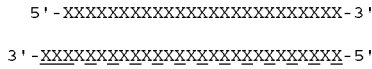

wherein "X"=RNA and "X"=2'-O-methyl RNA. The top strand is the sense strand, and the bottom strand is the antisense strand. In a further related embodiment, the DsiRNA comprises:

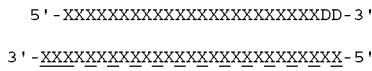

wherein "X"=RNA, "X"=2'-O-methyl RNA, and "D"=DNA. The top strand is the sense strand, and the bottom strand is the antisense strand. This modification pattern is also referred to herein as the "AS-M46" or "M46" modification pattern.

In further embodiments, the DsiRNA comprises:

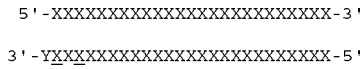

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

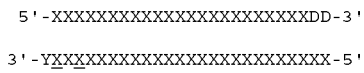

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

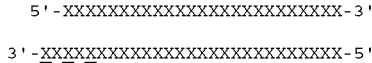

wherein "X"=RNA and "X"=2'-O-methyl RNA. The top strand is the sense strand, and the bottom strand is the antisense strand. In a further related embodiment, the DsiRNA comprises:

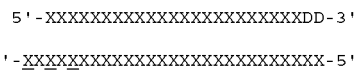

wherein "X"=RNA, "X"=2'-O-methyl RNA, and "D"=DNA. The top strand is the sense strand, and the bottom strand is the antisense strand. This modification pattern is also referred to herein as the "AS-M47" or "M47" modification pattern.

In additional embodiments, the DsiRNA comprises:

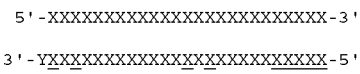

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

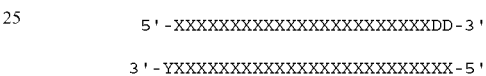

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

wherein "X"=RNA and "X"=2'-O-methyl RNA. The top strand is the sense strand, and the bottom strand is the antisense strand. In a further related embodiment, the DsiRNA comprises:

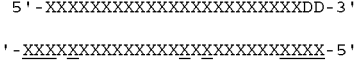

wherein "X"=RNA, "X"=2'-O-methyl RNA, and "D"=DNA. The top strand is the sense strand, and the bottom strand is the antisense strand. This modification pattern is also referred to herein as the "AS-M48" or "M48" modification pattern.

In further embodiments, the DsiRNA comprises:

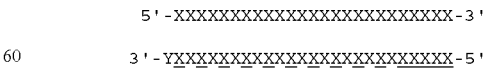

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M52" or "M52" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M54" or "M54" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M55" or "M55" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M56" or "M56" modification pattern.

In additional embodiments, the DsiRNA comprises:

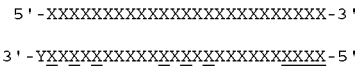

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

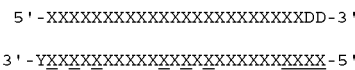

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

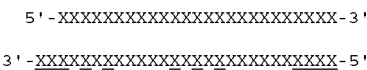

wherein "X"=RNA and "X"=2'-O-methyl RNA. The top strand is the sense strand, and the bottom strand is the antisense strand. In a further related embodiment, the DsiRNA comprises:

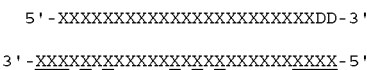

wherein "X"=RNA, "X"=2'-O-methyl RNA, and "D"=DNA. The top strand is the sense strand, and the bottom strand is the antisense strand. This modification pattern is also referred to herein as the "AS-M57" or "M57" modification pattern.

In further embodiments, the DsiRNA comprises:

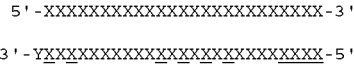

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

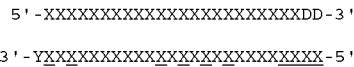

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

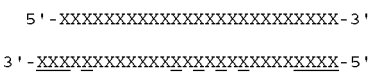

wherein "X"=RNA and "X"=2'-O-methyl RNA. The top strand is the sense strand, and the bottom strand is the antisense strand. In a further related embodiment, the DsiRNA comprises:

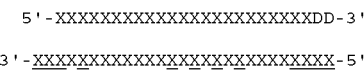

wherein "X"=RNA, "X"=2'-O-methyl RNA, and "D"=DNA. The top strand is the sense strand, and the bottom strand is the antisense strand. This modification pattern is also referred to herein as the "AS-M58" or "M58" modification pattern.

In additional embodiments, the DsiRNA comprises:

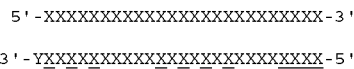

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

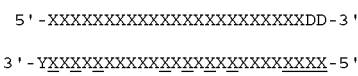

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M59" or "M59" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M60" or "M60" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M61" or "M61" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

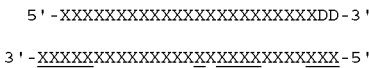

wherein "X"=RNA, "X̲"=2'-O-methyl RNA, and "D"=DNA. The top strand is the sense strand, and the bottom strand is the antisense strand. This modification pattern is also referred to herein as the "AS-M62" or "M62" modification pattern.

In additional embodiments, the DsiRNA comprises:

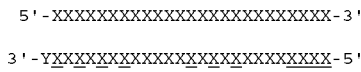

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

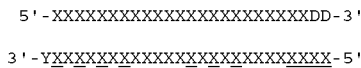

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

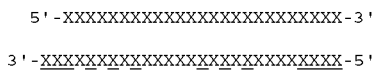

wherein "X"=RNA and "X̲"=2'-O-methyl RNA. The top strand is the sense strand, and the bottom strand is the antisense strand. In a further related embodiment, the DsiRNA comprises:

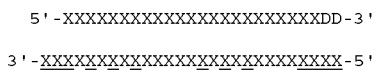

wherein "X"=RNA, "X̲"=2'-O-methyl RNA, and "D"=DNA. The top strand is the sense strand, and the bottom strand is the antisense strand. This modification pattern is also referred to herein as the "AS-M63" or "M63" modification pattern.

In further embodiments, the DsiRNA comprises:

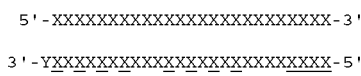

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

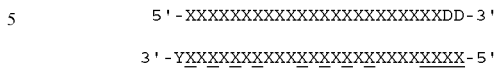

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

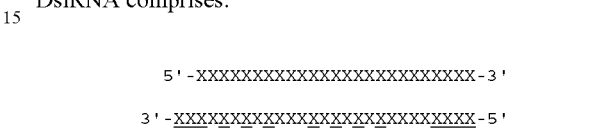

wherein "X"=RNA and "X̲"=2'-O-methyl RNA. The top strand is the sense strand, and the bottom strand is the antisense strand. In a further related embodiment, the DsiRNA comprises:

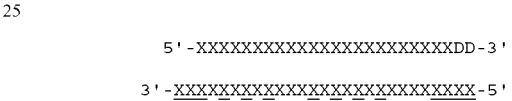

wherein "X"=RNA, "X̲"=2'-O-methyl RNA, and "D"=DNA. The top strand is the sense strand, and the bottom strand is the antisense strand. This modification pattern is also referred to herein as the "AS-M64" or "M64" modification pattern.

In additional embodiments, the DsiRNA comprises:

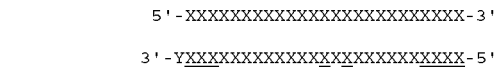

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

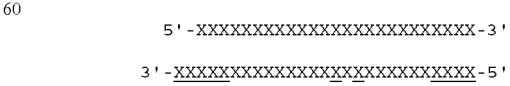

wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M65" or "M65" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M66" or "M66" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M67" or "M67" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M68" or "M68" modification pattern.

In additional embodiments, the DsiRNA comprises:

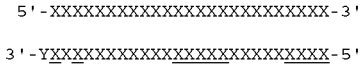

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

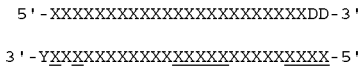

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

wherein "X"=RNA and "X̲"=2'-O-methyl RNA. The top strand is the sense strand, and the bottom strand is the antisense strand. In a further related embodiment, the DsiRNA comprises:

wherein "X"=RNA, "X̲"=2'-O-methyl RNA, and "D"=DNA. The top strand is the sense strand, and the bottom strand is the antisense strand. This modification pattern is also referred to herein as the "AS-M69" or "M69" modification pattern.

In further embodiments, the DsiRNA comprises:

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

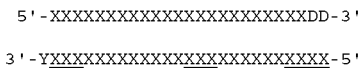

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

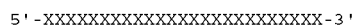

wherein "X"=RNA and "X̲"=2'-O-methyl RNA. The top strand is the sense strand, and the bottom strand is the antisense strand. In a further related embodiment, the DsiRNA comprises:

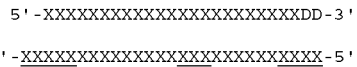

wherein "X"=RNA, "X̲"=2'-O-methyl RNA, and "D"=DNA. The top strand is the sense strand, and the bottom strand is the antisense strand. This modification pattern is also referred to herein as the "AS-M70" or "M70" modification pattern.

In additional embodiments, the DsiRNA comprises:

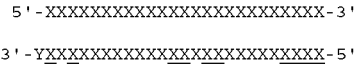

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

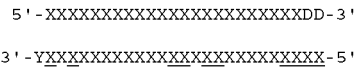

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

wherein "X"=RNA and "X̲"=2'-O-methyl RNA. The top strand is the sense strand, and the bottom strand is the antisense strand. In a further related embodiment, the DsiRNA comprises:

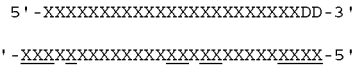

wherein "X"=RNA, "X̲"=2'-O-methyl RNA, and "D"=DNA. The top strand is the sense strand, and the bottom strand is the antisense strand. This modification pattern is also referred to herein as the "AS-M71" or "M71" modification pattern.

In further embodiments, the DsiRNA comprises:

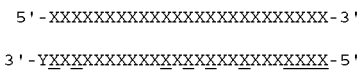

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

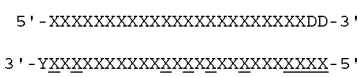

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

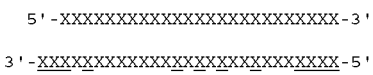

wherein "X"=RNA and "X"=2'-O-methyl RNA. The top strand is the sense strand, and the bottom strand is the antisense strand. In a further related embodiment, the DsiRNA comprises:

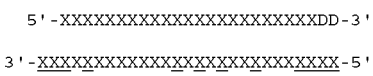

wherein "X"=RNA, "X"=2'-O-methyl RNA, and "D"=DNA. The top strand is the sense strand, and the bottom strand is the antisense strand. This modification pattern is also referred to herein as the "AS-M72" or "M72" modification pattern.

In additional embodiments, the DsiRNA comprises:

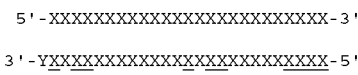

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

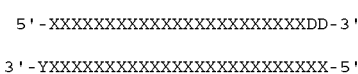

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

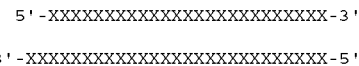

wherein "X"=RNA and "X"=2'-O-methyl RNA. The top strand is the sense strand, and the bottom strand is the antisense strand. In a further related embodiment, the DsiRNA comprises:

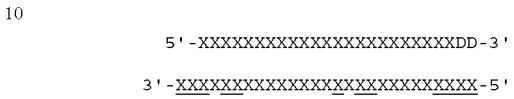

wherein "X"=RNA, "X"=2'-O-methyl RNA, and "D"=DNA. The top strand is the sense strand, and the bottom strand is the antisense strand. This modification pattern is also referred to herein as the "AS-M73" or "M73" modification pattern.

In additional embodiments, the DsiRNA comprises:

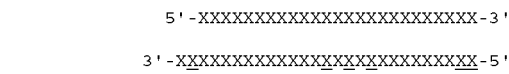

wherein "X"=RNA and "X"=2'-O-methyl RNA. In a further related embodiment, the DsiRNA comprises:

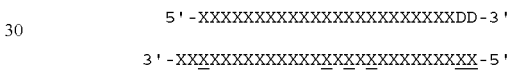

wherein "X"=RNA, "X"=2'-O-methyl RNA, and "D"=DNA. The top strand is the sense strand, and the bottom strand is the antisense strand. This modification pattern is also referred to herein as the "AS-M7*" or "M7*" modification pattern.

In further embodiments, the DsiRNA comprises:

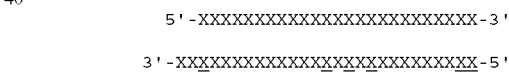

wherein "X"=RNA and "X"=2'-O-methyl RNA. The top strand is the sense strand, and the bottom strand is the antisense strand. In a further related embodiment, the DsiRNA comprises:

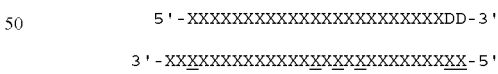

wherein "X"=RNA, "X"=2'-O-methyl RNA, and "D"=DNA. The top strand is the sense strand, and the bottom strand is the antisense strand. This modification pattern is also referred to herein as the "AS-M6*" or "M6*" modification pattern.

In other embodiments, the DsiRNA comprises:

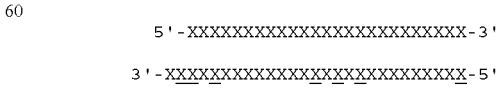

wherein "X"=RNA and "X"=2'-O-methyl RNA. The top strand is the sense strand, and the bottom strand is the antisense strand. In another related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M5*" or "M5*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M4*" or "M4*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M8*" or "M8*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M2*" or "M2*" modification pattern.

In other embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M10*" or "M10*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M11*" or "M11*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M13*" or "M13*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

wherein "X"=RNA, "X̲"=2'-O-methyl RNA, and "D"=DNA. The top strand is the sense strand, and the bottom strand is the antisense strand. This modification pattern is also referred to herein as the "AS-M14*" or "M14*" modification pattern.

In additional embodiments, the DsiRNA comprises:

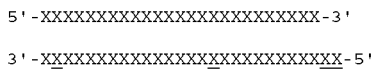

wherein "X"=RNA and "X̲"=2'-O-methyl RNA. The top strand is the sense strand, and the bottom strand is the antisense strand. In a further related embodiment, the DsiRNA comprises:

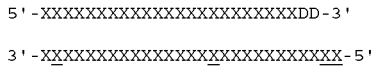

wherein "X"=RNA, "X̲"=2'-O-methyl RNA, and "D"=DNA. The top strand is the sense strand, and the bottom strand is the antisense strand. This modification pattern is also referred to herein as the "AS-M15*" or "M15*" modification pattern.

In further embodiments, the DsiRNA comprises:

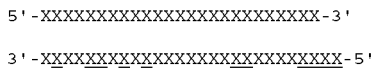

wherein "X"=RNA and "X̲"=2'-O-methyl RNA. The top strand is the sense strand, and the bottom strand is the antisense strand. In a further related embodiment, the DsiRNA comprises:

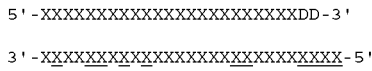

wherein "X"=RNA, "X̲"=2'-O-methyl RNA, and "D"=DNA. The top strand is the sense strand, and the bottom strand is the antisense strand. This modification pattern is also referred to herein as the "AS-M16*" or "M16*" modification pattern.

In additional embodiments, the DsiRNA comprises:

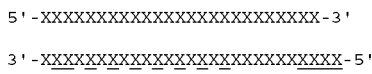

wherein "X"=RNA and "X̲"=2'-O-methyl RNA. The top strand is the sense strand, and the bottom strand is the

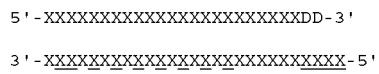

wherein "X"=RNA, "X̲"=2'-O-methyl RNA, and "D"=DNA. The top strand is the sense strand, and the bottom strand is the antisense strand. This modification pattern is also referred to herein as the "AS-M17*" or "M17*" modification pattern.

In further embodiments, the DsiRNA comprises:

wherein "X"=RNA and "X̲"=2'-O-methyl RNA. The top strand is the sense strand, and the bottom strand is the antisense strand. In a further related embodiment, the DsiRNA comprises:

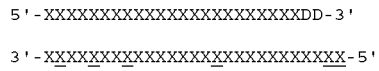

wherein "X"=RNA, "X̲"=2'-O-methyl RNA, and "D"=DNA. The top strand is the sense strand, and the bottom strand is the antisense strand. This modification pattern is also referred to herein as the "AS-M18*" or "M18*" modification pattern.

In additional embodiments, the DsiRNA comprises:

wherein "X"=RNA and "X̲"=2'-O-methyl RNA. The top strand is the sense strand, and the bottom strand is the antisense strand. In a further related embodiment, the DsiRNA comprises:

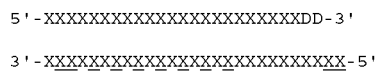

wherein "X"=RNA, "X̲"=2'-O-methyl RNA, and "D"=DNA. The top strand is the sense strand, and the bottom strand is the antisense strand. This modification pattern is also referred to herein as the "AS-M19*" or "M19*" modification pattern.

In further embodiments, the DsiRNA comprises:

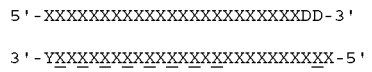

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

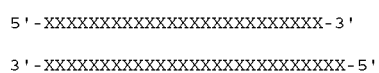

wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'
3'-XXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M20*" or "M20*" modification pattern.

In additional embodiments, the DsiRNA comprises:

5'-XXXXXXXXXXXXXXXXXXXXXXXXX-3'
3'-XXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'
3'-XXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M22*" or "M22*" modification pattern.

In further embodiments, the DsiRNA comprises:

5'-XXXXXXXXXXXXXXXXXXXXXXXXX-3'
3'-XXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'
3'-XXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M24*" or "M24*" modification pattern.

In additional embodiments, the DsiRNA comprises:

5'-XXXXXXXXXXXXXXXXXXXXXXXXX-3'
3'-XXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'
3'-XXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M25*" or "M25*" modification pattern.

In further embodiments the DsiRNA comprises:

5'-XXXXXXXXXXXXXXXXXXXXXXXXX-3'
3'-XXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'
3'-XXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M26*" or "M26*" modification pattern.

In additional embodiments, the DsiRNA comprises:

5'-XXXXXXXXXXXXXXXXXXXXXXXXX-3'
3'-XXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'
3'-XXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M27*" or "M27*" modification pattern.

In additional embodiments, the DsiRNA comprises:

5'-XXXXXXXXXXXXXXXXXXXXXXXXX-3'
3'-XXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXDD-3'
3'-XXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M28*" or "M28*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M29*" or "M29*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M34*" or "M34*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M35*" or "M35*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M37*" or "M37*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M38*" or "M38*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M40*" or "M40*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M41*" or "M41*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M36*" or "M36*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M42*" or "M42*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M43*" or "M43*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M44*" or "M44*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M46*" or "M46*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M47*" or "M47*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M48*" or "M48*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M52*" or "M52*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M54*" or "M54*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M55*" or "M55*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M56*" or "M56*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M57*" or "M57*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M58*" or "M58*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M59*" or "M59*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M60*" or "M60*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M61*" or "M61*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M62*" or "M62*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M63*" or "M63*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M64*" or "M64*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M65*" or "M65*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M66*" or "M66*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M67*" or "M67*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M68*" or "M68*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M69*" or "M69*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M70*" or "M70*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
       5'-XXXXXXXXXXXXXXXXXXXXXXXDD-3'
       3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M71*" or "M71*" modification pattern.

In further embodiments, the DsiRNA comprises:

```
       5'-XXXXXXXXXXXXXXXXXXXXXXXXX-3'
       3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
       5'-XXXXXXXXXXXXXXXXXXXXXXXDD-3'
       3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M72*" or "M72*" modification pattern.

In additional embodiments, the DsiRNA comprises:

```
       5'-XXXXXXXXXXXXXXXXXXXXXXXXX-3'
       3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
       5'-XXXXXXXXXXXXXXXXXXXXXXXDD-3'
       3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M73*" or "M73*" modification pattern.

Additional exemplary antisense strand modifications include the following:

```
3'-XXXXXXXXXXXXXXXXXXXXXXXXXXX-5'     "AS-M74"
3'-XXXXXXXXXXXXXXXXXXXXXXXXXXX-5'     "AS-M75"
3'-XXXXXXXXXXXXXXXXXXXXXXXXXXX-5'     "AS-M76"
3'-XXXXXXXXXXXXXXXXXXXXXXXXXXX-5'     "AS-M77"
3'-XXXXXXXXXXXXXXXXXXXXXXXXXXX-5'     "AS-M78"
```

-continued

```
3'-XXXXXXXXXXXXXXXXXXXXXXXXXXX-5'      "AS-M79"
3'-XXXXXXXXXXXXXXXXXXXXXXXXXXX-5'      "AS-M80"
3'-XXXXXXXXXXXXXXXXXXXXXXXXXXX-5'      "AS-M81"
3'-XpXXXXXXXXXXXXXXXXXXXXXXXXXX-5'     "AS-M82"
3'-XpXXXXXXXXXXXXXXXXXXXXXXXXXX-5'     "AS-M83"
3'-XXXXXXXXXXXXXXXXXXXXXXXXXXX-5'      "AS-M84"
3'-XXXXXXXXXXXXXXXXXXXXXXXXXXX-5'      "AS-M85"
3'-FFFXXXXXXXXXXXXXXXXXXXXFFFF-5'      "AS-M88"
3'-XXXXFXXXFXXXXXXXXXXXXXXXXX-5'       "AS-M89"
3'-FFFXFXFXFXFXFXFXXXXXXFFFF-5'        "AS-M90"
3'-FFFXXXXXXXXXXXXXXXXXXXXFF-5'        "AS-M91"
3'-XXXXXFXXXXXFXFXXXXXXXXXXX-5'        "AS-M92"
3'-FFFXFXXXXXXXXXXXFXXXXXXXX-5'        "AS-M93"
3'-FFFXFXFXXXXXFXFXFXXXXFFFF-5'        "AS-M94"
3'-FFFXFXFXFXFXFXFXXXXXXFFFF-5'        "AS-M95"
3'-FFFXFXFXFXFXFXFXXXXXXFFpF-5'        "AS-M96"
3'-XXXXXXXXXXXXXXXXXXXXXXXXXXX-5'      "AS-M210"
3'-XXXXXXXXXXXXXXXXXXXXXXXXXXX-5'      "AS-M74*"
3'-XXXXXXXXXXXXXXXXXXXXXXXXXXX-5'      "AS-M75*"
3'-XXXXXXXXXXXXXXXXXXXXXXXXXXX-5'      "AS-M76*"
3'-XXXXXXXXXXXXXXXXXXXXXXXXXXX-5'      "AS-M77*"
3'-XXXXXXXXXXXXXXXXXXXXXXXXXXX-5'      "AS-M78*"
3'-XXXXXXXXXXXXXXXXXXXXXXXXXXX-5'      "AS-M79*"
3'-XXXXXXXXXXXXXXXXXXXXXXXXXXX-5'      "AS-M80*"
3'-XpXXXXXXXXXXXXXXXXXXXXXXXXXX-5'     "AS-M82*"
3'-XpXXXXXXXXXXXXXXXXXXXXXXXXXX-5'     "AS-M83*"
3'-XXXXXXXXXXXXXXXXXXXXXXXXXXX-5'      "AS-M84*"
3'-XFFXXXXXXXXXXXXXXXXXXFFFF-5'        "AS-M88*"
3'-XXXXFXXXFXXXXXXXXXXXXXXXXX-5'       "AS-M89*"
3'-XFFXFXFXFXFXFXFXXXXXXFFFF-5'        "AS-M90*"
3'-XFFXXXXXXXXXXXXXXXXXXXXFF-5'        "AS-M91*"
3'-XXXXXFXXXXXFXFXXXXXXXXXXX-5'        "AS-M92*"
3'-XFFXFXXXXXXXXXXXFXXXXXXXX-5'        "AS-M93*"
3'-XFFXFXXXXXFXFXFXXXXFFFF-5'          "AS-M94*"
3'-XFFXFXFXFXFXFXFXXXXXXFFFF-5'        "AS-M95*"
3'-XFFXFXFXFXFXFXFXXXXXXFFpF-5'        "AS-M96*"
3'-XXXXXXXXXXXXXXXXXXXXXXXXXXX-5'      "AS-M210*"
3'-XpXXXXXXXXXXXXXXXXXXXXXXXXpX-5'     "AS-M101"
3'-XpXXXXXXXXXXXXXXXXXXXXXXXXpX-5'     "AS-M104"
3'-XpXXXXXXXXXXXXXXXXXXXXXXXXpX-5'     "AS-M104*"
3'-XpFpXFXFXFXFXFXFXFXFFXXXpX-5'       "AS-M105"
```

-continued

3'-XpFpXFXFXFXFXFXFXFXFXFFXXXpX-5' "AS-M105*"

3'-XpXXXXXXXXXXXXXXXXXXXXXXXXXpX-5' "AS-M106"

3'-XpXXXXXXXXXXXXXXXXXXXXXXXXXpX-5' "AS-M106*"

3'-XXpXXXXXXXXXXXXXXXXXXXXXXXXX-5' "AS-M107"

3'-XXpXXXXXXXXXXXXXXXXXXXXXXXXX-5' "AS-M107*"

3'-ba-XXXXXXXXXXXXXXXXXXXXXXXXXX-5' "AS-M108"
(ba = inverted abasic for F7 stabilization at 3' end)

3'-ba-XXXXXXXXXXXXXXXXXXXXXXXXXXX-5' "AS-M108*"
(ba = inverted abasic for F7 stabilization at 3' end)

3'-XDXXXXXXXXXXXXXXXXXXXXXXXXX-5' "AS-M109"

3'-XpXXFXFXFXXXXXXXXXXXXXXXXpX-5' "AS-M110"

3'-XpXXFXFXFXXXXXXXXXXXXXXXXpX-5' "AS-M110*"

3'-XpXXFXFXFXXXXXFXFXFXXXXXXpX-5' "AS-M111"

3'-XpXXFXFXFFXXXXXXXXFXXXXXXpX-5' "AS-M112"

3'-XpXXFXFXFFXXFXFXXXFXXXXXXpX-5' "AS-M113"

3'-XpXXFXFXFFFFFXXXXXXFXXXXXXpX-5' "AS-M114"

3'-XpXXFXFXFFFFFXXXXXXFXXFXXXpX-5' "AS-M115"

3'-XpXXFXFXFFFFFXXXXXXFFFFXXXpX-5' "AS-M116"

3'-XpFXFXFXFXFXFXFXFXFXFXFXFpX-5' "AS-M117"

3'-XpXXFXFXFXXXXXXFXFXFXXXXXXpX-5' "AS-M111*"

3'-XpXXFXFXFFXXXXXXXXFXXXXXXpX-5' "AS-M112*"

3'-XpXXFXFXFFXXFXXXXXXFXXXXXXpX-5' "AS-M113*"

3'-XpXXFXFXFFFFFXXXXXXXFXXXXXXpX-5' "AS-M114*"

3'-XpXXFXFXFFFFFXXXXXXXFXXFXXXpX-5' "AS-M115*"

3'-XpXXFXFXFFFFFXXXXXXXFFFFXXXpX-5' "AS-M116*"

3'-XpFXFXFXFXFXFXFXFXFXFXFXFpX-5' "AS-M117*"

3'-XpXXXXXXXXXXXXXXXXXXXXXXXXpX-5' "AS-M120"

3'-XpXXXXXXXXXXXXXXXXXXXXXXXXpX-5' "AS-M121"

3'-XpXXXXXXXXXXXXXXXXXXXXXXXXpX-5' "AS-M122"

3'-XpXXXXXXXXXXXXXXXXXXXXXXXXpX-5' "AS-M123"

3'-XpXXXXXXXXXXXXXXXXXXXXXXXXpX-5' "AS-M124"

3'-XpXXXXXXXXXXXXXXXXXXXXXXXXpX-5' "AS-M125"

3'-XpFpXFXFXFXXXXXFXFXFXXXXFXFpX-5' "AS-M126"

3'-XpFpXFXFXFXXXXXFXFXFXXXXFXFpX-5' "AS-M127"

3'-XpFpXFXFXFXFXFXFXFXFXFFXXXpX-5' "AS-M128"

3'-XpFpXFXFXFXFXFXFXFXFXFFFFFpF-5' "AS-M129"

3'-XpFpXFXFXFXFXFXFXFXFXXXXFXFpX-5' "AS-M130"

3'-XpFpXFXFXFXFXFXFXFXFXFXFXpX-5' "AS-M131"

3'-XpFpXFXFXFXFXFXFXFXFXFXXXpX-5' "AS-M132"

3'-XpFpXFXFXFXFXFXFXFXFXFXXXXpX-5' "AS-M133"

3'-XpFpXFXFXFXFXFXFXFXFXFXFFFpF-5' "AS-M134"

3'-XXXXXXXXXXXXXXXXXXXXXXXXXXXX-5' "AS-M135"

3'-XXXXXXXXXXXXXXXXXXXXXXXXXXXX-5' "AS-M136"

3'-XXXXXXXXXXXXXXXXXXXXXXXXXXXX-5' "AS-M137"

3'-XXXFXFXFXXXXXFXFXFXXXXXXXX-5' "AS-M138"

3'-XXXFXFXFFXXXXXXXXXFXXXXXXXX-5' "AS-M139"

3'-XpXXFXFXFXXXXXFXFFFXXXXXXpX-5' "AS-M140"

3'-XpXXFXFFFXXXXFFXFXFFFXXXXXXpX-5' "AS-M141"

3'-XpXXFXFXFXFXFXFXFFFXXXXXXpX-5' "AS-M142"

3'-XpXXFXFFFFFFFFXFXFFFXXXXXXpX-5' "AS-M143"

3'-XpXXFXFXFXFXFXFXFXFpXpFpXXXXXpX-5' "AS-M144"

3'-XXXXXXXXXXXXXXFXXXXXXXXXX-5' "AS-M145"

3'-XXXXXXXXXXXXXXFXXXXXXXXXX-5' "AS-M146"

3'-XXXXXXFXXXXXXXFXXXXXXXXXX-5' "AS-M147"

3'-XXXXXXXXXXXXXXFXXXXXXXXXX-5' "AS-M148"

3'-XXXXXXXXXXXXXXFXXXXXXXXXX-5' "AS-M149"

3'-XXXXXXXXXXFXFXXXXXXXXXXX-5' "AS-M150"

3'-XXXXXXXXXXFXXXFXXXXXXXXXX-5' "AS-M151"

3'-XXXXXXXXXXFXXXFXXXXXXXXXX-5' "AS-M152"

3'-XXXXXXXXXXFXXXXXXXXXXXXXX-5' "AS-M153"

3'-XXXXXXXXXFXXXXXXXXXXXXXXX-5' "AS-M154"

3'-XXXXXFXXXXXXXXXXXXXXXXXXX-5' "AS-M155"

3'-XpXXXXXXXXXXXXXXXXXXXXXXXXpX-5' "AS-M156"

3'-XpXXXXXXXXXXXXXXXXXXXXXXXXpX-5' "AS-M157"

3'-XpXXFFFFFXXXFXXFXXFXXXXXXpX-5' "AS-M158"

3'-XpXXFFFFFFFFFXXFXXFFXXXXXXpX-5' "AS-M159"

3'-XpXXFXXXFXXXXFXXXFXXXXXXpX-5' "AS-M160"

3'-XpXXFXXXFXFXFXFXFFXXXXXXpX-5' "AS-M161"

3'-XXXXXXXXFXFXFXXXXXXXXXXXX-5' "AS-M162"

3'-XXXXXXXXXXXXXXXXXXXXXXXX-5' "AS-M163"

3'-XXXXXXXXDXXXXXXXXXXXXXXXXX-5' "AS-M164"

3'-XpXXXXXXXXXXXXXXXXXXXXXXXXpX-5' "AS-M120*"

3'-XpXXXXXXXXXXXXXXXXXXXXXXXXpX-5' "AS-M121*"

3'-XpXXXXXXXXXXXXXXXXXXXXXXXXpX-5' "AS-M122*"

3'-XpXXXXXXXXXXXXXXXXXXXXXXXXpX-5' "AS-M123*"

3'-XpXXXXXXXXXXXXXXXXXXXXXXXXpX-5' "AS-M124*"

3'-XpXXXXXXXXXXXXXXXXXXXXXXXXpX-5' "AS-M125*"

3'-XpFpXFXFXFXXXXXFXFXFXXXXFXFpX-5' "AS-M126*"

3'-XpFpXFXFXFXXXXXFXFXFXXXXFXpX-5' "AS-M127*"

3'-XpFpXFXFXFXFXFXFXFXFXFFXXXpX-5' "AS-M128*"

3'-XpFpXFXFXFXFXFXFXFXFXFFFFFpF-5' "AS-M129*"

-continued

```
3'-XpFpXFXFXFXFXFXFXFXFXFXXXFXFpX-5'  "AS-M130*"

3'-XpFpXFXFXFXFXFXFXFXFXFXFXFpX-5'  "AS-M131*"

3'-XpFpXFXFXFXFXFXFXFXFXFXXXXpX-5'  "AS-M132*"

3'-XpFpXFXFXFXFXFXFXFXFXFXXXXpX-5'  "AS-M133*"

3'-XpFpXFXFXFXFXFXFXFXFXFXFFFpF-5'  "AS-M134*"

3'-XXXXXXXXXXXXXXXXXXXXXXXXXXXX-5'  "AS-M135*"

3'-XXXXXXXXXXXXXXXXXXXXXXXXXXXX-5'  "AS-M136*"

3'-XXXXXXXXXXXXXXXXXXXXXXXXXXXX-5'  "AS-M137*"

3'-XXXFXFXFXXXXXFXFXFXFXXXXXXXX-5'  "AS-M138*"

3'-XXXFXFFFXXXXXXXXFXXXXXXXX-5'  "AS-M139*"

3'-XpXXFXFXFXXXXXFXFFFXXXXXXpX-5'  "AS-M140*"

3'-XpXXFXFXFFXXXXFFXFXFFFXXXXXXpX-5'  "AS-M141*"

3'-XpXXFXFXFXFXFXFXFFFXXXXXXpX-5'  "AS-M142*"

3'-XpXXFXFXFFFFFFFXFXFFFXXXXXXpX-5'  "AS-M143*"

3'-XpXXFXFXFXFXFXFXFpXpFpXXXXXXpX-5'  "AS-M144*"

3'-XXXXXXXXXXXXXXFXXXXXXXXXX-5'  "AS-M145*"

3'-XXXXXXXXXXXXXFXXXXXXXXX-5'  "AS-M146*"

3'-XXXXXXFXXXXXXXXXXXXXXXXXXXX-5'  "AS-M147*"

3'-XXXXXXXXXXXXFXXXXXXXXXXXXXX-5'  "AS-M148*"

3'-XXXXXXXXXXXXFXXXXXXXXXXXXXX-5'  "AS-M149*"

3'-XXXXXXXXXXXFXFXXXXXXXXXXXXX-5'  "AS-M150*"

3'-XXXXXXXXXXXXFXXXFXXXXXXXXXXX-5'  "AS-M151*"

3'-XXXXXXXXXXXFXXXFXXXXXXXXXX-5'  "AS-M152*"

3'-XXXXXXXXFXXXXXXXXXXXXXXXX-5'  "AS-M153*"

3'-XXXXXXXXFXXXXXXXXXXXXXXXX-5'  "AS-M154*"

3'-XXXXXXXFXXXXXXXXXXXXXXXXX-5'  "AS-M155*"

3'-XpXXXXXXXXXXXXXXXXXXXXXXXXpX-5'  "AS-M156*"

3'-XpXXXXXXXXXXXXXXXXXXXXXXXXpX-5'  "AS-M157*"

3'-XpXXFXFFFFXXXXXFXXFFXXXXXXpX-5'  "AS-M158*"

3'-XpXXFXFFFFFFFFXXFXFFXXXXXXpX-5'  "AS-M159*"

3'-XpXXFXXXFXXXXXFXFXXFFXXXXXXpX-5'  "AS-M160*"

3'-XpXXFXXXFXFXFXFXXFFXXXXXXpX-5'  "AS-M161*"

3'-XXXXXXXXFXFXFXXXXXXXXXXXXX-5'  "AS-M162*"

3'-XXXXXXXXXXXXXXXXXXXXXXXXXX-5'  "AS-M163*"

3'-XXXXXXXXDXXXXXXXXXXXXXXXXX-5'  "AS-M164*"

3'-XXXXXXXXXXXXXXXXXXXXXXXXXX-5'  "AS-M211"

3'-XXXXXXXXXXXXXXXXXXXXXXXXXX-5'  "AS-M212"

3'-XXXXXXXXXXXXXXXXXXXXXXXXXX-5'  "AS-M215"

3'-XXXXXXXXXXXXXXXXXXXXXXXXXX-5'  "AS-M216"

3'-XXXXXXXXXXXXXXXXXXXXXXXXXX-5'  "AS-M217"
```

-continued

```
3'-XXXXXXXXXXXXXXXXXXXXXXXXXX-5'  "AS-M218"

3'-XXXXXXXXXXXXXXXXXXXXXXXXXX-5'  "AS-M219"

3'-XXXXXXXXXXXXXXXXXXXXXXXXXX-5'  "AS-M220"

3'-XXXXXXXXXXXXXXXXXXXXXXXXXX-5'  "AS-M221"

3'-XXXXXXXXXXXXXXXXXXXXXXXXXX-5'  "AS-M222"

3'-XXXXXXXXXXXXXXXXXXXXXXXXXX-5'  "AS-M223"

3'-XXXXXXXXXXXXXXXXXXXXXXXXXX-5'  "AS-M224"

3'-XXXXXXXXXXXXXXXXXXXXXXXXXX-5'  "AS-M225"

3'-XXXXXXXXXXXXXXXXXXXXXXXXXX-5'  "AS-M226"

3'-XXXXXXXXXXXXXXXXXXXXXXXXXX-5'  "AS-M230"

3'-XXXXXXXXXXXXXXXXXXXXXXXXXX-5'  "AS-M231"

3'-XXXXXXXXXXXXXXXXXXXXXXXXXX-5'  "AS-M232"

3'-XXXXXXXXXXXXXXXXXXXXXXXXXX-5'  "AS-M233"

3'-XXXXXXXXXXXXXXXXXXXXXXXXXX-5'  "AS-M234"

3'-XXXXXXXXXXXXXXXXXXXXXXXXXX-5'  "AS-M235"

3'-XXXXXXXXXXXXXXXXXXXXXXXXXX-5'  "AS-M236"

3'-XXXXXXXXXXXXXXXXXXXXXXXXXX-5'  "AS-M237"

3'-XXXXXXXXXXXXXXXXXXXXXXXXXX-5'  "AS-M238"

3'-XXXXXXXXXXXXXXXXXXXXXXXXXX-5'  "AS-M239"

3'-XXXXXXXXXXXXXXXXXXXXXXXXXX-5'  "AS-M240"

3'-XXXXXXXXXXXXXXXXXXXXXXXXXX-5'  "AS-M241"

3'-XXXXXXXXXXXXXXXXXXXXXXXXXX-5'  "AS-M242"

3'-XpXXXXXXXXXXXXXXXXXXXXXXXXpX-5'  "AS-M243"

3'-XpXXXXXXXXXXXXXXXXXXXXXXXXpX-5'  "AS-M244"

3'-XpXXXXXXXXXXXXXXXXXXXXXXXXpX-5'  "AS-M245"

3'-XpXXXXXXXXXXXXXXXXXXXXXXXXpX-5'  "AS-M246"

3'-XpXXXXXXXXXXXXXXXXXXXXXXXXpX-5'  "AS-M247"

3'-XpXXXXXXXXXXXXXXXXXXXXXXXXpX-5'  "AS-M248"

3'-XpXXXXXXXXXXXXXXXXXXXXXXXXpX-5'  "AS-M249"

3'-XpXXXXXXXXXXXXXXXXXXXXXXXXpX-5'  "AS-M250"

3'-XpXXXXXXXXXXXXXXXXXXXXXXXXpX-5'  "AS-M251"

3'-XpXXXXXXXXXXXXXXXXXXXXXXXXpX-5'  "AS-M252"

3'-XpXXXXXXXXXXXXXXXXXXXXXXXXpX-5'  "AS-M253"

3'-XpXXXXXXXXXXXXXXXXXXXXXXXXpX-5'  "AS-M254"

3'-XpXXXXXXXXXXXXXXXXXXXXXXXXpX-5'  "AS-M255"

3'-XXXXXXXXXXXXXXXXXXXXXXXXXX-5'  "AS-M211*"

3'-XXXXXXXXXXXXXXXXXXXXXXXXXX-5'  "AS-M212*"

3'-XXXXXXXXXXXXXXXXXXXXXXXXXX-5'  "AS-M215*"

3'-XXXXXXXXXXXXXXXXXXXXXXXXXX-5'  "AS-M216*"

3'-XXXXXXXXXXXXXXXXXXXXXXXXXX-5'  "AS-M217*"

3'-XXXXXXXXXXXXXXXXXXXXXXXXXX-5'  "AS-M218*"
```

-continued

```
3'-XXXXXXXXXXXXXXXXXXXXXXXXXXX-5'  "AS-M219*"
3'-XXXXXXXXXXXXXXXXXXXXXXXXXXX-5'  "AS-M220*"
3'-XXXXXXXXXXXXXXXXXXXXXXXXXXX-5'  "AS-M221*"
3'-XXXXXXXXXXXXXXXXXXXXXXXXXXX-5'  "AS-M222*"
3'-XXXXXXXXXXXXXXXXXXXXXXXXXXX-5'  "AS-M223*"
3'-XXXXXXXXXXXXXXXXXXXXXXXXXXX-5'  "AS-M224*"
3'-XXXXXXXXXXXXXXXXXXXXXXXXXXX-5'  "AS-M225*"
3'-XXXXXXXXXXXXXXXXXXXXXXXXXXX-5'  "AS-M226*"
3'-XXXXXXXXXXXXXXXXXXXXXXXXXXX-5'  "AS-M230*"
3'-XXXXXXXXXXXXXXXXXXXXXXXXXXX-5'  "AS-M231*"
3'-XXXXXXXXXXXXXXXXXXXXXXXXXXX-5'  "AS-M232*"
3'-XXXXXXXXXXXXXXXXXXXXXXXXXXX-5'  "AS-M233*"
3'-XXXXXXXXXXXXXXXXXXXXXXXXXXX-5'  "AS-M234*"
3'-XXXXXXXXXXXXXXXXXXXXXXXXXXX-5'  "AS-M235*"
3'-XXXXXXXXXXXXXXXXXXXXXXXXXXX-5'  "AS-M236*"
3'-XXXXXXXXXXXXXXXXXXXXXXXXXXX-5'  "AS-M237*"
3'-XXXXXXXXXXXXXXXXXXXXXXXXXXX-5'  "AS-M238*"
3'-XXXXXXXXXXXXXXXXXXXXXXXXXXX-5'  "AS-M239*"
3'-XXXXXXXXXXXXXXXXXXXXXXXXXXX-5'  "AS-M240*"
3'-XXXXXXXXXXXXXXXXXXXXXXXXXXX-5'  "AS-M241*"
3'-XXXXXXXXXXXXXXXXXXXXXXXXXXX-5'  "AS-M242*"
3'-XpXXXXXXXXXXXXXXXXXXXXXXXXXpX-5'  "AS-M243*"
3'-XpXXXXXXXXXXXXXXXXXXXXXXXXXpX-5'  "AS-M244*"
3'-XpXXXXXXXXXXXXXXXXXXXXXXXXXpX-5'  "AS-M245*"
3'-XpXXXXXXXXXXXXXXXXXXXXXXXXXpX-5'  "AS-M246*"
3'-XpXXXXXXXXXXXXXXXXXXXXXXXXXpX-5'  "AS-M247*"
3'-XpXXXXXXXXXXXXXXXXXXXXXXXXXpX-5'  "AS-M248*"
3'-XpXXXXXXXXXXXXXXXXXXXXXXXXXpX-5'  "AS-M249*"
3'-XpXXXXXXXXXXXXXXXXXXXXXXXXXpX-5'  "AS-M250*"
3'-XpXXXXXXXXXXXXXXXXXXXXXXXXXpX-5'  "AS-M251*"
3'-XpXXXXXXXXXXXXXXXXXXXXXXXXXpX-5'  "AS-M252*"
3'-XpXXXXXXXXXXXXXXXXXXXXXXXXXpX-5'  "AS-M253*"
3'-XpXXXXXXXXXXXXXXXXXXXXXXXXXpX-5'  "AS-M254*"
3'-XpXXXXXXXXXXXXXXXXXXXXXXXXXpX-5'  "AS-M255*"
``` where "X"=RNA, "X"=2'-O-methyl RNA, "D"=DNA, "F"=2'-Fluoro NA and "p"=Phosphorothioate linkage.

In certain additional embodiments, the antisense strand of selected dsRNAs of the invention are extended, optionally at the 5' end, with an exemplary 5' extension of base "AS-M8", "AS-M17" and "AS-M48" modification patterns respectively represented as follows:

```
                                                  (SEQ ID NO: 3479)
3'-XXXXXXXXXXXXXXXXXXXXXXXXXXXXXUAGCUAUCGT-5'
"AS-M8, extended"

(SEQ ID NO: 3479)
3'-XXXXXXXXXXXXXXXXXXXXXXXXXXXXXUAGCUAUCGT-5'
"AS-M17, extended"

(SEQ ID NO: 3479)
3'-XXXXXXXXXXXXXXXXXXXXXXXXXXXXXUAGCUAUCGT-5'
"AS-M48, extended"
``` where "X"=RNA; "X"=2'-O-methyl RNA; "F"=2'-Fluoro NA and "A" in bold, italics indicates a 2'-Fluoro-adenine residue.

In certain embodiments, the sense strand of a DsiRNA of the invention is modified—specific exemplary forms of sense strand modifications are shown below, and it is contemplated that such modified sense strands can be substituted for the sense strand of any of the DsiRNAs shown above to generate a DsiRNA comprising a below-depicted sense strand that anneals with an above-depicted antisense strand. Exemplary sense strand modification patterns include:

```
5'-XXXXXXXXXXXXXXXXXXXXXXXXXDD-3'  "SM1"
5'-XXXXXXXXXXXXXXXXXXXXXXXXXDD-3'  "SM2"
5'-XXXXXXXXXXXXXXXXXXXXXXXXXDD-3'  "SM3"
5'-XXXXXXXXXXXXXXXXXXXXXXXXXDD-3'  "SM4"
5'-XXXXXXXXXXXXXXXXXXXXXXXXXDD-3'  "SM5"
5'-XXXXXXXXXXXXXXXXXXXXXXXXXDD-3'  "SM6"
5'-XXXXXXXXXXXXXXXXXXXXXXXXXDD-3'  "SM7"
5'-XXXXXXXXXXXXXXXXXXXXXXXXXDD-3'  "SM8"
5'-XXXXXXXXXXXXXXXXXXXXXXXXXDD-3'  "SM9"
5'-XXXXXXXXXXXXXXXXXXXXXXXXXDD-3'  "SM10"
5'-XXXXXXXXXXXXXXXXXXXXXXXXXDD-3'  "SM11"
5'-XXXXXXXXXXXXXXXXXXXXXXXXXDD-3'  "SM12"
5'-XXXXXXXXXXXXXXXXXXXXXXXXXDD-3'  "SM13"
5'-XXXXXXXXXXXXXXXXXXXXXXXXXDD-3'  "SM14"
5'-XXXXXXXXXXXXXXXXXXXXXXXXXDD-3'  "SM15"
5'-XXXXXXXXXXXXXXXXXXXXXXXXXDD-3'  "SM16"
5'-XXXXXXXXXXXXXXXXXXXXXXXXXDD-3'  "SM17"
5'-XXXXXXXXXXXXXXXXXXXXXXXXXDD-3'  "SM18"
5'-XXXXXXXXXXXXXXXXXXXXXXXXXDD-3'  "SM19"
5'-XXXXXXXXXXXXXXXXXXXXXXXXXDD-3'  "SM20"
5'-XXXXXXXXXXXXXXXXXXXXXXXXXDD-3'  "SM21"
5'-XXXXXXXXXXXXXXXXXXXXXXXXXDD-3'  "SM23"
5'-XXXXXXXXXXXXXXXXXXXXXXXXXDD-3'  "SM24"
5'-XXXXXXXXXXXXXXXXXXXXXXXXXDD-3'  "SM25"
5'-XXXXXXXXXXXXXXXXXXXXXXXXXDD-3'  "SM30"
5'-XXXXXXXXXXXXXXXXXXXXXXXXXDD-3'  "SM31"
```

-continued

5'-XXXXXXXXXXXXXXXXXXXXXXXXDD-3' "SM32"

5'-XXXXXXXXXXXXXXXXXXXXXXXXDD-3' "SM33"

5'-XXXXXXXXXXXXXXXXXXXXXXXXDD-3' "SM34"

5'-XXXXXXXXXXXXXXXXXXXXXXXXDD-3' "SM35"

5'-XXXXXXXXXXXXXXXXXXXXXXXXDD-3' "SM36"

5'-XXXXXXXXXXXXXXXXXXXXXXXXDD-3' "SM37"

5'-XXXXXXXXXXXXXXXXXXXXXXXXDD-3' "SM38"

5'-XXXXXXXXXXXXXXXXXXXXXXXXDD-3' "SM39"

5'-XXXXXXXXXXXXXXXXXXXXXXXXDD-3' "SM40"

5'-XXXXXXXXXXXXXXXXXXXXXXXXDD-3' "SM41"

5'-XXXXXXXXXXXXXXXXXXXXXXXXDD-3' "SM42"

5'-XXXXXXXXXXXXXXXXXXXXXXXXDD-3' "SM43"

5'-XXXXXXXXXXXXXXXXXXXXXXXXDD-3' "SM44"

5'-XXXXXXXXXXXXXXXXXXXXXXXXDD-3' "SM45", "SM47"

5'-XXXXXXXXXXXXXXXXXXXXXXXXDD-3' "SM46"

5'-XXXXXXXXXXXXXXXXXXXXXXXXDD-3' "SM48"

5'-XXXXXXXXXXXXXXXXXXXXXXXXDD-3' "SM49"

5'-XXXXXXXXXXXXXXXXXXXXXXXXDD-3' "SM50"

5'-XXXXXXXXXXXXXXXXXXXXXXXXDD-3' "SM51"

5'-XXXXXXXXXXXXXXXXXXXXXXXXDD-3' "SM52"

5'-XXXXXXXXXXXXXXXXXXXXXXXXDD-3' "SM53"

5'-XXXXXXXXXXXXXXXXXXXXXXXXDD-3' "SM54"

5'-XXXXXXXXXXXXXXXXXXXXXXXXDD-3' "SM55"

5'-XXXXXXXXXXXXXXXXXXXXXXXXDD-3' "SM56"

5'-XXXXXXXXXXXXXXXXXXXXXXXXDD-3' "SM57"

5'-XXXXXXXXXXXXXXXXXXXXXXXXDD-3' "SM58"

5'-XXXXXXXXXXXXXXXXXXXXXXXXDD-3' "SM59"

5'-XXXXXXXXXXXXXXXXXXXXXXXXDD-3' "SM60"

5'-XXXXXXXXXXXXXXXXXXXXXXXXDD-3' "SM61"

5'-XXXXXXXXXXXXXXXXXXXXXXXXDD-3' "SM62"

5'-XXXXXXXXXXXXXXXXXXXXXXXXDD-3' "SM63"

5'-XXXXXXXXXXXXXXXXXXXXXXXXDD-3' "SM64"

5'-XXXXXXXXXXXXXXXXXXXXXXXXDD-3' "SM65"

5'-XXXXXXXXXXXXXXXXXXXXXXXXpDpD-3' "SM66"

5'-XpXXXXXXXXXXXXXXXXXXXXXXXDD-3' "SM67"

5'-XpXXXXXXXXXXXXXXXXXXXXXXXpDpD-3' "SM68"

5'-DXXXXXXXXXXXXXXXXXXXXXXXXDD-3' "SM69"

5'-DpXXXXXXXXXXXXXXXXXXXXXXXpDpD-3' "SM70"

5'-DXDXXXXXXXXXXXXXXXXXXXXXXDD-3' "SM71"

5'-DpXDXXXXXXXXXXXXXXXXXXXXXXDD-3' "SM72"

5'-XXDXXXXXXXXXXDXXXXXXXXXXXDD-3' "SM73"

5'-XpXDXXXXXXXXXDXXXXXXXXXXXDD-3' "SM74"

5'-DXDXXXXXXXXXDXXXXXDXXXXDD-3' "SM75"

5'-DpXDXXXXXXXXXDXXXXXDXXXXDD-3' "SM76"

5'-XpXpXXXXXXXXXXXXXXXXXXXXXDD-3' "SM77"

5'-XpXpXXXXXXXXXXXXXXXXXXXXXpDpD-3' "SM78"

5'-DpXpDXXXXXXXXXXXXXXXXXXXXXDD-3' "SM79"

5'-XpXpDXXXXXXXXXDXXXXXXXXXXXDD-3' "SM80"

5'-DXDXXXDXXXXXDXXXXXDXXXXDD-3' "SM81"

5'-DpXDXXXDXXXXXDXXXXXDXXXXpDpD-3' "SM82"

5' C3 spacer-XXXXXXXXXXXXXXXXXXXXXXXDD-3' "SM83"

5' C3 spacer-XXDXXXXXXXXXDXXXXXXXXXXXDD-3' "SM84"

5' C3 spacer-XXXXXXXXXXXXXXXXXXXXXXXXpDpD-3' "SM85"

5'-XXXXXXXXXXXXXXXXXXXXXXXXpDpD-3' "SM86"

5'-XpXXXXXXXXXXXXXXXXXXXXXXXDD-3' "SM87"

5'-XpXXXXXXXXXXXXXXXXXXXXXXXpDpD-3' "SM88"

5'-DXXXXXXXXXXXXXXXXXXXXXXXXDD-3' "SM89"

5'-DpXXXXXXXXXXXXXXXXXXXXXXXpDpD-3' "SM90"

5'-DXDXXXXXXXXXXXXXXXXXXXXXXDD-3' "SM91"

5'-DpXDXXXXXXXXXXXXXXXXXXXXXXDD-3' "SM92"

5'-XXDXXXXXXXXXDXXXXXXXXXXXDD-3' "SM93"

5'-XpXDXXXXXXXXXDXXXXXXXXXXXDD-3' "SM94"

5'-DXDXXXXXXXXXDXXXXXDXXXXDD-3' "SM95"

5'-DpXDXXXXXXXXXDXXXXDXXXXDD-3' "SM96"

5'-XpXpXXXXXXXXXXXXXXXXXXXXXDD-3' "SM97"

5'-XpXpXXXXXXXXXXXXXXXXXXXXXpDpD-3' "SM98"

5'-DpXpDXXXXXXXXXXXXXXXXXXXXXDD-3' "SM99"

5'-XpXpDXXXXXXXXXDXXXXXXXXXXXDD-3' "SM100"

5'-DXDXXXXXXXXXDXDXXXDDXXDDD-3' "SM101"

5'-DpXDXXXXDXXXXDXXXXXDXXXXpDpD-3' "SM102"

5' C3 spacer-XXXXXXXXXXXXXXXXXXXXXXXDD-3' "SM103"

5' C3 spacer-XXDXXXXXXXXXDXXXXXXXXXXXDD-3' "SM104"

5' C3 spacer-XXXXXXXXXXXXXXXXXXXXXXXXpDpD-3' "SM105"

5'-XXXXXXXXXXXXXXXXXXXXXXXXDD-3' "SM106"

5'-XXXXXXXXXXXXXXXXXXXXXXXXDD-3' "SM107"

5'-XXXXXXXXXXXXXXXXXXXXXXXXDD-3' "SM108"

5'-XFXXXXXXXXXXXXXXXXFXXXXXDD-3' "SM110"

5'-XXXFXFXXXXXXXFXXXXXXXXXDD-3' "SM111"

5'-XFXFXFXFXXXXFXFXFXFXXXXXDD-3' "SM112"

5'-XpFXFXFXFXXXXFXFXFXFXXXXXpDpD-3' "SM113"

5'-XFXXXXXXXXXXXXXXXXXXXXXXDD-3' "SM114"

-continued

```
5'-XXXXFFXFXXXFXFXXXXXXXXDD-3'   "SM115"

5'-XFXFXXXXXXXXXXXFXXXXXXDD-3'   "SM116"

5'-XFXFFFXFXXXFXFXFFFXXXXDD-3'   "SM117"

5'-XFXFXFXFXXXFXFXFXFXXXXDD-3'   "SM118"

5'-XpFXFXFXFXXXFXFXFXFXXXXXpDpD-3'  "SM119"

5'-XXXXXXXXXXXXXXXXXXXXXXXXDD-3'   "SM250"

5'-XXXXXXXXXXXXXXXXXXXXXXXXDD-3'   "SM251"

5'-XXXXXXXXXXXXXXXXXXXXXXXXDD-3'   "SM252"

5'-XXXXXXXXXXXXXXXXXXXXXXXXXXXX-3'

5'-XXXXXXXXXXXXXXXXXXXXXXXXXXXX-3'

5'-XXXXXXXXXXXXXXXXXXXXXXXXXXXX-3'

5'-XXXXXXXXXXXXXXXXXXXXXXXXXXXX-3'

5'-XXXXXXXXXXXXXXXXXXXXXXXXXXXX-3'

5'-XXXXXXXXXXXXXXXXXXXXXXXXXXXX-3'

5'-XXXXXXXXXXXXXXXXXXXXXXXXXXXX-3'

5'-XXXXXXXXXXXXXXXXXXXXXXXXXXXX-3'

5'-XXXXXXXXXXXXXXXXXXXXXXXXXXXX-3'

5'-XXXXXXXXXXXXXXXXXXXXXXXXXXXX-3'

5'-XXXXXXXXXXXXXXXXXXXXXXXXXXXX-3'

5'-XXXXXXXXXXXXXXXXXXXXXXXXXXXX-3'

5'-XXXXXXXXXXXXXXXXXXXXXXXXXXXX-3'

5'-XXXXXXXXXXXXXXXXXXXXXXXXXXXX-3'

5'-XXXXXXXXXXXXXXXXXXXXXXXXXXXX-3'

5'-XXXXXXXXXXXXXXXXXXXXXXXXXXXX-3'

5'-XXXXXXXXXXXXXXXXXXXXXXXXXXXX-3'

5'-XXXXXXXXXXXXXXXXXXXXXXXXXXXX-3'

5'-XXXXXXXXXXXXXXXXXXXXXXXXXXXX-3'

5'-XXXXXXXXXXXXXXXXXXXXXXXXXXXX-3'

5'-XXXXXXXXXXXXXXXXXXXXXXXXXXXX-3'

5'-XXXXXXXXXXXXXXXXXXXXXXXXXXXX-3'

5'-XXXXXXXXXXXXXXXXXXXXXXXXXXXX-3'

5'-XXXXXXXXXXXXXXXXXXXXXXXXXXXX-3'

5'-XXXXXXXXXXXXXXXXXXXXXXXXXXXX-3'

5'-XXXXXXXXXXXXXXXXXXXXXXXXXXXX-3'

5'-XXXXXXXXXXXXXXXXXXXXXXXXXXXX-3'

5'-XXXXXXXXXXXXXXXXXXXXXXXXXXXX-3'
```

-continued

```
5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'   "SM22"

5'-XXXXXXXXXXXXXXXXXXXXXXXXXXX-3

5'-XXXXXXXXXXXXXXXXXXXXXXXXXXX-3'

5'-XXXXXXXXXXXXXXXXXXXXXXXXXXX-3'

5'-XpXXXXXXXXXXXXXXXXXXXXXXXXDpD-3'   "SM120"

5'-FpXFXFXFXFXFXFXFXFXFXXXDpD-3'   "SM121"

5'-XpXXXXXXXXXXXXXXXXXXXXXXXXDpD-3'   "SM122"

5'-XpXXXXXXXXXXXXXXXXXXXXXXXXDpD-3'   "SM123"

5'-FpXFXXXFXXXXXXXXXXXXXXXpDpD-3'   "SM124"

5'-FpXFXXXFXXXXXFXFXXXXXXXXpDpD-3'   "SM125"

5'-FpXFXXXFXFFFXFXFXXXXXXXXpDpD-3'   "SM126"

5'-FpXFXXXFXFFFXFXFXXXFFXXXpDpD-3'   "SM127"

5'-FpXFXXXFXFFFXFXFXXXFFXXFpDpD-3'   "SM128"

5'-FpXFXXXFXFFFXFXFXXXFFFFFpDpD-3'   "SM129"

5'-FpXFXFXFXFXFXFXFXFXFXFXFpDpD-3'   "SM130"

5'-XpXXXXXXXXXXXXXXXXXXXXXXXXpX-3'

5'-FpXFXFXFXFXFXFXFXFXFXFXXXpX-3'

5'-XpXXXXXXXXXXXXXXXXXXXXXXXXpX-3'

5'-XpXXXXXXXXXXXXXXXXXXXXXXXXpX-3'

5'-FpXFXXXFXXXXXXXXXXXXXXXXpXpX-3'

5'-FpXFXXXFXXXXXFXFXXXXXXXXpXpX-3'

5'-FpXFXXXFXFFFXFXFXXXXXXXXpXpX-3'

5'-FpXFXXXFXFFFXFXFXXXFFXXXpXpX-3'

5'-FpXFXXXFXFFFXFXFXXXFFXXFpXpX-3'

5'-FpXFXXXFXFFFXFXFXXXFFFFFpXpX-3'

5'-FpXFXFXFXFXFXFXFXFXFXFXFpXpX-3'

5'-XpXXXXXXXXXXXXXXXXXXXXXXXXXpDpD-3'   "SM133"
```

-continued
```
5'-XpXXXXXXXXXXXXXXXXXXXXXXXpDpD-3'  "SM134"

5'-XpXXXXXXXXXXXXXXXXXXXXXXXpDpD-3'  "SM135"

5'-XpXXXXXXXXXXXXXXXXXXXXXXXpDpD-3'  "SM136"

5'-XpXXXXXXXXXXXXXXXXXXXXXXXpDpD-3'  "SM137"

5'-XpXXXXXXXXXXXXXXXXXXXXXXXpDpD-3'  "SM138"

5'-XpXXXXXXXXXXXXXXXXXXXXXXXpXpX-3'

5'-XpXXXXXXXXXXXXXXXXXXXXXXXpXpX-3'

5'-XpXXXXXXXXXXXXXXXXXXXXXXXpXpX-3'

5'-XpXXXXXXXXXXXXXXXXXXXXXXXpXpX-3'

5'-XpXXXXXXXXXXXXXXXXXXXXXXXpXpX-3'

5'-XpXXXXXXXXXXXXXXXXXXXXXXXpXpX-3'

5'-XpXXXXXXXXXXXXXXXXXXXXXXXDpD-3'  "SM140"

5'-XpXXXXXXXXXXXXXXXXXXXXXXXDpD-3'  "SM141"

5'-XpXXXXXXXXXXXXXXXXXXXXXXXDpD-3'  "SM142"

5'-FpXFXFXFXFXFXFXFXFXXXXFDpD-3'  "SM143"

5'-FpXFXFXFXFXFXFXFXFFFFFDpD-3'  "SM144"

5'-FpXFXFXFXFXFXFXFXFXXXXDpD-3'  "SM145"

5'-FpXFXFXFXFXFXFXFXFXFXFDpD-3'  "SM146"

5'-FXFXXXFXFFFXFXFXXXXXXXXXDD-3'  "SM147"

5'-FXFXXXFXFFFXFXFXXXFFXXXDD-3'  "SM148"

5'-FXFXXXFXFFFXFXFXXXFFXXFDD-3'  "SM149"

5'-FXFXXXFXFFFXFXFXXXFFFFFDD-3'  "SM150"

5'-FpXFXFXFXFFFXFXFXFXFFXXXDpD-3'  "SM151"

5'-FpXFXFXXFFFFXXFXFXXXFXXXDpD-3'  "SM152"

5'-FpXFXXFFFFXXFXFXXFXXXDpD-3'  "SM153"

5'-ab-XXFXXFFFFXXFFXXXFFFFXpXXXDD-3'  "SM154"
(ab = abasic for F7 stabilization at 5' end)

5'-XpXXXXXXXXXXXXXXXXXXXXXXXXpX-3'  "SM155"

5'-XpXXXXXXXXXXXXXXXXXXXXXXXXpX-3'  "SM156"

5'-FpXFXXXFFFFFFXXXFXXFXXFXpX-3'  "SM157"

5'-XpXFXFXXFFFFXFXFXFXXFXXXXpX-3'  "SM158"

5'-FpXFXXXFXFFXFXXXFXXXFXXXXpX-3'  "SM159"

5'-FpXFXFXFFFFXFXFXFXFXXXXX-3'  "SM160"

5'-XpXXXXXXXXXXXXXXXXXXXXXXXpX-3'

5'-XpXXXXXXXXXXXXXXXXXXXXXXXpX-3'

5'-XpXXXXXXXXXXXXXXXXXXXXXXXpX-3'

5'-FpXFXFXFXFXFXFXFXFXFXXXFXpX-3'

5'-FpXFXFXFXFXFXFXFXFFFFFXpX-3'

5'-FpXFXFXFXFXFXFXFXFXXXXXpX-3'

5'-FpXFXFXFXFXFXFXFXFXFXFXpX-3'

5'-FXFXXXFXFFFXFXFXXXXXXXXXX-3'
```

-continued
```
5'-FXFXXXFXFFFXFXFXXXFFXXXXX-3'

5'-FXFXXXFXFFFXFXFXXXFFXXFXX-3'

5'-FXFXXXFXFFFXFXFXXXFFFFFXX-3'

138
5'-FpXFXFXFXFFFXFXFXFXFFXXFXpX-3'

5'-FpXFXFXFXFFFXFXXXFXFXXXXXpX-3'

5'-FpXFXFXXFFFFXXFXFXXFXXXXpX-3'

5'-ab-XFXXFFFXXFFXXFFFFFXpXXXXX-3'
(ab = abasic for F7 stabilization at 5' end)

5'-XpXXXXXXXXXXXXXXXXXXXXXXXpX-3'

5'-XpXXXXXXXXXXXXXXXXXXXXXXXpX-3'

5'-FpXFXXXFFFFFFFXXXFXXFXXFXpX-3'

5'-XpXFXFXXFFFFXFXFXFXXFXXXXpX-3'

5'-FpXFXXXFXFFXFXXXFXXXFXXXXpX-3'

5'-FpXFXFXFXFFFXFXFXFXXXXXX-3'

5'-XXXXXXXXXXXXXXXXXXXXXXXDD-3'  "SM253"

5'-XXXXXXXXXXXXXXXXXXXXXXXDD-3'  "SM255"

5'-XXXXXXXXXXXXXXXXXXXXXXXDD-3'  "SM256"

5'-XXXXXXXXXXXXXXXXXXXXXXXDD-3'  "SM257"

5'-XXXXXXXXXXXXXXXXXXXXXXXDD-3'  "SM258"

5'-XXXXXXXXXXXXXXXXXXXXXXXDD-3'  "SM259"

5'-XXXXXXXXXXXXXXXXXXXXXXXDD-3'  "SM260"

5'-XXXXXXXXXXXXXXXXXXXXXXXDD-3'  "SM261"

5'-XXXXXXXXXXXXXXXXXXXXXXXDD-3'  "SM262"

5'-XXXXXXXXXXXXXXXXXXXXXXXDD-3'  "SM263"

5'-XXXXXXXXXXXXXXXXXXXXXXXDD-3'  "SM264"

5'-XXXXXXXXXXXXXXXXXXXXXXXDD-3'  "SM265"

5'-XXXXXXXXXXXXXXXXXXXXXXXDD-3'  "SM266"

5'-XXXXXXXXXXXXXXXXXXXXXXXDD-3'  "SM267"

5'-XXXXXXXXXXXXXXXXXXXXXXXDD-3'  "SM268"

5'-XXXXXXXXXXXXXXXXXXXXXXXDD-3'  "SM269"

5'-XXXXXXXXXXXXXXXXXXXXXXXDD-3'  "SM270"

5'-XXXXXXXXXXXXXXXXXXXXXXXDD-3'  "SM271"

5'-XXXXXXXXXXXXXXXXXXXXXXXDD-3'  "SM275"

5'-XXXXXXXXXXXXXXXXXXXXXXXDD-3'  "SM276"

5'-XXXXXXXXXXXXXXXXXXXXXXXDD-3'  "SM277"

5'-XXXXXXXXXXXXXXXXXXXXXXXDD-3'  "SM278"

5'-XXXXXXXXXXXXXXXXXXXXXXXDD-3'  "SM279"

5'-XXXXXXXXXXXXXXXXXXXXXXXDD-3'  "SM280"

5'-XXXXXXXXXXXXXXXXXXXXXXXDD-3'  "SM281"

5'-XXXXXXXXXXXXXXXXXXXXXXXDD-3'  "SM282"

5'-XXXXXXXXXXXXXXXXXXXXXXXDD-3'  "SM283"
```

-continued

```
5'-XXXXXXXXXXXXXXXXXXXXXXXXXDD-3'  "SM284"
5'-XXXXXXXXXXXXXXXXXXXXXXXXXDD-3'  "SM285"
5'-XXXXXXXXXXXXXXXXXXXXXXXXXDD-3'  "SM286"
5'-XXXXXXXXXXXXXXXXXXXXXXXXXDD-3'  "SM287"
5'-XXXXXXXXXXXXXXXXXXXXXXXXXDD-3'  "SM288"
5'-XXXXXXXXXXXXXXXXXXXXXXXXXDD-3'  "SM289"
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXDD-3'  "SM300"

5'-XpXXXXXXXXXXXXXXXXXXXXXXXDpD-3'  "SM301"
5'-XpXXXXXXXXXXXXXXXXXXXXXXXDpD-3'  "SM302"
5'-XpXXXXXXXXXXXXXXXXXXXXXXXDpD-3'  "SM303"
5'-XpXXXXXXXXXXXXXXXXXXXXXXXDpD-3'  "SM304"
5'-XpXXXXXXXXXXXXXXXXXXXXXXXDpD-3'  "SM305"
5'-XpXXXXXXXXXXXXXXXXXXXXXXXDpD-3'  "SM306"
5'-XpXXXXXXXXXXXXXXXXXXXXXXXDpD-3'  "SM307"
5'-XpXXXXXXXXXXXXXXXXXXXXXXXDpD-3'  "SM308"
5'-XpXXXXXXXXXXXXXXXXXXXXXXXDpD-3'  "SM309"
5'-XpXXXXXXXXXXXXXXXXXXXXXXXDpD-3'  "SM310"
5'-XXXXXXXXXXXXXXXXXXXXXXXXXXX-3'
5'-XpXXXXXXXXXXXXXXXXXXXXXXXpX-3'
5'-XpXXXXXXXXXXXXXXXXXXXXXXXpX-3'
5'-XpXXXXXXXXXXXXXXXXXXXXXXXpX-3'
5'-XpXXXXXXXXXXXXXXXXXXXXXXXpX-3'
5'-XpXXXXXXXXXXXXXXXXXXXXXXXpX-3'
5'-XpXXXXXXXXXXXXXXXXXXXXXXXpX-3'
5'-XpXXXXXXXXXXXXXXXXXXXXXXXpX-3'
5'-XpXXXXXXXXXXXXXXXXXXXXXXXpX-3'
5'-XpXXXXXXXXXXXXXXXXXXXXXXXpX-3'
5'-XpXXXXXXXXXXXXXXXXXXXXXXXpX-3'
``` where "X"=RNA, "$\underline{X}$"=2'-O-methyl RNA, "D"=DNA, "F"=2'-Fluoro NA and "p"=Phosphorothioate linkage.

It is contemplated that in certain embodiments of the invention, for all 2'-O-methyl modification patterns disclosed herein, any or all sites of 2'-O-methyl modification can optionally be replaced by a 2'-Fluoro modification. The above modification patterns can also be incorporated into, e.g., the extended DsiRNA structures and mismatch and/or frayed DsiRNA structures described below.

In another embodiment, the DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary 27mer DsiRNA agent with two terminal mismatched residues is shown:

$$5'\text{-XXXXXXXXXXXXXXXXXXXXXXXXX}X^{M}M\text{-}3'$$
$$3'\text{-XXXXXXXXXXXXXXXXXXXXXXXXX}X_{M}M\text{-}5'$$

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand is the sense strand, and the bottom strand is the antisense strand. Alternatively, the bottom strand is the sense strand and the top strand is the antisense strand.

In certain additional embodiments, the present invention provides compositions for RNA interference (RNAi) that possess one or more base paired deoxyribonucleotides within a region of a double stranded ribonucleic acid (dsRNA) that is positioned 3' of a projected sense strand Dicer cleavage site and correspondingly 5' of a projected antisense strand Dicer cleavage site. The compositions of the invention comprise a dsRNA which is a precursor molecule, i.e., the dsRNA of the present invention is processed in vivo to produce an active small interfering nucleic acid (siRNA). The dsRNA is processed by Dicer to an active siRNA which is incorporated into RISC.

In certain embodiments, the DsiRNA agents of the invention can have the following exemplary structures (noting that any of the following exemplary structures can be combined, e.g., with the bottom strand modification patterns of the above-described structures—in one specific example, the bottom strand modification pattern shown in any of the above structures is applied to the 27 most 3' residues of the bottom strand of any of the following structures; in another specific example, the bottom strand modification pattern shown in any of the above structures upon the 23 most 3' residues of the bottom strand is applied to the 23 most 3' residues of the bottom strand of any of the following structures):

In one such embodiment, the DsiRNA comprises the following (an exemplary "right-extended", "DNA extended" DsiRNA):

$$5\text{'}-\text{XXXXXXXXXXXXXXXXXXXXXXXXX}_N*D_N DD-3\text{'}$$
$$3\text{'}-\text{YXXXXXXXXXXXXXXXXXXXXXXXXX}_N*D_N XX-5\text{'}$$

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

$$5\text{'}-\text{XXXXXXXXXXXXXXXXXXXXXXXXX}_N*D_N DD-3\text{'}$$
$$3\text{'}-\text{YXXXXXXXXXXXXXXXXXXXXXXXXX}_N*D_N DD-5\text{'}$$

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

$$5\text{'}-\text{XXXXXXXXXXXXXXXXXXXXXXXXX}_N*D_N DD-3\text{'}$$
$$3\text{'}-\text{Y}\underline{\text{XXXXXXXXXXXXXXXXX}}\text{XXXXXXXXX}_N*D_N ZZ-5\text{'}$$

wherein "X"=RNA, "$\underline{X}$"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

$$5\text{'}-\text{XXXXXXXXXXXXXXXXXXXXXXXXX}_N*D_N DD-3\text{'}$$
$$3\text{'}-\text{Y}\underline{\text{XXXXXXXXXXXXXXXXX}}\text{XXXXXXXXX}_N*D_N ZZ-5\text{'}$$

wherein "X"=RNA, "$\underline{X}$"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

$$5\text{'}-\text{XXXXXXXXXXXXXXXXXXXXXXXXX}_N*D_N DD-3\text{'}$$
$$3\text{'}-\text{Y}\underline{\text{XXXXXXXXXXXXXXXXX}}\text{XXXXXXXXX}_N*D_N ZZ-5\text{'}$$

wherein "X"=RNA, "$\underline{X}$"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

$$5\text{'}-\text{XXXXXXXXXXXXXXXXXXXXXXXX}_{N*}\ [\text{X1/D1}]_N DD-3\text{'}$$
$$3\text{'}-\text{YXXXXXXXXXXXXXXXXXXXXXXXX}_{N*}\ [\text{X2/D2}]_N ZZ-5\text{'}$$

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In the structures depicted herein, the 5' end of either the sense strand or antisense strand can optionally comprise a phosphate group.

In another embodiment, a DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

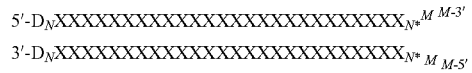

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-15 or, optionally, 1-8. "N*"=0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA:DNA extension patterns paralleling those shown above for asymmetric/overhang agents can also be incorporated into such "blunt/frayed" agents.

In one embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. An exemplary structure for such a molecule is shown:

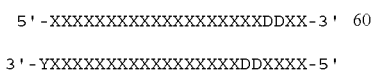

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand. The above structure is modeled to force Dicer to cleave a minimum of a 21mer duplex as its primary post-processing form. In embodiments where the bottom strand of the above structure is the antisense strand, the positioning of two deoxyribonucleotide residues at the ultimate and penultimate residues of the 5' end of the antisense strand will help reduce off-target effects (as prior studies have shown a 2'-O-methyl modification of at least the penultimate position from the 5' terminus of the antisense strand to reduce off-target effects; see, e.g., US 2007/0223427).

In one embodiment, the DsiRNA comprises the following (an exemplary "left-extended", "DNA extended" DsiRNA):

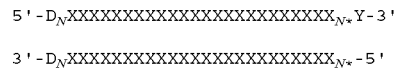

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

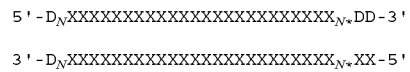

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

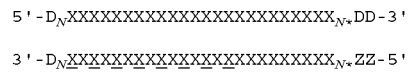

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

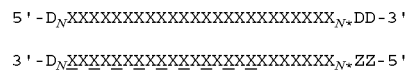

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

wherein "X"=RNA, "$\underline{X}$"=2'-O-methyl RNA, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

wherein "X"=RNA, "$\underline{X}$"=2'-O-methyl RNA, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

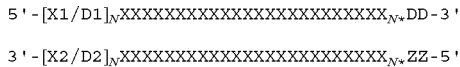

wherein "X"=RNA, "D"=DNA, "Z"=DNA or RNA, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In a related embodiment, the DsiRNA comprises:

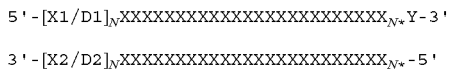

wherein "X"=RNA, "D"=DNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

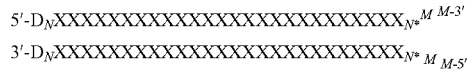

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-8 or 1-10. "N*"=0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA:DNA extension patterns paralleling those shown above for asymmetric/overhang agents can also be incorporated into such "blunt/frayed" agents.

In another embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. Exemplary structures for such a molecule are shown:

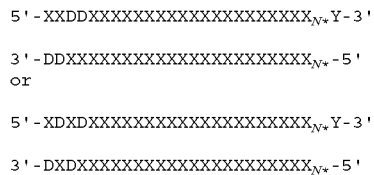

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In any of the above embodiments where the bottom strand of the above structure is the antisense strand, the positioning of two deoxyribonucleotide residues at the ultimate and penultimate residues of the 5' end of the antisense strand will help reduce off-target effects (as prior studies have shown a 2'-O-methyl modification of at least the penultimate position from the 5' terminus of the antisense strand to reduce off-target effects; see, e.g., US 2007/0223427).

In certain embodiments, the "D" residues of the above structures include at least one PS-DNA or PS-RNA. Optionally, the "D" residues of the above structures include at least one modified nucleotide that inhibits Dicer cleavage.

While the above-described "DNA-extended" DsiRNA agents can be categorized as either "left extended" or "right extended", DsiRNA agents comprising both left- and right-extended DNA-containing sequences within a single agent (e.g., both flanks surrounding a core dsRNA structure are dsDNA extensions) can also be generated and used in similar manner to those described herein for "right-extended" and "left-extended" agents.

In some embodiments, the DsiRNA of the instant invention further comprises a linking moiety or domain that joins the sense and antisense strands of a DNA:DNA-extended DsiRNA agent. Optionally, such a linking moiety domain joins the 3' end of the sense strand and the 5' end of the antisense strand. The linking moiety may be a chemical (non-nucleotide) linker, such as an oligomethylenediol linker, oligoethylene glycol linker, or other art-recognized linker moiety. Alternatively, the linker can be a nucleotide linker, optionally including an extended loop and/or tetraloop.

In one embodiment, the DsiRNA agent has an asymmetric structure, with the sense strand having a 25-base pair length, and the antisense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxynucleotides at the 3' end of the sense strand.

In another embodiment, the DsiRNA agent has an asymmetric structure, with the antisense strand having a 25-base pair length, and the sense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxyribonucleotides at the 3' end of the antisense strand.

Exemplary C5 targeting DsiRNA agents of the invention, and their associated C5 target sequences, include the following, presented in the below series of tables:
Table Number:
(2) Selected Human Anti-C5 DsiRNA Agents (Asymmetrics);
(3) Selected Human Anti-C5 DsiRNAs, Unmodified Duplexes (Asymmetrics);
(4) DsiRNA Target Sequences (21mers) in C5 mRNA;
(5) Selected Human Anti-C5 "Blunt/Blunt" DsiRNAs; and
(6) DsiRNA Component 19 Nucleotide Target Sequences in C5 mRNA (7) Human Anti-C5 DsiRNAs Predicted to have >50% Knockdown Efficacy (Asymmetrics);
(8) DsiRNA Target Sequences (21mers) of Human Anti-C5 DsiRNAs Predicted to have >50% Knockdown Efficacy;
(9) "Blunt/Blunt" DsiRNAs Corresponding to Human Anti-C5 DsiRNAs Predicted to have >50% Knockdown Efficacy; and
(10) DsiRNA Component 19 Nucleotide Target Sequences of Human Anti-C5 DsiRNAs Predicted to have >50% Knockdown Efficacy

TABLE 2

Selected Human Anti-C5 DsiRNA Agents (Asymmetrics)

5'-AUAUGUCAUUUCAGCACCAAAAAta-3' (SEQ ID NO: 1)

3'-UGUAUACAGUAAAGUCGUGGUUUUUAU-5' (SEQ ID NO: 385)

C5-120 Target:
5'-ACATATGTCATTTCAGCACCAAAAATA-3' (SEQ ID NO: 769)

5'-AUUGUGAUUCAAGUUUAUGGAUACa-3' (SEQ ID NO: 2)

3'-UAUAACACUAAGUUCAAAUACCUAUGU-5' (SEQ ID NO: 386)

C5-169 Target:
5'-ATATTGTGATTCAAGTTTATGGATACA-3' (SEQ ID NO: 770)

5'-UUGUGAUUCAAGUUUAUGGAUACac-3' (SEQ ID NO: 3)

3'-AUAACACUAAGUUCAAAUACCUAUGUG-5' (SEQ ID NO: 387)

C5-170 Target:
5'-TATTGTGATTCAAGTTTATGGATACAC-3' (SEQ ID NO: 771)

5'-UGUGAUUCAAGUUUAUGGAUACAct-3' (SEQ ID NO: 4)

3'-UAACACUAAGUUCAAAUACCUAUGUGA-5' (SEQ ID NO: 388)

C5-171 Target:
5'-ATTGTGATTCAAGTTTATGGATACACT-3' (SEQ ID NO: 772)

5'-GUGAUUCAAGUUUAUGGAUACACtg-3' (SEQ ID NO: 5)

3'-AACACUAAGUUCAAAUACCUAUGUGAC-5' (SEQ ID NO: 389)

C5-172 Target:
5'-TTGTGATTCAAGTTTATGGATACACTG-3' (SEQ ID NO: 773)

5'-UGAUUCAAGUUUAUGGAUACACUga-3' (SEQ ID NO: 6)

3'-ACACUAAGUUCAAAUACCUAUGUGACU-5' (SEQ ID NO: 390)

C5-173 Target:
5'-TGTGATTCAAGTTTATGGATACACTGA-3' (SEQ ID NO: 774)

5'-GAUUCAAGUUUAUGGAUACACUGaa-3' (SEQ ID NO: 7)

3'-CACUAAGUUCAAAUACCUAUGUGACUU-5' (SEQ ID NO: 391)

C5-174 Target:
5'-GTGATTCAAGTTTATGGATACACTGAA-3' (SEQ ID NO: 775)

5'-AUUCAAGUUUAUGGAUACACUGAag-3' (SEQ ID NO: 8)

3'-ACUAAGUUCAAAUACCUAUGUGACUUC-5' (SEQ ID NO: 392)

C5-175 Target:
5'-TGATTCAAGTTTATGGATACACTGAAG-3' (SEQ ID NO: 776)

5'-UUCAAGUUUAUGGAUACACUGAAgc-3' (SEQ ID NO: 9)

3'-CUAAGUUCAAAUACCUAUGUGACUUCG-5' (SEQ ID NO: 393)

TABLE 2-continued

Selected Human Anti-O5 DsiRNA Agents (Asymmetrics)

C5-176 Target:
5'-GATTCAAGTTTATGGATACACTGAAGC-3' (SEQ ID NO: 777)

5'-UCAAGUUUAUGGAUACACUGAAGca-3' (SEQ ID NO: 10)

3'-UAAGUUCAAAUACCUAUGUGACUUCGU-5' (SEQ ID NO: 394)

C5-177 Target:
5'-ATTCAAGTTTATGGATACACTGAAGCA-3' (SEQ ID NO: 778)

5'-CAAGUUUAUGGAUACACUGAAGCat-3' (SEQ ID NO: 11)

3'-AAGUUCAAAUACCUAUGUGACUUCGUA-5' (SEQ ID NO: 395)

C5-178 Target:
5'-TTCAAGTTTATGGATACACTGAAGCAT-3' (SEQ ID NO: 779)

5'-AAGUUUAUGGAUACACUGAAGCAtt-3' (SEQ ID NO: 12)

3'-AGUUCAAAUACCUAUGUGACUUCGUAA-5' (SEQ ID NO: 396)

C5-179 Target:
5'-TCAAGTTTATGGATACACTGAAGCATT-3' (SEQ ID NO: 780)

5'-AGUUUAUGGAUACACUGAAGCAUtt-3' (SEQ ID NO: 13)

3'-GUUCAAAUACCUAUGUGACUUCGUAAA-5' (SEQ ID NO: 397)

C5-180 Target:
5'-CAAGTTTATGGATACACTGAAGCATTT-3' (SEQ ID NO: 781)

5'-UUUAUGGAUACACUGAAGCAUUUga-3' (SEQ ID NO: 14)

3'-UCAAAUACCUAUGUGACUUCGUAAACU-5' (SEQ ID NO: 398)

C5-182 Target:
5'-AGTTTATGGATACACTGAAGCATTTGA-3' (SEQ ID NO: 782)

5'-UUUAUGGAUACACUGAAGCAUUUGat-3' (SEQ ID NO: 15)

3'-CAAAUACCUAUGUGACUUCGUAAACUA-5' (SEQ ID NO: 399)

C5-183 Target:
5'-GTTTATGGATACACTGAAGCATTTGAT-3' (SEQ ID NO: 783)

5'-AUGGAUACACUGAAGCAUUUGAUgc-3' (SEQ ID NO: 16)

3'-AAUACCUAUGUGACUUCGUAAACUACG-5' (SEQ ID NO: 400)

C5-185 Target:
5'-TTATGGATACACTGAAGCATTTGATGC-3' (SEQ ID NO: 784)

5'-GGAUACACUGAAGCAUUUGAUGCaa-3' (SEQ ID NO: 17)

3'-UACCUAUGUGACUUCGUAAACUACGUU-5' (SEQ ID NO: 401)

C5-187 Target:
5'-ATGGATACACTGAAGCATTTGATGCAA-3' (SEQ ID NO: 785)

5'-GAUACACUGAAGCAUUUGAUGCAac-3' (SEQ ID NO: 18)

3'-ACCUAUGUGACUUCGUAAACUACGUUG-5' (SEQ ID NO: 402)

C5-188 Target:
5'-TGGATACACTGAAGCATTTGATGCAAC-3' (SEQ ID NO: 786)

5'-AUACACUGAAGCAUUUGAUGCAAca-3' (SEQ ID NO: 19)

3'-CCUAUGUGACUUCGUAAACUACGUUGU-5' (SEQ ID NO: 403)

C5-189 Target:
5'-GGATACACTGAAGCATTTGATGCAACA-3' (SEQ ID NO: 787)

5'-UACACUGAAGCAUUUGAUGCAACaa-3' (SEQ ID NO: 20)

3'-CUAUGUGACUUCGUAAACUACGUUGUU-5' (SEQ ID NO: 404)

TABLE 2-continued

Selected Human Anti-O5 DsiRNA Agents (Asymmetrics)

C5-190 Target:
5'-GATACACTGAAGCATTTGATGCAACAA-3' (SEQ ID NO: 788)

5'-ACACUGAAGCAUUUGAUGCAACAat-3' (SEQ ID NO: 21)

3'-UAUGUGACUUCGUAAACUACGUUGUUA-5' (SEQ ID NO: 405)

C5-191 Target:
5'-ATACACTGAAGCATTTGATGCAACAAT-3' (SEQ ID NO: 789)

5'-CACUGAAGCAUUUGAUGCAACAAtc-3' (SEQ ID NO: 22)

3'-AUGUGACUUCGUAAACUACGUUGUUAG-5' (SEQ ID NO: 406)

C5-192 Target:
5'-TACACTGAAGCATTTGATGCAACAATC-3' (SEQ ID NO: 790)

5'-ACUGAAGCAUUUGAUGCAACAAUct-3' (SEQ ID NO: 23)

3'-UGUGACUUCGUAAACUACGUUGUUAGA-5' (SEQ ID NO: 407)

C5-193 Target:
5'-ACACTGAAGCATTTGATGCAACAATCT-3' (SEQ ID NO: 791)

5'-CUGAAGCAUUUGAUGCAACAAUCtc-3' (SEQ ID NO: 24)

3'-GUGACUUCGUAAACUACGUUGUUAGAG-5' (SEQ ID NO: 408)

C5-194 Target:
5'-CACTGAAGCATTTGATGCAACAATCTC-3' (SEQ ID NO: 792)

5'-GAAGCAUUUGAUGCAACAAUCUCta-3' (SEQ ID NO: 25)

3'-GACUUCGUAAACUACGUUGUUAGAGAU-5' (SEQ ID NO: 409)

C5-196 Target:
5'-CTGAAGCATTTGATGCAACAATCTCTA-3' (SEQ ID NO: 793)

5'-AGCAUUUGAUGCAACAAUCUCUAtt-3' (SEQ ID NO: 26)

3'-CUUCGUAAACUACGUUGUUAGAGAUAA-5' (SEQ ID NO: 410)

C5-198 Target:
5'-GAAGCATTTGATGCAACAATCTCTATT-3' (SEQ ID NO: 794)

5'-CAUUUGAUGCAACAAUCUCUAUUaa-3' (SEQ ID NO: 27)

3'-UCGUAAACUACGUUGUUAGAGAUAAUU-5' (SEQ ID NO: 411)

C5-200 Target:
5'-AGCATTTGATGCAACAATCTCTATTAA-3' (SEQ ID NO: 795)

5'-UGAUGCAACAAUCUCUAUUAAAgt-3' (SEQ ID NO: 28)

3'-AAACUACGUUGUUAGAGAUAAUUUCA-5' (SEQ ID NO: 412)

C5-204 Target:
5'-TTTGATGCAACAATCTCTATTAAAAGT-3' (SEQ ID NO: 796)

5'-GAUGCAACAAUCUCUAUUAAAAGtt-3' (SEQ ID NO: 29)

3'-AACUACGUUGUUAGAGAUAAUUUCAA-5' (SEQ ID NO: 413)

C5-205 Target:
5'-TTGATGCAACAATCTCTATTAAAAGTT-3' (SEQ ID NO: 797)

5'-AUGCAACAAUCUCUAUUAAAAGUta-3' (SEQ ID NO: 30)

3'-ACUACGUUGUUAGAGAUAAUUUCAAU-5' (SEQ ID NO: 414)

C5-206 Target:
5'-TGATGCAACAATCTCTATTAAAAGTTA-3' (SEQ ID NO: 798)

5'-UGCAACAAUCUCUAUUAAAAGUUat-3' (SEQ ID NO: 31)

3'-CUACGUUGUUAGAGAUAAUUUCAAUA-5' (SEQ ID NO: 415)

TABLE 2-continued

Selected Human Anti-O5 DsiRNA Agents (Asymmetrics)

C5-207 Target:
5'-GATGCAACAATCTCTATTAAAAGTTAT-3' (SEQ ID NO: 799)

5'-A<u>CAA</u>UCUCUAUUA<u>AAA</u>GUUAUCCtg-3' (SEQ ID NO: 32)

3'-<u>GUUG</u>UUAGAGAUAA<u>UUU</u>UCAAUA<u>GGAC</u>-5' (SEQ ID NO: 416)

C5-211 Target:
5'-CAACAATCTCTATTAAAAGTTATCCTG-3' (SEQ ID NO: 800)

5'-C<u>AA</u>UCUCUAUUA<u>AAG</u>UUAUCC<u>U</u>ga-3' (SEQ ID NO: 33)

3'-<u>UUG</u>UUAGAGAUAA<u>UUU</u>UCAAUAG<u>GACU</u>-5' (SEQ ID NO: 417)

C5-212 Target:
5'-AACAATCTCTATTAAAAGTTATCCTGA-3' (SEQ ID NO: 801)

5'-C<u>U</u>AUUA<u>AAA</u>GUUAU<u>CC</u>UGAUAAAaa-3' (SEQ ID NO: 34)

3'-<u>GAG</u>AUAAUUUUCAAU<u>AG</u>GAC<u>U</u>AUUUUU-5' (SEQ ID NO: 418)

C5-218 Target:
5'-CTCTATTAAAAGTTATCCTGATAAAAA-3' (SEQ ID NO: 802)

5'-A<u>U</u>UA<u>AAA</u>GUUAUCC<u>U</u>GAUAAAAAat-3' (SEQ ID NO: 35)

3'-<u>GAU</u>A<u>A</u>UUUUCAAUAG<u>GA</u>CUAUUUU<u>UUA</u>-5' (SEQ ID NO: 419)

C5-220 Target:
5'-CTATTAAAAGTTATCCTGATAAAAAAT-3' (SEQ ID NO: 803)

5'-A<u>AAA</u>GUUAUCCUG<u>A</u>UAAAAAAUta-3' (SEQ ID NO: 36)

3'-<u>AAU</u>UUCAAUAGGAC<u>U</u>AUUUUUU<u>AAAU</u>-5' (SEQ ID NO: 420)

C5-223 Target:
5'-TTAAAAGTTATCCTGATAAAAAATTTA-3' (SEQ ID NO: 804)

5'-A<u>AA</u>GUUAUCCUGA<u>U</u>AAAAAAUUag-3' (SEQ ID NO: 37)

3'-<u>AUU</u>UUCAAUAGGACU<u>A</u>UUUUUUAAAUC-5' (SEQ ID NO: 421)

C5-224 Target:
5'-TAAAAGTTATCCTGATAAAAAATTTAG-3' (SEQ ID NO: 805)

5'-G<u>UU</u>A<u>U</u>CCUGAUAA<u>AAA</u>AUUUAGUta-3' (SEQ ID NO: 38)

3'-<u>UUC</u>A<u>A</u>UAGGACUAUUUUUUAAAUC<u>AAU</u>-5' (SEQ ID NO: 422)

C5-227 Target:
5'-AAGTTATCCTGATAAAAAATTTAGTTA-3' (SEQ ID NO: 806)

5'-<u>UU</u>A<u>U</u>CCUGAUAAA<u>AAA</u>UUUAGUUac-3' (SEQ ID NO: 39)

3'-<u>UCA</u>AUAGGACUAUUUUUUAAAUC<u>AAUG</u>-5' (SEQ ID NO: 423)

C5-228 Target:
5'-AGTTATCCTGATAAAAAATTTAGTTAC-3' (SEQ ID NO: 807)

5'-<u>GUU</u>C<u>A</u>UUUAUCCU<u>C</u>AGAGAAUAAat-3' (SEQ ID NO: 40)

3'-<u>UAC</u>A<u>A</u>GUAAAUAGG<u>AG</u>UCUCUUAUUUA-5' (SEQ ID NO: 424)

C5-265 Target:
5'-ATGTTCATTTATCCTCAGAGAATAAAT-3' (SEQ ID NO: 808)

5'-<u>UUC</u>A<u>U</u>UUAUCCUC<u>AG</u>AGAAUAAAtt-3' (SEQ ID NO: 41)

3'-<u>ACA</u>AGUAAAUAGG<u>AG</u>UC<u>U</u>CUUAU<u>UUAA</u>-5' (SEQ ID NO: 425)

C5-266 Target:
5'-TGTTCATTTATCCTCAGAGAATAAATT-3' (SEQ ID NO: 809)

5'-<u>GUAU</u>UUGGAAGUUG<u>U</u>AUCAAAGcat-3' (SEQ ID NO: 42)

3'-<u>CAC</u>AUAAACCUUCA<u>AC</u>AUAGUUU<u>CGUA</u>-5' (SEQ ID NO: 426)

C5-360 Target:
5'-GTGTATTTGGAAGTTGTATCAAAGCAT-3' (SEQ ID NO: 810)

5'-<u>U</u>A<u>UU</u>UGGAAGUUG<u>U</u>A<u>U</u>CAAAGCAtt-3' (SEQ ID NO: 43)

3'-<u>ACA</u>UAAACCUUCA<u>AC</u>AUAGUUUC<u>GUAA</u>-5' (SEQ ID NO: 427)

C5-361 Target:
5'-TGTATTTGGAAGTTGTATCAAAGCATT-3' (SEQ ID NO: 811)

5'-<u>U</u>UGGAAGUUGUAUC<u>A</u>AAGCAUUUtt-3' (SEQ ID NO: 44)

3'-<u>UAA</u>CCUUCAACAUA<u>G</u>UUUCGUA<u>AAAA</u>-5' (SEQ ID NO: 428)

C5-364 Target:
5'-ATTTGGAAGTTGTATCAAAGCATTTTT-3' (SEQ ID NO: 812)

5'-<u>U</u>GGAAGUUGUAUC<u>A</u>AAGCAUUUUtc-3' (SEQ ID NO: 45)

3'-<u>AAA</u>CCUUCAACAUAGUUUCGUA<u>AAAG</u>-5' (SEQ ID NO: 429)

C5-365 Target:
5'-TTTGGAAGTTGTATCAAAGCATTTTTC-3' (SEQ ID NO: 813)

5'-<u>G</u>G<u>A</u>AGUUGUAUCA<u>AA</u>GCAUUUUUca-3' (SEQ ID NO: 46)

3'-<u>AAC</u>CUUCAACAUAGUUUCGUA<u>AAAAGU</u>-5' (SEQ ID NO: 430)

C5-366 Target:
5'-TTGGAAGTTGTATCAAAGCATTTTTCA-3' (SEQ ID NO: 814)

5'-G<u>AA</u>GUUGUAUCAA<u>AGC</u>AUUUUUCaa-3' (SEQ ID NO: 47)

3'-<u>ACC</u>UUCAACAUAGUU<u>UC</u>GUAAAAA<u>GUU</u>-5' (SEQ ID NO: 431)

C5-367 Target:
5'-TGGAAGTTGTATCAAAGCATTTTTCAA-3' (SEQ ID NO: 815)

5'-A<u>AG</u>UUGUAUCAAA<u>GC</u>A<u>U</u>UUUUCAaa-3' (SEQ ID NO: 48)

3'-<u>CCU</u>UCAACAUAGUUUC<u>G</u>UAAAAAG<u>UUU</u>-5' (SEQ ID NO: 432)

C5-368 Target:
5'-GGAAGTTGTATCAAAGCATTTTTCAAA-3' (SEQ ID NO: 816)

5'-A<u>GU</u>UGUAUCAAAG<u>CA</u>UUUUUCAAaa-3' (SEQ ID NO: 49)

3'-<u>CUU</u>C<u>A</u>ACAUAGUUU<u>C</u>GUAAAAAGUUUU-5' (SEQ ID NO: 433)

C5-369 Target:
5'-GAAGTTGTATCAAAGCATTTTTCAAAA-3' (SEQ ID NO: 817)

5'-G<u>UU</u>G<u>U</u>AUCAAAGCA<u>U</u>UUUUCAAAat-3' (SEQ ID NO: 50)

3'-<u>UUC</u>AACAUAGUUUC<u>G</u>UA<u>A</u>AAAGUUU<u>A</u>-5' (SEQ ID NO: 434)

C5-370 Target:
5'-AAGTTGTATCAAAGCATTTTTCAAAAT-3' (SEQ ID NO: 818)

5'-<u>UUG</u>UAUCAAAGCA<u>U</u>UUUUCAAAAtc-3' (SEQ ID NO: 51)

3'-<u>UCA</u>ACAUAGUUUC<u>G</u>UAAAAAGUUU<u>AG</u>-5' (SEQ ID NO: 435)

C5-371 Target:
5'-AGTTGTATCAAAGCATTTTTCAAAATC-3' (SEQ ID NO: 819)

5'-<u>U</u>G<u>U</u>AUCAAAGCAU<u>U</u>UUUCAAAAUca-3' (SEQ ID NO: 52)

3'-<u>CAA</u>CAUAGUUUCGUA<u>A</u>AAAGUUU<u>UAGU</u>-5' (SEQ ID NO: 436)

C5-372 Target:
5'-GTTGTATCAAAGCATTTTTCAAAATCA-3' (SEQ ID NO: 820)

5'-<u>G</u>U<u>AU</u>CAAAGCAUU<u>U</u>UUCAAAAUCaa-3' (SEQ ID NO: 53)

3'-<u>AAC</u>AUAGUUUCGUA<u>AAAA</u>GUUUU<u>AGUU</u>-5' (SEQ ID NO: 437)

TABLE 2-continued

| Selected Human Anti-05 DsiRNA Agents (Asymmetrics) |
|---|
| C5-373 Target: 5'-TTGTATCAAAGCATTTTTCAAAATCAA-3' (SEQ ID NO: 821) |
| 5'-AAUAACCUAUGACAAUGGAUUUCtc-3' (SEQ ID NO: 54) |
| 3'-GGUUAUUGGAUACUGUUACCUAAAGAG-5' (SEQ ID NO: 438) |
| C5-408 Target: 5'-CCAATAACCTATGACAATGGATTTCTC-3' (SEQ ID NO: 822) |
| 5'-CUAUGACAAUGGAUUUCUCUUCAtt-3' (SEQ ID NO: 55) |
| 3'-UGGAUACUGUUACCUAAAGAGAAGUAA-5' (SEQ ID NO: 439) |
| C5-414 Target: 5'-ACCTATGACAATGGATTTCTCTTCATT-3' (SEQ ID NO: 823) |
| 5'-GACAAUGGAUUUCUCUUCAUUCAta-3' (SEQ ID NO: 56) |
| 3'-UACUGUUACCUAAAGAGAAGUAAGUAU-5' (SEQ ID NO: 440) |
| C5-418 Target: 5'-ATGACAATGGATTTCTCTTCATTCATA-3' (SEQ ID NO: 824) |
| 5'-ACAAUGGAUUUCUCUUCAUUCAUac-3' (SEQ ID NO: 57) |
| 3'-ACUGUUACCUAAAGAGAAGUAAGUAUG-5' (SEQ ID NO: 441) |
| C5-419 Target: 5'-TGACAATGGATTTCTCTTCATTCATAC-3' (SEQ ID NO: 825) |
| 5'-CAAUGGAUUUCUCUUCAUUCAUAca-3' (SEQ ID NO: 58) |
| 3'-CUGUUACCUAAAGAGAAGUAAGUAUGU-5' (SEQ ID NO: 442) |
| C5-420 Target: 5'-GACAATGGATTTCTCTTCATTCATACA-3' (SEQ ID NO: 826) |
| 5'-AUGGAUUUCUCUUCAUUCAUACAga-3' (SEQ ID NO: 59) |
| 3'-GUUACCUAAAGAGAAGUAAGUAUGUCU-5' (SEQ ID NO: 443) |
| C5-422 Target: 5'-CAATGGATTTCTCTTCATTCATACAGA-3' (SEQ ID NO: 827) |
| 5'-UGGAUUUCUCUUCAUUCAUACAGac-3' (SEQ ID NO: 60) |
| 3'-UUACCUAAAGAGAAGUAAGUAUGUCUG-5' (SEQ ID NO: 444) |
| C5-423 Target: 5'-AATGGATTTCTCTTCATTCATACAGAC-3' (SEQ ID NO: 828) |
| 5'-GAUUUCUCUUCAUUCAUACAGACaa-3' (SEQ ID NO: 61) |
| 3'-ACCUAAAGAGAAGUAAGUAUGUCUGUU-5' (SEQ ID NO: 445) |
| C5-425 Target: 5'-TGGATTTCTCTTCATTCATACAGACAA-3' (SEQ ID NO: 829) |
| 5'-AUUCAUACAGACAAACCUGUUUAta-3' (SEQ ID NO: 62) |
| 3'-AGUAAGUAUGUCUGUUUGGACAAAUAU-5' (SEQ ID NO: 446) |
| C5-436 Target: 5'-TCATTCATACAGACAAACCTGTTTATA-3' (SEQ ID NO: 830) |
| 5'-UCAUACAGACAAACCUGUUUAUAct-3' (SEQ ID NO: 63) |
| 3'-UAAGUAUGUCUGUUUGGACAAAUAUGA-5' (SEQ ID NO: 447) |
| C5-438 Target: 5'-ATTCATACAGACAAACCTGTTTATACT-3' (SEQ ID NO: 831) |
| 5'-CAUACAGACAAACCUGUUUAUACtc-3' (SEQ ID NO: 64) |
| 3'-AAGUAUGUCUGUUUGGACAAAUAUGAG-5' (SEQ ID NO: 448) |

TABLE 2-continued

| Selected Human Anti-05 DsiRNA Agents (Asymmetrics) |
|---|
| C5-439 Target: 5'-TTCATACAGACAAACCTGTTTATACTC-3' (SEQ ID NO: 832) |
| 5'-AUACAGACAAACCUGUUUAUACUcc-3' (SEQ ID NO: 65) |
| 3'-AGUAUGUCUGUUUGGACAAAUAUGAGG-5' (SEQ ID NO: 449) |
| C5-440 Target: 5'-TCATACAGACAAACCTGTTTATACTCC-3' (SEQ ID NO: 833) |
| 5'-GUUAGAGUUUAUUCGUUGAAUGACg-3' (SEQ ID NO: 66) |
| 3'-UUCAAUCUCAAAUAAGCAACUUACUGC-5' (SEQ ID NO: 450) |
| C5-481 Target: 5'-AAGTTAGAGTTTATTCGTTGAATGACG-3' (SEQ ID NO: 834) |
| 5'-UGACGACUUGAAGCCAGCCAAAAga-3' (SEQ ID NO: 67) |
| 3'-UUACUGCUGAACUUCGGUCGGUUUUCU-5' (SEQ ID NO: 451) |
| C5-501 Target: 5'-AATGACGACTTGAAGCCAGCCAAAAGA-3' (SEQ ID NO: 835) |
| 5'-GACGACUUGAAGCCAGCCAAAAGag-3' (SEQ ID NO: 68) |
| 3'-UACUGCUGAACUUCGGUCGGUUUUCUC-5' (SEQ ID NO: 452) |
| C5-502 Target: 5'-ATGACGACTTGAAGCCAGCCAAAAGAG-3' (SEQ ID NO: 836) |
| 5'-ACGACUUGAAGCCAGCCAAAAGAga-3' (SEQ ID NO: 69) |
| 3'-ACUGCUGAACUUCGGUCGGUUUUCUCU-5' (SEQ ID NO: 453) |
| C5-503 Target: 5'-TGACGACTTGAAGCCAGCCAAAAGAGA-3' (SEQ ID NO: 837) |
| 5'-CGACUUGAAGCCAGCCAAAAGAGaa-3' (SEQ ID NO: 70) |
| 3'-CUGCUGAACUUCGGUCGGUUUUCUCUU-5' (SEQ ID NO: 454) |
| C5-504 Target: 5'-GACGACTTGAAGCCAGCCAAAAGAGAA-3' (SEQ ID NO: 838) |
| 5'-AGAAACUGUCUUAACUUUCAUAGat-3' (SEQ ID NO: 71) |
| 3'-UCUCUUUGACAGAAUUGAAAGUAUCUA-5' (SEQ ID NO: 455) |
| C5-525 Target: 5'-AGAGAAACTGTCTTAACTTTCATAGAT-3' (SEQ ID NO: 839) |
| 5'-ACUGUCUUAACUUUCAUAGAUCCtg-3' (SEQ ID NO: 72) |
| 3'-UUUGACAGAAUUGAAAGUAUCUAGGAC-5' (SEQ ID NO: 456) |
| C5-529 Target: 5'-AAACTGTCTTAACTTTCATAGATCCTG-3' (SEQ ID NO: 840) |
| 5'-CUGUCUUAACUUUCAUAGAUCCUga-3' (SEQ ID NO: 73) |
| 3'-UUGACAGAAUUGAAAGUAUCUAGGACU-5' (SEQ ID NO: 457) |
| C5-530 Target: 5'-AACTGTCTTAACTTTCATAGATCCTGA-3' (SEQ ID NO: 841) |
| 5'-GAAGGAUCAGAAGUUGACAUGGUag-3' (SEQ ID NO: 74) |
| 3'-GACUUCCUAGUCUUCAACUGUACCAUC-5' (SEQ ID NO: 458) |
| C5-553 Target: 5'-CTGAAGGATCAGAAGTTGACATGGTAG-3' (SEQ ID NO: 842) |
| 5'-AAGGAUCAGAAGUUGACAUGGUAga-3' (SEQ ID NO: 75) |
| 3'-ACUUCCUAGUCUUCAACUGUACCAUCU-5' (SEQ ID NO: 459) |

TABLE 2-continued

Selected Human Anti-05 DsiRNA Agents (Asymmetrics)

C5-554 Target:
5'-TGAAGGATCAGAAGTTGACATGGTAGA-3' (SEQ ID NO: 843)

5'-GACAUGGUAGAAGAAAUUGAUCAta-3' (SEQ ID NO: 76)

3'-AACGUACCAUCUUCUUUAACUAGUAU-5' (SEQ ID NO: 460)

C5-568 Target:
5'-TTGACATGGTAGAAGAAATTGATCATA-3' (SEQ ID NO: 844)

5'-ACAUGGUAGAAGAAAUUGAUCAUat-3' (SEQ ID NO: 77)

3'-ACUGUACCAUCUUCUUUAACUAGUAUA-5' (SEQ ID NO: 461)

C5-569 Target:
5'-TGACATGGTAGAAGAAATTGATCATAT-3' (SEQ ID NO: 845)

5'-GGUAGAAGAAAUUGAUCAUAUUGga-3' (SEQ ID NO: 78)

3'-UACCAUCUUCUUUAACUAGUAUAACCU-5' (SEQ ID NO: 462)

C5-573 Target:
5'-ATGGTAGAAGAAATTGATCATATTGGA-3' (SEQ ID NO: 846)

5'-GUAGAAGAAAUUGAUCAUAUUGGaa-3' (SEQ ID NO: 79)

3'-ACCAUCUUCUUUAACUAGUAUAACCUU-5' (SEQ ID NO: 463)

C5-574 Target:
5'-TGGTAGAAGAAATTGATCATATTGGAA-3' (SEQ ID NO: 847)

5'-AAGAAAUUGAUCAUAUUGGAAUUat-3' (SEQ ID NO: 80)

3'-UCUUCUUUAACUAGUAUAACCUUAAUA-5' (SEQ ID NO: 464)

C5-578 Target:
5'-AGAAGAAATTGATCATATTGGAATTAT-3' (SEQ ID NO: 848)

5'-AGAAAUUGAUCAUAUUGGAAUUAtc-3' (SEQ ID NO: 81)

3'-CUUCUUUAACUAGUAUAACCUUAAUAG-5' (SEQ ID NO: 465)

C5-579 Target:
5'-GAAGAAATTGATCATATTGGAATTATC-3' (SEQ ID NO: 849)

5'-GGAAUUAUCUCUUUUCCUGACUUca-3' (SEQ ID NO: 82)

3'-AACCUUAAUAGAGAAAAGGACUGAAGU-5' (SEQ ID NO: 466)

C5-595 Target:
5'-TTGGAATTATCTCTTTTCCTGACTTCA-3' (SEQ ID NO: 850)

5'-GAAUUAUCUCUUUUCCUGACUUCaa-3' (SEQ ID NO: 83)

3'-ACCUUAAUAGAGAAAAGGACUGAAGUU-5' (SEQ ID NO: 467)

C5-596 Target:
5'-TGGAATTATCTCTTTTCCTGACTTCAA-3' (SEQ ID NO: 851)

5'-AAUUAUCUCUUUUCCUGACUUCAag-3' (SEQ ID NO: 84)

3'-CCUUAAUAGAGAAAAGGACUGAAGUUC-5' (SEQ ID NO: 468)

C5-597 Target:
5'-GGAATTATCTCTTTTCCTGACTTCAAG-3' (SEQ ID NO: 852)

5'-AUUAUCUCUUUUCCUGACUUCAAga-3' (SEQ ID NO: 85)

3'-CUUAAUAGAGAAAAGGACUGAAGUUCU-5' (SEQ ID NO: 469)

C5-598 Target:
5'-GAATTATCTCTTTTCCTGACTTCAAGA-3' (SEQ ID NO: 853)

5'-UUAUCUCUUUUCCUGACUUCAAGat-3' (SEQ ID NO: 86)

3'-UUAAUAGAGAAAAGGACUGAAGUUCUA-5' (SEQ ID NO: 470)

C5-599 Target:
5'-AATTATCTCTTTTCCTGACTTCAAGAT-3' (SEQ ID NO: 854)

5'-UAUCUCUUUUCCUGACUUCAAGAtt-3' (SEQ ID NO: 87)

3'-UAAUAGAGAAAAGGACUGAAGUUCUAA-5' (SEQ ID NO: 471)

C5-600 Target:
5'-ATTATCTCTTTTCCTGACTTCAAGATT-3' (SEQ ID NO: 855)

5'-AUCUCUUUUCCUGACUUCAAGAUc-3' (SEQ ID NO: 88)

3'-AAUAGAGAAAAGGACUGAAGUUCUAAG-5' (SEQ ID NO: 472)

C5-601 Target:
5'-TTATCTCTTTTCCTGACTTCAAGATTC-3' (SEQ ID NO: 856)

5'-UCUCUUUUCCUGACUUCAAGAUUcc-3' (SEQ ID NO: 89)

3'-AUAGAGAAAAGGACUGAAGUUCUAAGG-5' (SEQ ID NO: 473)

C5-602 Target:
5'-TATCTCTTTTCCTGACTTCAAGATTCC-3' (SEQ ID NO: 857)

5'-CUCUUUUCCUGACUUCAAGAUUCcg-3' (SEQ ID NO: 90)

3'-UAGAGAAAAGGACUGAAGUUCUAAGGC-5' (SEQ ID NO: 474)

C5-603 Target:
5'-ATCTCTTTTCCTGACTTCAAGATTCCG-3' (SEQ ID NO: 858)

5'-UCUUUUCCUGACUUCAAGAUUCCgt-3' (SEQ ID NO: 91)

3'-AGAGAAAAGGACUGAAGUUCUAAGGCA-5' (SEQ ID NO: 475)

C5-604 Target:
5'-TCTCTTTTCCTGACTTCAAGATTCCGT-3' (SEQ ID NO: 859)

5'-CUUUUCCUGACUUCAAGAUUCCGtc-3' (SEQ ID NO: 92)

3'-GAGAAAAGGACUGAAGUUCUAAGGCAG-5' (SEQ ID NO: 476)

C5-605 Target:
5'-CTCTTTTCCTGACTTCAAGATTCCGTC-3' (SEQ ID NO: 860)

5'-UUUUCCUGACUUCAAGAUUCCGUct-3' (SEQ ID NO: 93)

3'-AGAAAAGGACUGAAGUUCUAAGGCAGA-5' (SEQ ID NO: 477)

C5-606 Target:
5'-TCTTTTCCTGACTTCAAGATTCCGTCT-3' (SEQ ID NO: 861)

5'-UUUCCUGACUUCAAGAUUCCGUCta-3' (SEQ ID NO: 94)

3'-GAAAAGGACUGAAGUUCUAAGGCAGAU-5' (SEQ ID NO: 478)

C5-607 Target:
5'-CTTTTCCTGACTTCAAGATTCCGTCTA-3' (SEQ ID NO: 862)

5'-UUCCUGACUUCAAGAUUCCGUCUaa-3' (SEQ ID NO: 95)

3'-AAAAGGACUGAAGUUCUAAGGCAGAUU-5' (SEQ ID NO: 479)

C5-608 Target:
5'-TTTTCCTGACTTCAAGATTCCGTCTAA-3' (SEQ ID NO: 863)

5'-UUAAAGAAUAUGUCUUGCCACAUtt-3' (SEQ ID NO: 96)

3'-UCAAUUCUUAUACAGAACGGUGUAAA-5' (SEQ ID NO: 480)

C5-710 Target:
5'-AGTTAAAGAATATGTCTTGCCACATTT-3' (SEQ ID NO: 864)

5'-UAAAGAAUAUGUCUUGCCACAUUtt-3' (SEQ ID NO: 97)

3'-CAAUUCUUAUACAGAACGGUGUAAAA-5' (SEQ ID NO: 481)

TABLE 2-continued

Selected Human Anti-05 DsiRNA Agents (Asymmetrics)

C5-711 Target:
5'-GTTAAAGAATATGTCTTGCCACATTTT-3' (SEQ ID NO: 865)

5'-A<u>AAG</u>AAUAUGUCU<u>UG</u>C<u>C</u>ACAUU<u>UU</u>tt-3' (SEQ ID NO: 98)

3'-<u>AAU</u>UUCUUAUACAGA<u>AC</u>GGUGUA<u>AAAA</u>-5' (SEQ ID NO: 482)

C5-712 Target:
5'-TTAAAGAATATGTCTTGCCACATTTTT-3' (SEQ ID NO: 866)

5'-A<u>AG</u>AACUUUAAGA<u>A</u>UUUUGAAAUta-3' (SEQ ID NO: 99)

3'-<u>UGU</u>U<u>C</u>UUGAAAUUC<u>UU</u>AAAACUUU<u>AAU</u>-5' (SEQ ID NO: 483)

C5-775 Target:
5'-ACAAGAACTTTAAGAATTTTGAAATTA-3' (SEQ ID NO: 867)

5'-A<u>GAA</u>CUUUAAGAA<u>U</u>UUUGAAAUUac-3' (SEQ ID NO: 100)

3'-<u>GUU</u>C<u>U</u>UGAAAUUCUU<u>AAAA</u>CUUU<u>AAUG</u>-5' (SEQ ID NO: 484)

C5-776 Target:
5'-CAAGAACTTTAAGAATTTTGAAATTAC-3' (SEQ ID NO: 868)

5'-C<u>UUU</u>AAGAAUUUUG<u>AAA</u>UUACUAta-3' (SEQ ID NO: 101)

3'-<u>UUG</u>A<u>AA</u>UUCUUAAA<u>AC</u>UUUAAUG<u>AUAU</u>-5' (SEQ ID NO: 485)

C5-780 Target:
5'-AACTTTAAGAATTTTGAAATTACTATA-3' (SEQ ID NO: 869)

5'-G<u>AA</u>UUUUGAAAUUA<u>C</u>UAUAAAAGca-3' (SEQ ID NO: 102)

3'-<u>UUC</u>UUAAAACUUUAAU<u>G</u>AUAUUUU<u>CGU</u>-5' (SEQ ID NO: 486)

C5-786 Target:
5'-AAGAATTTTGAAATTACTATAAAAGCA-3' (SEQ ID NO: 870)

5'-A<u>AU</u>UUUGAAAUUA<u>C</u>UAUAAAAGCaa-3' (SEQ ID NO: 103)

3'-<u>UCU</u>UAAAACUUUAAUG<u>AU</u>AUUUU<u>CGUU</u>-5' (SEQ ID NO: 487)

C5-787 Target:
5'-AGAATTTTGAAATTACTATAAAAGCAA-3' (SEQ ID NO: 871)

5'-A<u>UU</u>UUGAAAUUAC<u>U</u>AUAAAAGCAag-3' (SEQ ID NO: 104)

3'-<u>CUU</u>AAAACUUUAAUG<u>A</u>UAUUUU<u>C</u>GUU<u>C</u>-5' (SEQ ID NO: 488)

C5-788 Target:
5'-GAATTTTGAAATTACTATAAAAGCAAG-3' (SEQ ID NO: 872)

5'-U<u>UG</u>AAAUUACUAU<u>AAAA</u>GCAAGAta-3' (SEQ ID NO: 105)

3'-<u>AAAA</u>CUUUAAUGAU<u>AUU</u>UUCGUUC<u>UAU</u>-5' (SEQ ID NO: 489)

C5-791 Target:
5'-TTTTGAAATTACTATAAAAGCAAGATA-3' (SEQ ID NO: 873)

5'-U<u>G</u>AAAUUACUAUA<u>AAAA</u>GCAAGAUat-3' (SEQ ID NO: 106)

3'-<u>AAA</u>CUUUAAUGAUAU<u>UUU</u>CGUUC<u>UAUA</u>-5' (SEQ ID NO: 490)

C5-792 Target:
5'-TTTGAAATTACTATAAAAGCAAGATAT-3' (SEQ ID NO: 874)

5'-G<u>AAA</u>UUACUAUAAA<u>AG</u>CAAGAUAUt-3' (SEQ ID NO: 107)

3'-<u>AAC</u>UUUAAUGAUAUUU<u>UC</u>GUUCU<u>AUAA</u>-5' (SEQ ID NO: 491)

C5-793 Target:
5'-TTGAAATTACTATAAAAGCAAGATATT-3' (SEQ ID NO: 875)

5'-A<u>AAG</u>CAAGAUAUUUU<u>U</u>AUAAUAAag-3' (SEQ ID NO: 108)

3'-<u>AUUU</u>CGUUCUAUAAA<u>AAU</u>AUUA<u>UUUC</u>-5' (SEQ ID NO: 492)

C5-805 Target:
5'-TAAAAGCAAGATATTTTTATAATAAAG-3' (SEQ ID NO: 876)

5'-A<u>AG</u>CAAGAUAUUUU<u>U</u>AUAAUAAAgt-3' (SEQ ID NO: 109)

3'-<u>UUUUC</u>GUUCUAUAAA<u>AAU</u>AUUAUUUCA-5' (SEQ ID NO: 493)

C5-806 Target:
5'-AAAAGCAAGATATTTTTATAATAAAGT-3' (SEQ ID NO: 877)

5'-A<u>GC</u>AAGAUAUUUUU<u>A</u>UAAUAAAGta-3' (SEQ ID NO: 110)

3'-<u>UUUC</u>GUUCUAUAAAAA<u>U</u>AUUAUU<u>UCAU</u>-5' (SEQ ID NO: 494)

C5-807 Target:
5'-AAAGCAAGATATTTTTATAATAAAGTA-3' (SEQ ID NO: 878)

5'-G<u>C</u>AAGAUAUUUUU<u>A</u>UAAUAAAGUag-3' (SEQ ID NO: 111)

3'-<u>UUC</u>GUUCUAUAAAAA<u>U</u>AUUAUUU<u>C</u>AU<u>C</u>-5' (SEQ ID NO: 495)

C5-808 Target:
5'-AAGCAAGATATTTTTATAATAAAGTAG-3' (SEQ ID NO: 879)

5'-C<u>A</u>AGAUAUUUUU<u>A</u>U<u>A</u>AUAAAGUAgt-3' (SEQ ID NO: 112)

3'-<u>UC</u>GUU<u>C</u>UAUAAAAAUA<u>U</u>UAUUU<u>C</u>AU<u>C</u>A-5' (SEQ ID NO: 496)

C5-809 Target:
5'-AGCAAGATATTTTTATAATAAAGTAGT-3' (SEQ ID NO: 880)

5'-A<u>AG</u>AUAUUUUUAU<u>AA</u>UAAAGUAGtc-3' (SEQ ID NO: 113)

3'-<u>C</u>GUUCUAUAAAAAUA<u>U</u>UAUUU<u>C</u>AU<u>C</u>AG-5' (SEQ ID NO: 497)

C5-810 Target:
5'-GCAAGATATTTTTATAATAAAGTAGTC-3' (SEQ ID NO: 881)

5'-A<u>GA</u>UAUUUUUAU<u>A</u>AU<u>A</u>AAGUAGUca-3' (SEQ ID NO: 114)

3'-<u>GUU</u>CUAUAAAAAUAUU<u>A</u>UUU<u>C</u>AU<u>C</u>AGU-5' (SEQ ID NO: 498)

C5-811 Target:
5'-CAAGATATTTTTATAATAAAGTAGTCA-3' (SEQ ID NO: 882)

5'-G<u>AU</u>AUUUUUAUAAU<u>A</u>AAGUAGUCac-3' (SEQ ID NO: 115)

3'-<u>UUC</u>UAUAAAAAUAUUAUUU<u>C</u>AU<u>C</u>AGU<u>G</u>-5' (SEQ ID NO: 499)

C5-812 Target:
5'-AAGATATTTTTATAATAAAGTAGTCAC-3' (SEQ ID NO: 883)

5'-C<u>AA</u>UGUUGAUAAAU<u>GG</u>AAUUGCUca-3' (SEQ ID NO: 116)

3'-<u>GUG</u>UUACAACUAUUU<u>A</u>CCUUAAC<u>G</u>AGU-5' (SEQ ID NO: 500)

C5-923 Target:
5'-CACAATGTTGATAAATGGAATTGCTCA-3' (SEQ ID NO: 884)

5'-A<u>AU</u>GUUGAUAAAUGG<u>A</u>AUUGCUCaa-3' (SEQ ID NO: 117)

3'-<u>UGU</u>U<u>A</u>CAACUAUUUA<u>CC</u>UUAAC<u>G</u>AGUU-5' (SEQ ID NO: 501)

C5-924 Target:
5'-ACAATGTTGATAAATGGAATTGCTCAA-3' (SEQ ID NO: 885)

5'-U<u>GU</u>UGAUAAAUGG<u>AA</u>UUGCUCAAgt-3' (SEQ ID NO: 118)

3'-<u>UUA</u>CAACUAUUUA<u>CC</u>UUAACGAGUUCA-5' (SEQ ID NO: 502)

C5-926 Target:
5'-AATGTTGATAAATGGAATTGCTCAAGT-3' (SEQ ID NO: 886)

5'-G<u>UU</u>GAUAAAUGG<u>AA</u>UUGCUCAAGtc-3' (SEQ ID NO: 119)

3'-<u>UACAA</u>CUAUUUACC<u>UU</u>AACGAGUU<u>CAG</u>-5' (SEQ ID NO: 503)

TABLE 2-continued

Selected Human Anti-05 DsiRNA Agents (Asymmetrics)

C5-927 Target:
5'-ATGTTGATAAATGGAATTGCTCAAGTC-3' (SEQ ID NO: 887)

5'-UUGAUAAAUGGAAUUGCUCAAGUCa-3' (SEQ ID NO: 120)

3'-ACAACUAUUUACCUUAACGAGUUCAGU-5' (SEQ ID NO: 504)

C5-928 Target:
5'-TGTTGATAAATGGAATTGCTCAAGTCA-3' (SEQ ID NO: 888)

5'-AUAAAUGGAAUUGCUCAAGUCACat-3' (SEQ ID NO: 121)

3'-ACUAUUUACCUUAACGAGUUCAGUGUA-5' (SEQ ID NO: 505)

C5-931 Target:
5'-TGATAAATGGAATTGCTCAAGTCACAT-3' (SEQ ID NO: 889)

5'-AUGGAAUUGCUCAAGUCACAUUUga-3' (SEQ ID NO: 122)

3'-UUUACCUUAACGAGUUCAGUGUAAACU-5' (SEQ ID NO: 506)

C5-935 Target:
5'-AAATGGAATTGCTCAAGTCACATTTGA-3' (SEQ ID NO: 890)

5'-CUCAAGUCACAUUUGAUUCUGAAac-3' (SEQ ID NO: 123)

3'-ACGAGUUCAGUGUAAACUAAGACUUUG-5' (SEQ ID NO: 507)

C5-944 Target:
5'-TGCTCAAGTCACATTTGATTCTGAAAC-3' (SEQ ID NO: 891)

5'-CAAGUCACAUUUGAUUCUGAAACag-3' (SEQ ID NO: 124)

3'-GAGUUCAGUGUAAACUAAGACUUUGUC-5' (SEQ ID NO: 508)

C5-946 Target:
5'-CTCAAGTCACATTTGATTCTGAAACAG-3' (SEQ ID NO: 892)

5'-AAGUCACAUUUGAUUCUGAAACAgc-3' (SEQ ID NO: 125)

3'-AGUUCAGUGUAAACUAAGACUUUGUCG-5' (SEQ ID NO: 509)

C5-947 Target:
5'-TCAAGTCACATTTGATTCTGAAACAGC-3' (SEQ ID NO: 893)

5'-AGUCACAUUUGAUUCUGAAACAGca-3' (SEQ ID NO: 126)

3'-GUUCAGUGUAAACUAAGACUUUGUCGU-5' (SEQ ID NO: 510)

C5-948 Target:
5'-CAAGTCACATTTGATTCTGAAACAGCA-3' (SEQ ID NO: 894)

5'-CAUUUGAUUCUGAAACAGCAGUCaa-3' (SEQ ID NO: 127)

3'-GUGUAAACUAAGACUUUGUCGUCAGUU-5' (SEQ ID NO: 511)

C5-953 Target:
5'-CACATTTGATTCTGAAACAGCAGTCAA-3' (SEQ ID NO: 895)

5'-UUUGAUUCUGAAACAGCAGUCAAag-3' (SEQ ID NO: 128)

3'-GUAAACUAAGACUUUGUCGUCAGUUUC-5' (SEQ ID NO: 512)

C5-955 Target:
5'-CATTTGATTCTGAAACAGCAGTCAAAG-3' (SEQ ID NO: 896)

5'-UUGAUUCUGAAACAGCAGUCAAAga-3' (SEQ ID NO: 129)

3'-UAAACUAAGACUUUGUCGUCAGUUUCU-5' (SEQ ID NO: 513)

C5-956 Target:
5'-ATTTGATTCTGAAACAGCAGTCAAAGA-3' (SEQ ID NO: 897)

5'-CAGCAGUCAAAGAACUGUCAUACta-3' (SEQ ID NO: 130)

3'-UUGUCGUCAGUUUCUUGACAGUAUGAU-5' (SEQ ID NO: 514)

TABLE 2-continued

Selected Human Anti-05 DsiRNA Agents (Asymmetrics)

C5-968 Target:
5'-AACAGCAGTCAAAGAACTGTCATACTA-3' (SEQ ID NO: 898)

5'-GCAGUCAAAGAACUGUCAUACUAca-3' (SEQ ID NO: 131)

3'-GUCGUCAGUUUCUUGACAGUAUGAUGU-5' (SEQ ID NO: 515)

C5-970 Target:
5'-CAGCAGTCAAAGAACTGTCATACTACA-3' (SEQ ID NO: 899)

5'-GUCAAAGAACUGUCAUACUACAGtt-3' (SEQ ID NO: 132)

3'-GUCAGUUUCUUGACAGUAUGAUGUCAA-5' (SEQ ID NO: 516)

C5-973 Target:
5'-CAGTCAAAGAACTGTCATACTACAGTT-3' (SEQ ID NO: 900)

5'-AAGAACUGUCAUACUACAGUUUAga-3' (SEQ ID NO: 133)

3'-GUUUCUUGACAGUAUGAUGUCAAAUCU-5' (SEQ ID NO: 517)

C5-977 Target:
5'-CAAAGAACTGTCATACTACAGTTTAGA-3' (SEQ ID NO: 901)

5'-AGAACUGUCAUACUACAGUUUAGaa-3' (SEQ ID NO: 134)

3'-UUUCUUGACAGUAUGAUGUCAAAUCUU-5' (SEQ ID NO: 518)

C5-978 Target:
5'-AAAGAACTGTCATACTACAGTTTAGAA-3' (SEQ ID NO: 902)

5'-AACUGUCAUACUACAGUUUAGAAga-3' (SEQ ID NO: 135)

3'-UCUUGACAGUAUGAUGUCAAAUCUUCU-5' (SEQ ID NO: 519)

C5-980 Target:
5'-AGAACTGTCATACTACAGTTTAGAAGA-3' (SEQ ID NO: 903)

5'-UUAAACAACAAGUACCUUUAUAUtg-3' (SEQ ID NO: 136)

3'-UAAAUUUGUUGUUCAUGGAAAUAUAAC-5' (SEQ ID NO: 520)

C5-1006 Target:
5'-ATTTAAACAACAAGTACCTTTATATTG-3' (SEQ ID NO: 904)

5'-UAAACAACAAGUACCUUUAUAUUgc-3' (SEQ ID NO: 137)

3'-AAAUUUGUUGUUCAUGGAAAUAUAACG-5' (SEQ ID NO: 521)

C5-1007 Target:
5'-TTTAAACAACAAGTACCTTTATATTGC-3' (SEQ ID NO: 905)

5'-AAACAACAAGUACCUUUAUAUUGct-3' (SEQ ID NO: 138)

3'-AAUUUGUUGUUCAUGGAAAUAUAACGA-5' (SEQ ID NO: 522)

C5-1008 Target:
5'-TTAAACAACAAGTACCTTTATATTGCT-3' (SEQ ID NO: 906)

5'-AACAACAAGUACCUUUAUAUUGCtg-3' (SEQ ID NO: 139)

3'-AUUUGUUGUUCAUGGAAAUAUAACGAC-5' (SEQ ID NO: 523)

C5-1009 Target:
5'-TAAACAACAAGTACCTTTATATTGCTG-3' (SEQ ID NO: 907)

5'-ACAACAAGUACCUUUAUAUUGCUgt-3' (SEQ ID NO: 140)

3'-UUUGUUGUUCAUGGAAAUAUAACGACA-5' (SEQ ID NO: 524)

C5-1010 Target:
5'-AAACAACAAGTACCTTTATATTGCTGT-3' (SEQ ID NO: 908)

5'-CAACAAGUACCUUUAUAUUGCUGta-3' (SEQ ID NO: 141)

3'-UUGUUGUUCAUGGAAAUAUAACGACAU-5' (SEQ ID NO: 525)

TABLE 2-continued

Selected Human Anti-05 DsiRNA Agents (Asymmetrics)

C5-1011 Target:
5'-AACAACAAGTACCTTTATATTGCTGTA-3' (SEQ ID NO: 909)

5'-A<u>AC</u>AAGUACCUUU<u>AU</u>A<u>U</u>UGCUGUAaa-3' (SEQ ID NO: 142)

3'-<u>UGUUG</u>UUCAUGG<u>AAAU</u>AUAACGA<u>CAUU</u>-5' (SEQ ID NO: 526)

C5-1012 Target:
5'-ACAACAAGTACCTTTATATTGCTGTAA-3' (SEQ ID NO: 910)

5'-A<u>CA</u>AGUACCUUU<u>AUAU</u>UGCUGUAac-3' (SEQ ID NO: 143)

3'-<u>GUUG</u>UUCAUGG<u>AAAU</u>AUAACGACAUUG-5' (SEQ ID NO: 527)

C5-1013 Target:
5'-CAACAAGTACCTTTATATTGCTGTAAC-3' (SEQ ID NO: 911)

5'-C<u>AAG</u>UACCUUUAU<u>AU</u>UGCUGUAAca-3' (SEQ ID NO: 144)

3'-<u>UUGUU</u>CAUGG<u>AAAU</u>AUAACGA<u>CAUUGU</u>-5' (SEQ ID NO: 528)

C5-1014 Target:
5'-AACAAGTACCTTTATATTGCTGTAACA-3' (SEQ ID NO: 912)

5'-A<u>AG</u>UACCUUU<u>AUAU</u>UGCUGUAAcag-3' (SEQ ID NO: 145)

3'-<u>UGUUC</u>AUGGAA<u>AU</u>A<u>U</u>AACGA<u>CAUU</u>GUC-5' (SEQ ID NO: 529)

C5-1015 Target:
5'-ACAAGTACCTTTATATTGCTGTAACAG-3' (SEQ ID NO: 913)

5'-A<u>GU</u>ACCUUUAU<u>AU</u>UG<u>C</u>UGUAACAgt-3' (SEQ ID NO: 146)

3'-<u>GUUC</u>AUGGAAAUA<u>AC</u>GACAUUG<u>UCA</u>-5' (SEQ ID NO: 530)

C5-1016 Target:
5'-CAAGTACCTTTATATTGCTGTAACAGT-3' (SEQ ID NO: 914)

5'-G<u>UAC</u>CUUUAU<u>AU</u>UG<u>C</u>UGUAACAGtc-3' (SEQ ID NO: 147)

3'-<u>UUC</u>AUGGAAAU<u>AU</u>A<u>AC</u>GACAUUG<u>UCAG</u>-5' (SEQ ID NO: 531)

C5-1017 Target:
5'-AAGTACCTTTATATTGCTGTAACAGTC-3' (SEQ ID NO: 915)

5'-A<u>CC</u>UUU<u>AUAU</u>UGC<u>U</u>GUAACAGUCat-3' (SEQ ID NO: 148)

3'-<u>C</u>AUGG<u>AAAU</u>AUAACGACAUUG<u>UC</u>AGUA-5' (SEQ ID NO: 532)

C5-1019 Target:
5'-GTACCTTTATATTGCTGTAACAGTCAT-3' (SEQ ID NO: 916)

5'-U<u>C</u>A<u>AA</u>UAUGUCC<u>U</u>C<u>U</u>C<u>U</u>CCCUACaa-3' (SEQ ID NO: 149)

3'-<u>G</u>UAG<u>U</u>UUAUACAGG<u>AGAGAGGGAUGUU</u>-5' (SEQ ID NO: 533)

C5-1088 Target:
5'-CATCAAATATGTCCTCTCTCCCTACAA-3' (SEQ ID NO: 917)

5'-C<u>CC</u>UACAAACUGA<u>AUUU</u>GGUUGCta-3' (SEQ ID NO: 150)

3'-<u>GAGGG</u>AUGUUUGAC<u>UU</u>AAACCAA<u>CGAU</u>-5' (SEQ ID NO: 534)

C5-1105 Target:
5'-CTCCCTACAAACTGAATTTGGTTGCTA-3' (SEQ ID NO: 918)

5'-A<u>CA</u>AACUGA<u>AUUU</u>GG<u>U</u>UGCUACUcc-3' (SEQ ID NO: 151)

3'-<u>G</u>A<u>U</u>GUUUGACUUAAA<u>CC</u>AACGAUGAGG-5' (SEQ ID NO: 535)

C5-1109 Target:
5'-CTACAAACTGAATTTGGTTGCTACTCC-3' (SEQ ID NO: 919)

5'-C<u>AAA</u>CUGAAUUUGG<u>U</u>UGCUACUCct-3' (SEQ ID NO: 152)

3'-<u>AUG</u>UUUGACUUAAA<u>CC</u>AACGAUGAGGA-5' (SEQ ID NO: 536)

TABLE 2-continued

Selected Human Anti-05 DsiRNA Agents (Asymmetrics)

C5-1110 Target:
5'-TACAAACTGAATTTGGTTGCTACTCCT-3' (SEQ ID NO: 920)

5'-C<u>UG</u>AAUGCACAAAC<u>A</u>A<u>U</u>UGAUGUAaa-3' (SEQ ID NO: 153)

3'-<u>GUGA</u>CUUACGUGUUU<u>G</u>UUAACUA<u>C</u>AUU-5' (SEQ ID NO: 537)

C5-1222 Target:
5'-CACTGAATGCACAAACAATTGATGTAA-3' (SEQ ID NO: 921)

5'-U<u>GA</u>AUGCACAAAC<u>A</u>A<u>U</u>UGAUGUAaa-3' (SEQ ID NO: 154)

3'-<u>UGA</u>CUUACGUGUUU<u>G</u>UUAACUA<u>C</u>AUUU-5' (SEQ ID NO: 538)

C5-1223 Target:
5'-ACTGAATGCACAAACAATTGATGTAAA-3' (SEQ ID NO: 922)

5'-C<u>AA</u>GAGACAUCUGA<u>C</u>UUGGAUCCaa-3' (SEQ ID NO: 155)

3'-<u>UGGUU</u>CUCUGUAGACUGAACCUAG<u>GUU</u>-5' (SEQ ID NO: 539)

C5-1249 Target:
5'-ACCAAGAGACATCTGACTTGGATCCAA-3' (SEQ ID NO: 923)

5'-A<u>AG</u>AGACAUCUGA<u>CU</u>UGGAUCCAag-3' (SEQ ID NO: 156)

3'-<u>GGUU</u>CUCUGUAGACUG<u>AA</u>CCUAG<u>GUUC</u>-5' (SEQ ID NO: 540)

C5-1250 Target:
5'-CCAAGAGACATCTGACTTGGATCCAAG-3' (SEQ ID NO: 924)

5'-G<u>GUU</u>ACCGAGCAA<u>UA</u>GCAUACUCat-3' (SEQ ID NO: 157)

3'-<u>UUCC</u>AAUGGCUCGUU<u>AU</u>CGUAUG<u>AGUA</u>-5' (SEQ ID NO: 541)

C5-1405 Target:
5'-AAGGTTACCGAGCAATAGCATACTCAT-3' (SEQ ID NO: 925)

5'-U<u>CAG</u>CCAAAGUU<u>ACC</u>UUUAUAUUga-3' (SEQ ID NO: 158)

3'-<u>AGA</u>GUCGGUUUCAUGG<u>AAAU</u>AUAACU-5' (SEQ ID NO: 542)

C5-1433 Target:
5'-TCTCAGCCAAAGTTACCTTTATATTGA-3' (SEQ ID NO: 926)

5'-C<u>AG</u>CCAAAGUUAC<u>CU</u>UUAUAUUGat-3' (SEQ ID NO: 159)

3'-<u>GAGUCGG</u>UUUCAUGG<u>AA</u>AUAUAACUA-5' (SEQ ID NO: 543)

C5-1434 Target:
5'-CTCAGCCAAAGTTACCTTTATATTGAT-3' (SEQ ID NO: 927)

5'-A<u>GCC</u>AAAGUUACC<u>UUU</u>AUAUUGAtt-3' (SEQ ID NO: 160)

3'-<u>AGUCGG</u>UUUCAUGG<u>A</u>A<u>A</u>UAUAACUAA-5' (SEQ ID NO: 544)

C5-1435 Target:
5'-TCAGCCAAAGTTACCTTTATATTGATT-3' (SEQ ID NO: 928)

5'-G<u>CC</u>AAAGUUACCUUU<u>AUAUU</u>GAUtg-3' (SEQ ID NO: 161)

3'-<u>GUCGG</u>UUUCAUGG<u>AAAU</u>AUAACUAAC-5' (SEQ ID NO: 545)

C5-1436 Target:
5'-CAGCCAAAGTTACCTTTATATTGATTG-3' (SEQ ID NO: 929)

5'-A<u>AAAG</u>CCCAUAU<u>AU</u>UGACAAAAUaa-3' (SEQ ID NO: 162)

3'-<u>GGUUU</u>UCGGGUAUAU<u>AA</u>CUGUUUUAUU-5' (SEQ ID NO: 546)

C5-1519 Target:
5'-CCAAAAGCCCATATATTGACAAAATAA-3' (SEQ ID NO: 930)

5'-G<u>CC</u>CAUAUAUUGA<u>C</u>A<u>AA</u>AUAACUca-3' (SEQ ID NO: 163)

3'-<u>UUCGGG</u>UAUAUAACUGUUUUAUU<u>GAGU</u>-5' (SEQ ID NO: 547)

TABLE 2-continued

Selected Human Anti-O5 DsiRNA Agents (Asymmetrics)

C5-1523 Target:
5'-AAGCCCATATATTGACAAAATAACTCA-3' (SEQ ID NO: 931)

5'-CCCAUAUAUUGACAAAAUAACUCac-3' (SEQ ID NO: 164)

3'-UCGGGUAUAUAACUGUUUUAUUGAGUG-5' (SEQ ID NO: 548)

C5-1524 Target:
5'-AGCCCATATATTGACAAAATAACTCAC-3' (SEQ ID NO: 932)

5'-CAUAUAUUGACAAAAUAACUCACta-3' (SEQ ID NO: 165)

3'-GGGUAUAUAACUGUUUUAUUGAGUGAU-5' (SEQ ID NO: 549)

C5-1526 Target:
5'-CCCATATATTGACAAAATAACTCACTA-3' (SEQ ID NO: 933)

5'-AUAUAUUGACAAAAUAACUCACUat-3' (SEQ ID NO: 166)

3'-GGUAUAUAACUGUUUUAUUGAGUGAUA-5' (SEQ ID NO: 550)

C5-1527 Target:
5'-CCATATATTGACAAAATAACTCACTAT-3' (SEQ ID NO: 934)

5'-UAUAUUGACAAAAUAACUCACUAta-3' (SEQ ID NO: 167)

3'-GUAUAUAACUGUUUUAUUGAGUGAUAU-5' (SEQ ID NO: 551)

C5-1528 Target:
5'-CATATATTGACAAAATAACTCACTATA-3' (SEQ ID NO: 935)

5'-AUUGACAAAAUAACUCACUAUAAtt-3' (SEQ ID NO: 168)

3'-UAUAACUGUUUUAUUGAGUGAUAUUAA-5' (SEQ ID NO: 552)

C5-1531 Target:
5'-ATATTGACAAAATAACTCACTATAATT-3' (SEQ ID NO: 936)

5'-UGACAAAAUAACUCACUAUAAUUac-3' (SEQ ID NO: 169)

3'-UAACUGUUUUAUUGAGUGAUAUUAAUG-5' (SEQ ID NO: 553)

C5-1533 Target:
5'-ATTGACAAAATAACTCACTATAATTAC-3' (SEQ ID NO: 937)

5'-GACAAAAUAACUCACUAUAAUUAct-3' (SEQ ID NO: 170)

3'-AACUGUUUUAUUGAGUGAUAUUAAUGA-5' (SEQ ID NO: 554)

C5-1534 Target:
5'-TTGACAAAATAACTCACTATAATTACT-3' (SEQ ID NO: 938)

5'-ACAAAAUAACUCACUAUAAUUACtt-3' (SEQ ID NO: 171)

3'-ACUGUUUUAUUGAGUGAUAUUAAUGAA-5' (SEQ ID NO: 555)

C5-1535 Target:
5'-TGACAAAATAACTCACTATAATTACTT-3' (SEQ ID NO: 939)

5'-CAAAAUAACUCACUAUAAUUACUtg-3' (SEQ ID NO: 172)

3'-CUGUUUUAUUGAGUGAUAUUAAUGAAC-5' (SEQ ID NO: 556)

C5-1536 Target:
5'-GACAAAATAACTCACTATAATTACTTG-3' (SEQ ID NO: 940)

5'-AAAAUAACUCACUAUAAUUACUUga-3' (SEQ ID NO: 173)

3'-UGUUUUAUUGAGUGAUAUUAAUGAACU-5' (SEQ ID NO: 557)

C5-1537 Target:
5'-ACAAAATAACTCACTATAATTACTTGA-3' (SEQ ID NO: 941)

5'-AAAUAACUCACUAUAAUUACUUGat-3' (SEQ ID NO: 174)

3'-GUUUUAUUGAGUGAUAUUAAUGAACUA-5' (SEQ ID NO: 558)

C5-1538 Target:
5'-CAAAATAACTCACTATAATTACTTGAT-3' (SEQ ID NO: 942)

5'-AAUAACUCACUAUAAUUACUUGAtt-3' (SEQ ID NO: 175)

3'-UUUUAUUGAGUGAUAUUAAUGAACUAA-5' (SEQ ID NO: 559)

C5-1539 Target:
5'-AAAATAACTCACTATAATTACTTGATT-3' (SEQ ID NO: 943)

5'-AUAACUCACUAUAAUUACUUGAUtt-3' (SEQ ID NO: 176)

3'-UUUAUUGAGUGAUAUUAAUGAACUAAA-5' (SEQ ID NO: 560)

C5-1540 Target:
5'-AAATAACTCACTATAATTACTTGATTT-3' (SEQ ID NO: 944)

5'-UAACUCACUAUAAUUACUUGAUUtt-3' (SEQ ID NO: 177)

3'-UUAUUGAGUGAUAUUAAUGAACUAAAA-5' (SEQ ID NO: 561)

C5-1541 Target:
5'-AATAACTCACTATAATTACTTGATTTT-3' (SEQ ID NO: 945)

5'-AACUCACUAUAAUUACUUGAUUUta-3' (SEQ ID NO: 178)

3'-UAUUGAGUGAUAUUAAUGAACUAAAAU-5' (SEQ ID NO: 562)

C5-1542 Target:
5'-ATAACTCACTATAATTACTTGATTTTA-3' (SEQ ID NO: 946)

5'-ACUCACUAUAAUUACUUGAUUUUat-3' (SEQ ID NO: 179)

3'-AUUGAGUGAUAUUAAUGAACUAAAAUA-5' (SEQ ID NO: 563)

C5-1543 Target:
5'-TAACTCACTATAATTACTTGATTTTAT-3' (SEQ ID NO: 947)

5'-CUCACUAUAAUUACUUGAUUUUAtc-3' (SEQ ID NO: 180)

3'-UUGAGUGAUAUUAAUGAACUAAAAUAG-5' (SEQ ID NO: 564)

C5-1544 Target:
5'-AACTCACTATAATTACTTGATTTTATC-3' (SEQ ID NO: 948)

5'-UCACUAUAAUUACUUGAUUUUAUcc-3' (SEQ ID NO: 181)

3'-UGAGUGAUAUUAAUGAACUAAAAUAGG-5' (SEQ ID NO: 565)

C5-1545 Target:
5'-ACTCACTATAATTACTTGATTTTATCC-3' (SEQ ID NO: 949)

5'-CACUAUAAUUACUUGAUUUUAUCca-3' (SEQ ID NO: 182)

3'-GAGUGAUAUUAAUGAACUAAAAUAGGU-5' (SEQ ID NO: 566)

C5-1546 Target:
5'-CTCACTATAATTACTTGATTTTATCCA-3' (SEQ ID NO: 950)

5'-ACUAUAAUUACUUGAUUUUAUCCaa-3' (SEQ ID NO: 183)

3'-AGUGAUAUUAAUGAACUAAAAUAGGUU-5' (SEQ ID NO: 567)

C5-1547 Target:
5'-TCACTATAATTACTTGATTTTATCCAA-3' (SEQ ID NO: 951)

5'-CUAUAAUUACUUGAUUUUAUCCAag-3' (SEQ ID NO: 184)

3'-GUGAUAUUAAUGAACUAAAAUAGGUUC-5' (SEQ ID NO: 568)

C5-1548 Target:
5'-CACTATAATTACTTGATTTTATCCAAG-3' (SEQ ID NO: 952)

5'-UAUAAUUACUUGAUUUUAUCCAAgg-3' (SEQ ID NO: 185)

3'-UGAUAUUAAUGAACUAAAAUAGGUUCC-5' (SEQ ID NO: 569)

TABLE 2-continued

Selected Human Anti-05 DsiRNA Agents (Asymmetrics)

C5-1549 Target:
5'-ACTATAATTACTTGATTTTATCCAAGG-3' (SEQ ID NO: 953)

5'-AUAAUUACUUGAUUUUAUCCAAGgg-3' (SEQ ID NO: 186)

3'-GAUAUUAAUGAACUAAAAUAGGUUCCC-5' (SEQ ID NO: 570)

C5-1550 Target:
5'-CTATAATTACTTGATTTTATCCAAGGG-3' (SEQ ID NO: 954)

5'-UAAUUACUUGAUUUUAUCCAAGGgc-3' (SEQ ID NO: 187)

3'-AUAUUAAUGAACUAAAAUAGGUUCCCG-5' (SEQ ID NO: 571)

C5-1551 Target:
5'-TATAATTACTTGATTTTATCCAAGGGC-3' (SEQ ID NO: 955)

5'-AAUUACUUGAUUUUAUCCAAGGGca-3' (SEQ ID NO: 188)

3'-UAUUAAUGAACUAAAAUAGGUUCCCGU-5' (SEQ ID NO: 572)

C5-1552 Target:
5'-ATAATTACTTGATTTTATCCAAGGGCA-3' (SEQ ID NO: 956)

5'-AUUACUUGAUUUUAUCCAAGGGCaa-3' (SEQ ID NO: 189)

3'-AUUAAUGAACUAAAAUAGGUUCCCGUU-5' (SEQ ID NO: 573)

C5-1553 Target:
5'-TAATTACTTGATTTTATCCAAGGGCAA-3' (SEQ ID NO: 957)

5'-GUCUGAUUCAGUCUGGUUAAAUAtt-3' (SEQ ID NO: 190)

3'-CACAGACUAAGUCAGACCAAUUUAUAA-5' (SEQ ID NO: 574)

C5-1719 Target:
5'-GTGTCTGATTCAGTCTGGTTAAATATT-3' (SEQ ID NO: 958)

5'-CUGAUUCAGUCUGGUUAAAUAUUga-3' (SEQ ID NO: 191)

3'-CAGACUAAGUCAGACCAAUUUAUAACU-5' (SEQ ID NO: 575)

C5-1721 Target:
5'-GTCTGATTCAGTCTGGTTAAATATTGA-3' (SEQ ID NO: 959)

5'-UGAUUCAGUCUGGUUAAAUAUUGaa-3' (SEQ ID NO: 192)

3'-AGACUAAGUCAGACCAAUUUAUAACUU-5' (SEQ ID NO: 576)

C5-1722 Target:
5'-TCTGATTCAGTCTGGTTAAATATTGAA-3' (SEQ ID NO: 960)

5'-GAUUCAGUCUGGUUAAAUAUUGAag-3' (SEQ ID NO: 193)

3'-GACUAAGUCAGACCAAUUUAUAACUUC-5' (SEQ ID NO: 577)

C5-1723 Target:
5'-CTGATTCAGTCTGGTTAAATATTGAAG-3' (SEQ ID NO: 961)

5'-AUUCAGUCUGGUUAAAUAUUGAga-3' (SEQ ID NO: 194)

3'-ACUAAGUCAGACCAAUUUAUAACUUCU-5' (SEQ ID NO: 578)

C5-1724 Target:
5'-TGATTCAGTCTGGTTAAATATTGAAGA-3' (SEQ ID NO: 962)

5'-UCAGUCUGGUUAAAUAUUGAAGAaa-3' (SEQ ID NO: 195)

3'-UAAGUCAGACCAAUUUAUAACUUCUUU-5' (SEQ ID NO: 579)

C5-1726 Target:
5'-ATTCAGTCTGGTTAAATATTGAAGAAA-3' (SEQ ID NO: 963)

5'-CAGUCUGGUUAAAUAUUGAAGAAaa-3' (SEQ ID NO: 196)

3'-AAGUCAGACCAAUUUAUAACUUCUUUU-5' (SEQ ID NO: 580)

C5-1727 Target:
5'-TTCAGTCTGGTTAAATATTGAAGAAAA-3' (SEQ ID NO: 964)

5'-AGUCUGGUUAAAUAUUGAAGAAAaa-3' (SEQ ID NO: 197)

3'-AGUCAGACCAAUUUAUAACUUCUUUUU-5' (SEQ ID NO: 581)

C5-1728 Target:
5'-TCAGTCTGGTTAAATATTGAAGAAAAA-3' (SEQ ID NO: 965)

5'-GUCUGGUUAAAUAUUGAAGAAAAat-3' (SEQ ID NO: 198)

3'-GUCAGACCAAUUUAUAACUUCUUUUUA-5' (SEQ ID NO: 582)

C5-1729 Target:
5'-CAGTCTGGTTAAATATTGAAGAAAAAT-3' (SEQ ID NO: 966)

5'-UCUGGUUAAAUAUUGAAGAAAAAtg-3' (SEQ ID NO: 199)

3'-UCAGACCAAUUUAUAACUUCUUUUUAC-5' (SEQ ID NO: 583)

C5-1730 Target:
5'-AGTCTGGTTAAATATTGAAGAAAAATG-3' (SEQ ID NO: 967)

5'-CUGGUUAAAUAUUGAAGAAAAAUgt-3' (SEQ ID NO: 200)

3'-CAGACCAAUUUAUAACUUCUUUUUACA-5' (SEQ ID NO: 584)

C5-1731 Target:
5'-GTCTGGTTAAATATTGAAGAAAAATGT-3' (SEQ ID NO: 968)

5'-UGGUUAAAUAUUGAAGAAAAAUGtg-3' (SEQ ID NO: 201)

3'-AGACCAAUUUAUAACUUCUUUUUACAC-5' (SEQ ID NO: 585)

C5-1732 Target:
5'-TCTGGTTAAATATTGAAGAAAAATGTG-3' (SEQ ID NO: 969)

5'-GGUUAAAUAUUGAAGAAAAAUGUgg-3' (SEQ ID NO: 202)

3'-GACCAAUUUAUAACUUCUUUUUACACC-5' (SEQ ID NO: 586)

C5-1733 Target:
5'-CTGGTTAAATATTGAAGAAAAATGTGG-3' (SEQ ID NO: 970)

5'-UGUGGCAACCAGCUCCAGGUUCAtc-3' (SEQ ID NO: 203)

3'-UUACACCGUUGGUCGAGGUCCAAGUAG-5' (SEQ ID NO: 587)

C5-1753 Target:
5'-AATGTGGCAACCAGCTCCAGGTTCATC-3' (SEQ ID NO: 971)

5'-GUGGCAACCAGCUCCAGGUUCAUct-3' (SEQ ID NO: 204)

3'-UACACCGUUGGUCGAGGUCCAAGUAGA-5' (SEQ ID NO: 588)

C5-1754 Target:
5'-ATGTGGCAACCAGCTCCAGGTTCATCT-3' (SEQ ID NO: 972)

5'-CUGGGCUGUGGGGCAGGUGGUGGcc-3' (SEQ ID NO: 205)

3'-UAGACCCGACACCCCGUCCACCACCGG-5' (SEQ ID NO: 589)

C5-1948 Target:
5'-ATCTGGGCTGTGGGGCAGGTGGTGGCC-3' (SEQ ID NO: 973)

5'-UGGGCUGUGGGGCAGGUGGUGGCct-3' (SEQ ID NO: 206)

3'-AGACCCGACACCCCGUCCACCACCGGA-5' (SEQ ID NO: 590)

C5-1949 Target:
5'-TCTGGGCTGTGGGGCAGGTGGTGGCCT-3' (SEQ ID NO: 974)

5'-GGGCUGUGGGGCAGGUGGUGGCCtc-3' (SEQ ID NO: 207)

3'-GACCCGACACCCCGUCCACCACCGGAG-5' (SEQ ID NO: 591)

TABLE 2-continued

Selected Human Anti-05 DsiRNA Agents (Asymmetrics)

C5-1950 Target:
5'-CTGGGCTGTGGGGCAGGTGGTGGCCTC-3' (SEQ ID NO: 975)

5'-GGCUGUGGGGCAGGUGGUGGCCUCa-3' (SEQ ID NO: 208)

3'-ACCCGACACCCCGUCCACCACCGGAGU-5' (SEQ ID NO: 592)

C5-1951 Target:
5'-TGGGCTGTGGGGCAGGTGGTGGCCTCA-3' (SEQ ID NO: 976)

5'-GCUGUGGGGCAGGUGGUGGCCUCaa-3' (SEQ ID NO: 209)

3'-CCCGACACCCCGUCCACCACCGGAGUU-5' (SEQ ID NO: 593)

C5-1952 Target:
5'-GGGCTGTGGGGCAGGTGGTGGCCTCAA-3' (SEQ ID NO: 977)

5'-CUGUGGGGCAGGUGGUGGCCUCAac-3' (SEQ ID NO: 210)

3'-CCGACACCCCGUCCACCACCGGAGUUG-5' (SEQ ID NO: 594)

C5-1953 Target:
5'-GGCTGTGGGGCAGGTGGTGGCCTCAAC-3' (SEQ ID NO: 978)

5'-UGUGGGGCAGGUGGUGGCCUCAAca-3' (SEQ ID NO: 211)

3'-CGACACCCCGUCCACCACCGGAGUUGU-5' (SEQ ID NO: 595)

C5-1954 Target:
5'-GCTGTGGGGCAGGTGGTGGCCTCAACA-3' (SEQ ID NO: 979)

5'-AGAAAAUGAUGAACCUUGUAAAGaa-3' (SEQ ID NO: 212)

3'-GUUCUUUUACUACUUGGAACAUUUCUU-5' (SEQ ID NO: 596)

C5-2043 Target:
5'-CAAGAAAATGATGAACCTTGTAAAGAA-3' (SEQ ID NO: 980)

5'-AUGAUGAACCUUGUAAAGAAAUUct-3' (SEQ ID NO: 213)

3'-UUUACUACUUGGAACAUUUCUUUAAGA-5' (SEQ ID NO: 597)

C5-2048 Target:
5'-AAATGATGAACCTTGTAAAGAAATTCT-3' (SEQ ID NO: 981)

5'-GAUGAACCUUGUAAAGAAAUUCUca-3' (SEQ ID NO: 214)

3'-UACUACUUGGAACAUUUCUUUAAGAGU-5' (SEQ ID NO: 598)

C5-2050 Target:
5'-ATGATGAACCTTGTAAAGAAATTCTCA-3' (SEQ ID NO: 982)

5'-AUGAACCUUGUAAAGAAAUUCUCag-3' (SEQ ID NO: 215)

3'-ACUACUUGGAACAUUUCUUUAAGAGUC-5' (SEQ ID NO: 599)

C5-2051 Target:
5'-TGATGAACCTTGTAAAGAAATTCTCAG-3' (SEQ ID NO: 983)

5'-CUUGUAAAGAAAUUCUCAGGCCAag-3' (SEQ ID NO: 216)

3'-UGGAACAUUUCUUUAAGAGUCCGGUUC-5' (SEQ ID NO: 600)

C5-2057 Target:
5'-ACCTTGTAAAGAAATTCTCAGGCCAAG-3' (SEQ ID NO: 984)

5'-UUGUAAAGAAAUUCUCAGGCCAAga-3' (SEQ ID NO: 217)

3'-GGAACAUUUCUUUAAGAGUCCGGUUCU-5' (SEQ ID NO: 601)

C5-2058 Target:
5'-CCTTGTAAAGAAATTCTCAGGCCAAGA-3' (SEQ ID NO: 985)

5'-AGUAGUGAAGAAAUGUUGUUACGat-3' (SEQ ID NO: 218)

3'-AGUCAUCACUUCUUUACAACAAUGCUA-5' (SEQ ID NO: 602)

C5-2133 Target:
5'-TCAGTAGTGAAGAAATGTTGTTACGAT-3' (SEQ ID NO: 986)

5'-GUAGUGAAGAAAUGUUGUUACGAtg-3' (SEQ ID NO: 219)

3'-GUCAUCACUUCUUUACAACAAUGCUAC-5' (SEQ ID NO: 603)

C5-2134 Target:
5'-CAGTAGTGAAGAAATGTTGTTACGATG-3' (SEQ ID NO: 987)

5'-GAAGACCCUGUUACCAGUAAGCAag-3' (SEQ ID NO: 220)

3'-UACUUCUGGGACAAUGGUCAUUCGUUC-5' (SEQ ID NO: 604)

C5-2316 Target:
5'-ATGAAGACCCTGTTACCAGTAAGCAAG-3' (SEQ ID NO: 988)

5'-CAAGCCAGAAAUUCGGAGUUAUUtt-3' (SEQ ID NO: 221)

3'-UCGUUCGGUCUUUAAGCCUCAUAAAA-5' (SEQ ID NO: 605)

C5-2337 Target:
5'-AGCAAGCCAGAAATTCGGAGTTATTTT-3' (SEQ ID NO: 989)

5'-UCAAGGCAAAGGUGUUCAAAGAUgt-3' (SEQ ID NO: 222)

3'-ACAGUUCCGUUUCCACAAGUUUCUACA-5' (SEQ ID NO: 606)

C5-2498 Target:
5'-TGTCAAGGCAAAGGTGTTCAAAGATGT-3' (SEQ ID NO: 990)

5'-CAAGGCAAAGGUGUUCAAAGAUGtc-3' (SEQ ID NO: 223)

3'-CAGUUCCGUUUCCACAAGUUUCUACAG-5' (SEQ ID NO: 607)

C5-2499 Target:
5'-GTCAAGGCAAAGGTGTTCAAAGATGTC-3' (SEQ ID NO: 991)

5'-AAGGCAAAGGUGUUCAAAGAUGUct-3' (SEQ ID NO: 224)

3'-AGUUCCGUUUCCACAAGUUUCUACAGA-5' (SEQ ID NO: 608)

C5-2500 Target:
5'-TCAAGGCAAAGGTGTTCAAAGATGTCT-3' (SEQ ID NO: 992)

5'-AGGCAAAGGUGUUCAAAGAUGUCtt-3' (SEQ ID NO: 225)

3'-GUUCCGUUUCCACAAGUUUCUACAGAA-5' (SEQ ID NO: 609)

C5-2501 Target:
5'-CAAGGCAAAGGTGTTCAAAGATGTCTT-3' (SEQ ID NO: 993)

5'-GAUGUCUUCCUGGAAAUGAAUAUac-3' (SEQ ID NO: 226)

3'-UUCUACAGAAGGACCUUUACUUAUAUG-5' (SEQ ID NO: 610)

C5-2518 Target:
5'-AAGATGTCTTCCTGGAAATGAATATAC-3' (SEQ ID NO: 994)

5'-CUGGAAAUGAAUAUACCAUAUUCtg-3' (SEQ ID NO: 227)

3'-AGGACCUUUACUUAUAUGGUAUAAGAC-5' (SEQ ID NO: 611)

C5-2527 Target:
5'-TCCTGGAAATGAATATACCATATTCTG-3' (SEQ ID NO: 995)

5'-UGGAAAUGAAUAUACCAUAUUCUgt-3' (SEQ ID NO: 228)

3'-GGACCUUUACUUAUAUGGUAUAAGACA-5' (SEQ ID NO: 612)

C5-2528 Target:
5'-CCTGGAAATGAATATACCATATTCTGT-3' (SEQ ID NO: 996)

5'-GGAAAUGAAUAUACCAUAUUCUGtt-3' (SEQ ID NO: 229)

3'-GACCUUUACUUAUAUGGUAUAAGACAA-5' (SEQ ID NO: 613)

TABLE 2-continued

Selected Human Anti-O5 DsiRNA Agents (Asymmetrics)

C5-2529 Target:
5'-CTGGAAATGAATATACCATATTCTGTT-3' (SEQ ID NO: 997)

5'-GAAAUGAAUAUACCAUAUUCUGUUtg-3' (SEQ ID NO: 230)

3'-ACCUUUACUUAUAUGGUAUAAGACAAC-5' (SEQ ID NO: 614)

C5-2530 Target:
5'-TGGAAATGAATATACCATATTCTGTTG-3' (SEQ ID NO: 998)

5'-AAAUGAAUAUACCAUAUUCUGUUGta-3' (SEQ ID NO: 231)

3'-CCUUUACUUAUAUGGUAUAAGACAACA-5' (SEQ ID NO: 615)

C5-2531 Target:
5'-GGAAATGAATATACCATATTCTGTTGT-3' (SEQ ID NO: 999)

5'-AAUGAAUAUACCAUAUUCUGUUGta-3' (SEQ ID NO: 232)

3'-CUUUACUUAUAUGGUAUAAGACAACAU-5' (SEQ ID NO: 616)

C5-2532 Target:
5'-GAAATGAATATACCATATTCTGTTGTA-3' (SEQ ID NO: 1000)

5'-AUGAAUAUACCAUAUUCUGUUGUac-3' (SEQ ID NO: 233)

3'-UUUACUUAUAUGGUAUAAGACAACAUG-5' (SEQ ID NO: 617)

C5-2533 Target:
5'-AAATGAATATACCATATTCTGTTGTAC-3' (SEQ ID NO: 1001)

5'-UGAAUAUACCAUAUUCUGUUGUAcg-3' (SEQ ID NO: 234)

3'-UUACUUAUAUGGUAUAAGACAACAUGC-5' (SEQ ID NO: 618)

C5-2534 Target:
5'-AATGAATATACCATATTCTGTTGTACG-3' (SEQ ID NO: 1002)

5'-GAAUAUACCAUAUUCUGUUGUACga-3' (SEQ ID NO: 235)

3'-UACUUAUAUGGUAUAAGACAACAUGCU-5' (SEQ ID NO: 619)

C5-2535 Target:
5'-ATGAATATACCATATTCTGTTGTACGA-3' (SEQ ID NO: 1003)

5'-AAUAUACCAUAUUCUGUUGUACGag-3' (SEQ ID NO: 236)

3'-ACUUAUAUGGUAUAAGACAACAUGCUC-5' (SEQ ID NO: 620)

C5-2536 Target:
5'-TGAATATACCATATTCTGTTGTACGAG-3' (SEQ ID NO: 1004)

5'-AUAUACCAUAUUCUGUUGUACGAgg-3' (SEQ ID NO: 237)

3'-CUUAUAUGGUAUAAGACAACAUGCUCC-5' (SEQ ID NO: 621)

C5-2537 Target:
5'-GAATATACCATATTCTGTTGTACGAGG-3' (SEQ ID NO: 1005)

5'-CGAGGAGAACAGAUCCAAUUGAAag-3' (SEQ ID NO: 238)

3'-AUGCUCCUCUUGUCUAGGUUAACUUUC-5' (SEQ ID NO: 622)

C5-2557 Target:
5'-TACGAGGAGAACAGATCCAATTGAAAG-3' (SEQ ID NO: 1006)

5'-GAGGAGAACAGAUCCAAUUGAAAgg-3' (SEQ ID NO: 239)

3'-UGCUCCUCUUGUCUAGGUUAACUUUCC-5' (SEQ ID NO: 623)

C5-2558 Target:
5'-ACGAGGAGAACAGATCCAATTGAAAGG-3' (SEQ ID NO: 1007)

5'-AGGAGAACAGAUCCAAUUGAAAGga-3' (SEQ ID NO: 240)

3'-GCUCCUCUUGUCUAGGUUAACUUUCCU-5' (SEQ ID NO: 624)

TABLE 2-continued

Selected Human Anti-O5 DsiRNA Agents (Asymmetrics)

C5-2559 Target:
5'-CGAGGAGAACAGATCCAATTGAAAGGA-3' (SEQ ID NO: 1008)

5'-GGAGAACAGAUCCAAUUGAAAGGAa-3' (SEQ ID NO: 241)

3'-CUCCUCUUGUCUAGGUUAACUUUCCUU-5' (SEQ ID NO: 625)

C5-2560 Target:
5'-GAGGAGAACAGATCCAATTGAAAGGAA-3' (SEQ ID NO: 1009)

5'-GAGAACAGAUCCAAUUGAAAGGAac-3' (SEQ ID NO: 242)

3'-UCCUCUUGUCUAGGUUAACUUUCCUUG-5' (SEQ ID NO: 626)

C5-2561 Target:
5'-AGGAGAACAGATCCAATTGAAAGGAAC-3' (SEQ ID NO: 1010)

5'-AGAACAGAUCCAAUUGAAAGGAAct-3' (SEQ ID NO: 243)

3'-CCUCUUGUCUAGGUUAACUUUCCUUGA-5' (SEQ ID NO: 627)

C5-2562 Target:
5'-GGAGAACAGATCCAATTGAAAGGAACT-3' (SEQ ID NO: 1011)

5'-GAACAGAUCCAAUUGAAAGGAACtg-3' (SEQ ID NO: 244)

3'-CUCUUGUCUAGGUUAACUUUCCUUGAC-5' (SEQ ID NO: 628)

C5-2563 Target:
5'-GAGAACAGATCCAATTGAAAGGAACTG-3' (SEQ ID NO: 1012)

5'-AACAGAUCCAAUUGAAAGGAACUgt-3' (SEQ ID NO: 245)

3'-UCUUGUCUAGGUUAACUUUCCUUGACA-5' (SEQ ID NO: 629)

C5-2564 Target:
5'-AGAACAGATCCAATTGAAAGGAACTGT-3' (SEQ ID NO: 1013)

5'-ACAGAUCCAAUUGAAAGGAACUGtt-3' (SEQ ID NO: 246)

3'-CUUGUCUAGGUUAACUUUCCUUGACAA-5' (SEQ ID NO: 630)

C5-2565 Target:
5'-GAACAGATCCAATTGAAAGGAACTGTT-3' (SEQ ID NO: 1014)

5'-CAGAUCCAAUUGAAAGGAACUGUtt-3' (SEQ ID NO: 247)

3'-UUGUCUAGGUUAACUUUCCUUGACAAA-5' (SEQ ID NO: 631)

C5-2566 Target:
5'-AACAGATCCAATTGAAAGGAACTGTTT-3' (SEQ ID NO: 1015)

5'-AGAUCCAAUUGAAAGGAACUGUUta-3' (SEQ ID NO: 248)

3'-UGUCUAGGUUAACUUUCCUUGACAAAU-5' (SEQ ID NO: 632)

C5-2567 Target:
5'-ACAGATCCAATTGAAAGGAACTGTTTA-3' (SEQ ID NO: 1016)

5'-GAUCCAAUUGAAAGGAACUGUUUac-3' (SEQ ID NO: 249)

3'-GUCUAGGUUAACUUUCCUUGACAAAUG-5' (SEQ ID NO: 633)

C5-2568 Target:
5'-CAGATCCAATTGAAAGGAACTGTTTAC-3' (SEQ ID NO: 1017)

5'-AUCCAAUUGAAAGGAACUGUUUAca-3' (SEQ ID NO: 250)

3'-UCUAGGUUAACUUUCCUUGACAAAUGU-5' (SEQ ID NO: 634)

C5-2569 Target:
5'-AGATCCAATTGAAAGGAACTGTTTACA-3' (SEQ ID NO: 1018)

5'-UCCAAUUGAAAGGAACUGUUUACaa-3' (SEQ ID NO: 251)

3'-CUAGGUUAACUUUCCUUGACAAAUGUU-5' (SEQ ID NO: 635)

TABLE 2-continued

Selected Human Anti-05 DsiRNA Agents (Asymmetrics)

C5-2570 Target:
5'-GATCCAATTGAAAGGAACTGTTTACAA-3' (SEQ ID NO: 1019)

5'-CCAAUUGAAAGGAACUGUUUACAac-3' (SEQ ID NO: 252)

3'-UAGGUUAACUUUCCUUGACAAAUGUUG-5' (SEQ ID NO: 636)

C5-2571 Target:
5'-ATCCAATTGAAAGGAACTGTTTACAAC-3' (SEQ ID NO: 1020)

5'-CAAUUGAAAGGAACUGUUUACAAct-3' (SEQ ID NO: 253)

3'-AGGUUAACUUUCCUUGACAAAUGUUGA-5' (SEQ ID NO: 637)

C5-2572 Target:
5'-TCCAATTGAAAGGAACTGTTTACAACT-3' (SEQ ID NO: 1021)

5'-AAUUGAAAGGAACUGUUUACAACta-3' (SEQ ID NO: 254)

3'-GGUUAACUUUCCUUGACAAAUGUUGAU-5' (SEQ ID NO: 638)

C5-2573 Target:
5'-CCAATTGAAAGGAACTGTTTACAACTA-3' (SEQ ID NO: 1022)

5'-AUUGAAAGGAACUGUUUACAACUat-3' (SEQ ID NO: 255)

3'-GUUAACUUUCCUUGACAAAUGUUGAUA-5' (SEQ ID NO: 639)

C5-2574 Target:
5'-CAATTGAAAGGAACTGTTTACAACTAT-3' (SEQ ID NO: 1023)

5'-UUGAAAGGAACUGUUUACAACUAta-3' (SEQ ID NO: 256)

3'-UUAACUUUCCUUGACAAAUGUUGAUAU-5' (SEQ ID NO: 640)

C5-2575 Target:
5'-AATTGAAAGGAACTGTTTACAACTATA-3' (SEQ ID NO: 1024)

5'-UGAAAGGAACUGUUUACAACUAUag-3' (SEQ ID NO: 257)

3'-UAACUUUCCUUGACAAAUGUUGAUAUC-5' (SEQ ID NO: 641)

C5-2576 Target:
5'-ATTGAAAGGAACTGTTTACAACTATAG-3' (SEQ ID NO: 1025)

5'-GAAAGGAACUGUUUACAACUAUAgg-3' (SEQ ID NO: 258)

3'-AACUUUCCUUGACAAAUGUUGAUAUCC-5' (SEQ ID NO: 642)

C5-2577 Target:
5'-TTGAAAGGAACTGTTTACAACTATAGG-3' (SEQ ID NO: 1026)

5'-AAAGGAACUGUUUACAACUAUAGga-3' (SEQ ID NO: 259)

3'-ACUUUCCUUGACAAAUGUUGAUAUCCU-5' (SEQ ID NO: 643)

C5-2578 Target:
5'-TGAAAGGAACTGTTTACAACTATAGGA-3' (SEQ ID NO: 1027)

5'-AAGGAACUGUUUACAACUAUAGGac-3' (SEQ ID NO: 260)

3'-CUUUCCUUGACAAAUGUUGAUAUCCUG-5' (SEQ ID NO: 644)

C5-2579 Target:
5'-GAAAGGAACTGTTTACAACTATAGGAC-3' (SEQ ID NO: 1028)

5'-AGGAACUGUUUACAACUAUAGGAct-3' (SEQ ID NO: 261)

3'-UUUCCUUGACAAAUGUUGAUAUCCUGA-5' (SEQ ID NO: 645)

C5-2580 Target:
5'-AAAGGAACTGTTTACAACTATAGGACT-3' (SEQ ID NO: 1029)

5'-GGAACUGUUUACAACUAUAGGACtt-3' (SEQ ID NO: 262)

3'-UUCCUUGACAAAUGUUGAUAUCCUGAA-5' (SEQ ID NO: 646)

TABLE 2-continued

Selected Human Anti-05 DsiRNA Agents (Asymmetrics)

C5-2581 Target:
5'-AAGGAACTGTTTACAACTATAGGACTT-3' (SEQ ID NO: 1030)

5'-GUUAAAAUGUCUGCUGUGGAGGGaa-3' (SEQ ID NO: 263)

3'-CACAAUUUUACAGACGACACCUCCCUU-5' (SEQ ID NO: 647)

C5-2623 Target:
5'-GTGTTAAAATGTCTGCTGTGGAGGGAA-3' (SEQ ID NO: 1031)

5'-UUAAAAUGUCUGCUGUGGAGGGAat-3' (SEQ ID NO: 264)

3'-ACAAUUUUACAGACGACACCUCCCUUA-5' (SEQ ID NO: 648)

C5-2624 Target:
5'-TGTTAAAATGTCTGCTGTGGAGGGAAT-3' (SEQ ID NO: 1032)

5'-UAAAAUGUCUGCUGUGGAGGGAAtc-3' (SEQ ID NO: 265)

3'-CAAUUUUACAGACGACACCUCCCUUAG-5' (SEQ ID NO: 649)

C5-2625 Target:
5'-GTTAAAATGTCTGCTGTGGAGGGAATC-3' (SEQ ID NO: 1033)

5'-AAAAUGUCUGCUGUGGAGGGAAUct-3' (SEQ ID NO: 266)

3'-AAUUUUACAGACGACACCUCCCUUAGA-5' (SEQ ID NO: 650)

C5-2626 Target:
5'-TTAAAATGTCTGCTGTGGAGGGAATCT-3' (SEQ ID NO: 1034)

5'-AAAUGUCUGCUGUGGAGGGAAUCtg-3' (SEQ ID NO: 267)

3'-AUUUUACAGACGACACCUCCCUUAGAC-5' (SEQ ID NO: 651)

C5-2627 Target:
5'-TAAAATGTCTGCTGTGGAGGGAATCTG-3' (SEQ ID NO: 1035)

5'-UGCUUCCUCUGGAAAUUGGCCUUca-3' (SEQ ID NO: 268)

3'-ACACGAAGGAGACCUUUAACCGGAAGU-5' (SEQ ID NO: 652)

C5-2753 Target:
5'-TGTGCTTCCTCTGGAAATTGGCCTTCA-3' (SEQ ID NO: 1036)

5'-GCUUCCUCUGGAAAUUGGCCUUCac-3' (SEQ ID NO: 269)

3'-CACGAAGGAGACCUUUAACCGGAAGUG-5' (SEQ ID NO: 653)

C5-2754 Target:
5'-GTGCTTCCTCTGGAAATTGGCCTTCAC-3' (SEQ ID NO: 1037)

5'-CUUCCUCUGGAAAUUGGCCUUCAca-3' (SEQ ID NO: 270)

3'-ACGAAGGAGACCUUUAACCGGAAGUGU-5' (SEQ ID NO: 654)

C5-2755 Target:
5'-TGCTTCCTCTGGAAATTGGCCTTCACA-3' (SEQ ID NO: 1038)

5'-UUCCUCUGGAAAUUGGCCUUCACaa-3' (SEQ ID NO: 271)

3'-CGAAGGAGACCUUUAACCGGAAGUGUU-5' (SEQ ID NO: 655)

C5-2756 Target:
5'-GCTTCCTCTGGAAATTGGCCTTCACAA-3' (SEQ ID NO: 1039)

5'-UCCUCUGGAAAUUGGCCUUCACAac-3' (SEQ ID NO: 272)

3'-GAAGGAGACCUUUAACCGGAAGUGUUG-5' (SEQ ID NO: 656)

C5-2757 Target:
5'-CTTCCTCTGGAAATTGGCCTTCACAAC-3' (SEQ ID NO: 1040)

5'-CCUCUGGAAAUUGGCCUUCACAAca-3' (SEQ ID NO: 273)

3'-AAGGAGACCUUUAACCGGAAGUGUUGU-5' (SEQ ID NO: 657)

TABLE 2-continued

Selected Human Anti-05 DsiRNA Agents (Asymmetrics)

C5-2758 Target:
5'-TTCCTCTGGAAATTGGCCTTCACAACA-3' (SEQ ID NO: 1041)

5'-CUCUGGAAAUUGGCCUUCACAACat-3' (SEQ ID NO: 274)

3'-AGGAGACCUUUAACCGGAAGUGUUGUA-5' (SEQ ID NO: 658)

C5-2759 Target:
5'-TCCTCTGGAAATTGGCCTTCACAACAT-3' (SEQ ID NO: 1042)

5'-UCUGGAAAUUGGCCUUCACAACAtc-3' (SEQ ID NO: 275)

3'-GGAGACCUUUAACCGGAAGUGUUGUAG-5' (SEQ ID NO: 659)

C5-2760 Target:
5'-CCTCTGGAAATTGGCCTTCACAACATC-3' (SEQ ID NO: 1043)

5'-AGAAAUCAAAGGAUUUUGAGUGta-3' (SEQ ID NO: 276)

3'-UGUCUUUAGUUUUCCUAAAACUCACAU-5' (SEQ ID NO: 660)

C5-2967 Target:
5'-ACAGAAATCAAAGGATTTTGAGTGTA-3' (SEQ ID NO: 1044)

5'-GAAAUCAAAGGAUUUUGAGUGUaa-3' (SEQ ID NO: 277)

3'-GUCUUUAGUUUUCCUAAAACUCACAUU-5' (SEQ ID NO: 661)

C5-2968 Target:
5'-CAGAAATCAAAGGATTTTGAGTGTAA-3' (SEQ ID NO: 1045)

5'-CAAAAGGAUUUUGAGUGUAAAAGga-3' (SEQ ID NO: 278)

3'-UAGUUUUCCUAAAACUCACAUUUUCCU-5' (SEQ ID NO: 662)

C5-2973 Target:
5'-ATCAAAAGGATTTTGAGTGTAAAAGGA-3' (SEQ ID NO: 1046)

5'-AUCCUAACCCACCUCCCCAAAGGga-3' (SEQ ID NO: 279)

3'-UAUAGGAUUGGGUGGAGGGGUUUCCCU-5' (SEQ ID NO: 663)

C5-3049 Target:
5'-ATATCCTAACCCACCTCCCCAAAGGGA-3' (SEQ ID NO: 1047)

5'-UCCUAACCCACCUCCCCAAAGGGag-3' (SEQ ID NO: 280)

3'-AUAGGAUUGGGUGGAGGGGUUUCCCUC-5' (SEQ ID NO: 664)

C5-3050 Target:
5'-TATCCTAACCCACCTCCCCAAAGGGAG-3' (SEQ ID NO: 1048)

5'-CCAGUAUUCUAUGUUUUCACUAcc-3' (SEQ ID NO: 281)

3'-AGGGUCAUAAGAUACAAAAGUGAUGG-5' (SEQ ID NO: 665)

C5-3103 Target:
5'-TCCCAGTATTCTATGTTTTTCACTACC-3' (SEQ ID NO: 1049)

5'-AGGAAAUCAUUGGAACAUUUUUCat-3' (SEQ ID NO: 282)

3'-UGUCCUUUAGUAACCUUGUAAAAAGUA-5' (SEQ ID NO: 666)

C5-3135 Target:
5'-ACAGGAAATCATTGGAACATTTTTCAT-3' (SEQ ID NO: 1050)

5'-GGAAAUCAUUGGAACAUUUUUCAtt-3' (SEQ ID NO: 283)

3'-GUCCUUUAGUAACCUUGUAAAAAGUAA-5' (SEQ ID NO: 667)

C5-3136 Target:
5'-CAGGAAATCATTGGAACATTTTTCATT-3' (SEQ ID NO: 1051)

5'-GAGCAUUAUGUCCUACAGAAAUGct-3' (SEQ ID NO: 284)

3'-AACUCGUAAUACAGGAUGUCUUUACGA-5' (SEQ ID NO: 668)

C5-3216 Target:
5'-TTGAGCATTATGTCCTACAGAAATGCT-3' (SEQ ID NO: 1052)

5'-CUUGGUUAACAGCUUUUGCUUUAag-3' (SEQ ID NO: 285)

3'-GUGAACCAAUUGUCGAAAACGAAAUUC-5' (SEQ ID NO: 669)

C5-3281 Target:
5'-CACTTGGTTAACAGCTTTTGCTTTAAG-3' (SEQ ID NO: 1053)

5'-GGUUAACAGCUUUUGCUUUAAGAgt-3' (SEQ ID NO: 286)

3'-AACCAAUUGUCGAAAACGAAAUUCUCA-5' (SEQ ID NO: 670)

C5-3284 Target:
5'-TTGGTTAACAGCTTTTGCTTTAAGAGT-3' (SEQ ID NO: 1054)

5'-GUUAACAGCUUUUGCUUUAAGAGta-3' (SEQ ID NO: 287)

3'-ACCAAUUGUCGAAAACGAAAUUCUCAU-5' (SEQ ID NO: 671)

C5-3285 Target:
5'-TGGTTAACAGCTTTTGCTTTAAGAGTA-3' (SEQ ID NO: 1055)

5'-GCUUUAAGAGUACUUGGACAAGUaa-3' (SEQ ID NO: 288)

3'-AACGAAAUUCUCAUGAACCUGUUCAUU-5' (SEQ ID NO: 672)

C5-3298 Target:
5'-TTGCTTTAAGAGTACTTGGACAAGTAA-3' (SEQ ID NO: 1056)

5'-CUUUAAGAGUACUUGGACAAGUAaa-3' (SEQ ID NO: 289)

3'-ACGAAAUUCUCAUGAACCUGUUCAUUU-5' (SEQ ID NO: 673)

C5-3299 Target:
5'-TGCTTTAAGAGTACTTGGACAAGTAAA-3' (SEQ ID NO: 1057)

5'-UAAGAGUACUUGGACAAGUAAAUaa-3' (SEQ ID NO: 290)

3'-AAAUUCUCAUGAACCUGUUCAUUUAUU-5' (SEQ ID NO: 674)

C5-3302 Target:
5'-TTTAAGAGTACTTGGACAAGTAAATAA-3' (SEQ ID NO: 1058)

5'-AAGAGUACUUGGACAAGUAAAUAaa-3' (SEQ ID NO: 291)

3'-AAUUCUCAUGAACCUGUUCAUUUAUUU-5' (SEQ ID NO: 675)

C5-3303 Target:
5'-TTAAGAGTACTTGGACAAGTAAATAAA-3' (SEQ ID NO: 1059)

5'-UAGAGCAGAACCAAAAUUCAAUUtg-3' (SEQ ID NO: 292)

3'-GCAUCUCGUCUUGGUUUUAAGUUAAAC-5' (SEQ ID NO: 676)

C5-3332 Target:
5'-CGTAGAGCAGAACCAAAATTCAATTTG-3' (SEQ ID NO: 1060)

5'-AGAGCAGAACCAAAAUUCAAUUUgt-3' (SEQ ID NO: 293)

3'-CAUCUCGUCUUGGUUUUAAGUUAAACA-5' (SEQ ID NO: 677)

C5-3333 Target:
5'-GTAGAGCAGAACCAAAATTCAATTTGT-3' (SEQ ID NO: 1061)

5'-GAGCAGAACCAAAAUUCAAUUUGta-3' (SEQ ID NO: 294)

3'-AUCUCGUCUUGGUUUUAAGUUAAACAU-5' (SEQ ID NO: 678)

C5-3334 Target:
5'-TAGAGCAGAACCAAAATTCAATTTGTA-3' (SEQ ID NO: 1062)

5'-AGCAGAACCAAAAUUCAAUUUGUaa-3' (SEQ ID NO: 295)

3'-UCUCGUCUUGGUUUUAAGUUAAACAUU-5' (SEQ ID NO: 679)

TABLE 2-continued

Selected Human Anti-O5 DsiRNA Agents (Asymmetrics)

C5-3335 Target:
5'-AGAGCAGAACCAAAATTCAATTTGTAA-3' (SEQ ID NO: 1063)

5'-CACAGUAUCAACCAAUAAAAUUAca-3' (SEQ ID NO: 296)

3'-AAGUGUCAUAGUUGGUUAUUUUAAUGU-5' (SEQ ID NO: 680)

C5-3419 Target:
5'-TTCACAGTATCAACCAATAAAATTACA-3' (SEQ ID NO: 1064)

5'-ACCAAUAAAAUUACAGGGUACCUtg-3' (SEQ ID NO: 297)

3'-GUUGGUUAUUUUAAUGUCCCAUGGAAC-5' (SEQ ID NO: 681)

C5-3429 Target:
5'-CAACCAATAAAATTACAGGGTACCTTG-3' (SEQ ID NO: 1065)

5'-CCAAUAAAAUUACAGGGUACCUUgc-3' (SEQ ID NO: 298)

3'-UUGGUUAUUUUAAUGUCCCAUGGAACG-5' (SEQ ID NO: 682)

C5-3430 Target:
5'-AACCAATAAAATTACAGGGTACCTTGC-3' (SEQ ID NO: 1066)

5'-CAAUAAAAUUACAGGGUACCUUgcc-3' (SEQ ID NO: 299)

3'-UGGUUAUUUUAAUGUCCCAUGGAACGG-5' (SEQ ID NO: 683)

C5-3431 Target:
5'-ACCAATAAAATTACAGGGTACCTTGCC-3' (SEQ ID NO: 1067)

5'-CUGUGAUUGGAAUUAGAAAGGCUtt-3' (SEQ ID NO: 300)

3'-AUGACACUAACCUUAAUCUUUCCGAAA-5' (SEQ ID NO: 684)

C5-3497 Target:
5'-TACTGTGATTGGAATTAGAAAGGCTTT-3' (SEQ ID NO: 1068)

5'-UGUGAUUGGAAUUAGAAAGGCUUtc-3' (SEQ ID NO: 301)

3'-UGACACUAACCUUAAUCUUUCCGAAAG-5' (SEQ ID NO: 685)

C5-3498 Target:
5'-ACTGTGATTGGAATTAGAAAGGCTTTC-3' (SEQ ID NO: 1069)

5'-GUGAUUGGAAUUAGAAAGGCUUUcg-3' (SEQ ID NO: 302)

3'-GACACUAACCUUAAUCUUUCCGAAAGC-5' (SEQ ID NO: 686)

C5-3499 Target:
5'-CTGTGATTGGAATTAGAAAGGCTTTCG-3' (SEQ ID NO: 1070)

5'-UGAUUGGAAUUAGAAAGGCUUUCga-3' (SEQ ID NO: 303)

3'-ACACUAACCUUAAUCUUUCCGAAAGCU-5' (SEQ ID NO: 687)

C5-3500 Target:
5'-TGTGATTGGAATTAGAAAGGCTTTCGA-3' (SEQ ID NO: 1071)

5'-UUCAAUUGUUUCAGCUUUGAAGAga-3' (SEQ ID NO: 304)

3'-GCAAGUUAACAAAGUCGAAACUUCUCU-5' (SEQ ID NO: 688)

C5-3672 Target:
5'-CGTTCAATTGTTTCAGCTTTGAAGAGA-3' (SEQ ID NO: 1072)

5'-GAAGAGAGAAGCUUUGGUUAAAGgt-3' (SEQ ID NO: 305)

3'-AACUUCUCUCUUCGAAACCAAUUUCCA-5' (SEQ ID NO: 689)

C5-3690 Target:
5'-TTGAAGAGAGAAGCTTTGGTTAAAGGT-3' (SEQ ID NO: 1073)

5'-AAGAGAGAAGCUUUGGUUAAAGGta-3' (SEQ ID NO: 306)

3'-ACUUCUCUCUUCGAAACCAAUUUCCAU-5' (SEQ ID NO: 690)

TABLE 2-continued

Selected Human Anti-O5 DsiRNA Agents (Asymmetrics)

C5-3691 Target:
5'-TGAAGAGAGAAGCTTTGGTTAAAGGTA-3' (SEQ ID NO: 1074)

5'-AGAGAGAAGCUUUGGUUAAAGGUaa-3' (SEQ ID NO: 307)

3'-CUUCUCUCUUCGAAACCAAUUUCCAUU-5' (SEQ ID NO: 691)

C5-3692 Target:
5'-GAAGAGAGAAGCTTTGGTTAAAGGTAA-3' (SEQ ID NO: 1075)

5'-AGAAGCUUUGGUUAAAGGUAAUCca-3' (SEQ ID NO: 308)

3'-UCUCUUCGAAACCAAUUUCCAUUAGGU-5' (SEQ ID NO: 692)

C5-3696 Target:
5'-AGAGAAGCTTTGGTTAAAGGTAATCCA-3' (SEQ ID NO: 1076)

5'-GAAGCUUUGGUUAAAGGUAAUCCac-3' (SEQ ID NO: 309)

3'-CUCUUCGAAACCAAUUUCCAUUAGGUG-5' (SEQ ID NO: 693)

C5-3697 Target:
5'-GAGAAGCTTTGGTTAAAGGTAATCCAC-3' (SEQ ID NO: 1077)

5'-CCAUUUAUCGUUUUUGGAAAGACaa-3' (SEQ ID NO: 310)

3'-UGGGUAAAUAGCAAAAACCUUUCUGUU-5' (SEQ ID NO: 694)

C5-3722 Target:
5'-ACCCATTTATCGTTTTTGGAAAGACAA-3' (SEQ ID NO: 1078)

5'-GCUUUACUCACCAGUCUGAACUUga-3' (SEQ ID NO: 311)

3'-UACGAAAUGAGUGGUCAGACUUGAACU-5' (SEQ ID NO: 695)

C5-3814 Target:
5'-ATGCTTTACTCACCAGTCTGAACTTGA-3' (SEQ ID NO: 1079)

5'-CUUUACUCACCAGUCUGAACUUGaa-3' (SEQ ID NO: 312)

3'-ACGAAAUGAGUGGUCAGACUUGAACUU-5' (SEQ ID NO: 696)

C5-3815 Target:
5'-TGCTTTACTCACCAGTCTGAACTTGAA-3' (SEQ ID NO: 1080)

5'-CUCACCAGUCUGAACUUGAAAGAta-3' (SEQ ID NO: 313)

3'-AUGAGUGGUCAGACUUGAACUUUCUAU-5' (SEQ ID NO: 697)

C5-3820 Target:
5'-TACTCACCAGTCTGAACTTGAAAGATA-3' (SEQ ID NO: 1081)

5'-CCAGUCUGAACUUGAAAGAUAUAaa-3' (SEQ ID NO: 314)

3'-GUGGUCAGACUUGAACUUUCUAUAUUU-5' (SEQ ID NO: 698)

C5-3824 Target:
5'-CACCAGTCTGAACTTGAAAGATATAAA-3' (SEQ ID NO: 1082)

5'-GAAGAGCAGAGGUAUGGAGGUGGct-3' (SEQ ID NO: 315)

3'-GUCUUCUCGUCUCCAUACCUCCACCGA-5' (SEQ ID NO: 699)

C5-3880 Target:
5'-CAGAAGAGCAGAGGTATGGAGGTGGCT-3' (SEQ ID NO: 1083)

5'-AAGAGCAGAGGUAUGGAGGUGGCtt-3' (SEQ ID NO: 316)

3'-UCUUCUCGUCUCCAUACCUCCACCGAA-5' (SEQ ID NO: 700)

C5-3881 Target:
5'-AGAAGAGCAGAGGTATGGAGGTGGCTT-3' (SEQ ID NO: 1084)

5'-GAAUAUUCACUCCUGGUUAAACAac-3' (SEQ ID NO: 317)

3'-GCCUUAUAAGUGAGGACCAAUUUGUUG-5' (SEQ ID NO: 701)

TABLE 2-continued

Selected Human Anti-05 DsiRNA Agents (Asymmetrics)

C5-3949 Target:
5'-CGGAATATTCACTCCTGGTTAAACAAC-3' (SEQ ID NO: 1085)

5'-CCUUACAUAAUUAUAAAAUGACAga-3' (SEQ ID NO: 318)

3'-ACGGAAUGUAUUAAUAUUUUACUGUCU-5' (SEQ ID NO: 702)

C5-4019 Target:
5'-TGCCTTACATAATTATAAAATGACAGA-3' (SEQ ID NO: 1086)

5'-CAUGUAACAACUGUAGUUCACAAaa-3' (SEQ ID NO: 319)

3'-AUGUACAUUGUUGACAUCAAGUGUUUU-5' (SEQ ID NO: 703)

C5-4132 Target:
5'-TACATGTAACAACTGTAGTTCACAAAA-3' (SEQ ID NO: 1087)

5'-GAGGAAGUUUGCAGCUUUUAUUUga-3' (SEQ ID NO: 320)

3'-GACUCCUUCAAACGUCGAAAAUAAACU-5' (SEQ ID NO: 704)

C5-4168 Target:
5'-CTGAGGAAGTTTGCAGCTTTTATTTGA-3' (SEQ ID NO: 1088)

5'-AGGAAGUUUGCAGCUUUUAUUUGaa-3' (SEQ ID NO: 321)

3'-ACUCCUUCAAACGUCGAAAAUAAACUU-5' (SEQ ID NO: 705)

C5-4169 Target:
5'-TGAGGAAGTTTGCAGCTTTTATTTGAA-3' (SEQ ID NO: 1089)

5'-GGAAGUUUGCAGCUUUUAUUUGAaa-3' (SEQ ID NO: 322)

3'-CUCCUUCAAACGUCGAAAAUAAACUUU-5' (SEQ ID NO: 706)

C5-4170 Target:
5'-GAGGAAGTTTGCAGCTTTTATTTGAAA-3' (SEQ ID NO: 1090)

5'-GAAGUUUGCAGCUUUUAUUUGAaa-3' (SEQ ID NO: 323)

3'-UCCUUCAAACGUCGAAAAUAAACUUUU-5' (SEQ ID NO: 707)

C5-4171 Target:
5'-AGGAAGTTTGCAGCTTTTATTTGAAAA-3' (SEQ ID NO: 1091)

5'-AAGUUUGCAGCUUUUAUUUGAAAat-3' (SEQ ID NO: 324)

3'-CCUUCAAACGUCGAAAAUAAACUUUUA-5' (SEQ ID NO: 708)

C5-4172 Target:
5'-GGAAGTTTGCAGCTTTTATTTGAAAAT-3' (SEQ ID NO: 1092)

5'-AGUUUGCAGCUUUUAUUUGAAAAtc-3' (SEQ ID NO: 325)

3'-CUUCAAACGUCGAAAAUAAACUUUUAG-5' (SEQ ID NO: 709)

C5-4173 Target:
5'-GAAGTTTGCAGCTTTTATTTGAAAATC-3' (SEQ ID NO: 1093)

5'-GUUUGCAGCUUUUAUUUGAAAAUcg-3' (SEQ ID NO: 326)

3'-UUCAAACGUCGAAAAUAAACUUUUAGC-5' (SEQ ID NO: 710)

C5-4174 Target:
5'-AAGTTTGCAGCTTTTATTTGAAAATCG-3' (SEQ ID NO: 1094)

5'-UUUGCAGCUUUUAUUUGAAAAUCga-3' (SEQ ID NO: 327)

3'-UCAAACGUCGAAAAUAAACUUUUAGCU-5' (SEQ ID NO: 711)

C5-4175 Target:
5'-AGTTTGCAGCTTTTATTTGAAAATCGA-3' (SEQ ID NO: 1095)

5'-GCAGCUUUUAUUUGAAAAUCGAUac-3' (SEQ ID NO: 328)

3'-AACGUCGAAAAUAAACUUUUAGCUAUG-5' (SEQ ID NO: 712)

TABLE 2-continued

Selected Human Anti-05 DsiRNA Agents (Asymmetrics)

C5-4178 Target:
5'-TTGCAGCTTTTATTTGAAAATCGATAC-3' (SEQ ID NO: 1096)

5'-AUACUCAGGAUAUUGAAGCAUCCca-3' (SEQ ID NO: 329)

3'-GCUAUGAGUCCUAUAACUUCGUAGGGU-5' (SEQ ID NO: 713)

C5-4199 Target:
5'-CGATACTCAGGATATTGAAGCATCCCA-3' (SEQ ID NO: 1097)

5'-CAGGAUAUUGAAGCAUCCCACUAca-3' (SEQ ID NO: 330)

3'-GAGUCCUAUAACUUCGUAGGGUGAUGU-5' (SEQ ID NO: 714)

C5-4204 Target:
5'-CTCAGGATATTGAAGCATCCCACTACA-3' (SEQ ID NO: 1098)

5'-UAGCAUGUGCCAGCUACAAGCCCag-3' (SEQ ID NO: 331)

3'-UCAUCGUACACGGUCGAUGUUCGGGUC-5' (SEQ ID NO: 715)

C5-4262 Target:
5'-AGTAGCATGTGCCAGCTACAAGCCCAG-3' (SEQ ID NO: 1099)

5'-AGCAUGUGCCAGCUACAAGCCCAgc-3' (SEQ ID NO: 332)

3'-CAUCGUACACGGUCGAUGUUCGGGUCG-5' (SEQ ID NO: 716)

C5-4263 Target:
5'-GTAGCATGTGCCAGCTACAAGCCCAGC-3' (SEQ ID NO: 1100)

5'-GCAUGUGCCAGCUACAAGCCCAGca-3' (SEQ ID NO: 333)

3'-AUCGUACACGGUCGAUGUUCGGGUCGU-5' (SEQ ID NO: 717)

C5-4264 Target:
5'-TAGCATGTGCCAGCTACAAGCCCAGCA-3' (SEQ ID NO: 1101)

5'-CAUGUGCCAGCUACAAGCCCAGCag-3' (SEQ ID NO: 334)

3'-UCGUACACGGUCGAUGUUCGGGUCGUC-5' (SEQ ID NO: 718)

C5-4265 Target:
5'-AGCATGTGCCAGCTACAAGCCCAGCAG-3' (SEQ ID NO: 1102)

5'-AUGUGCCAGCUACAAGCCCAGCAgg-3' (SEQ ID NO: 335)

3'-CGUACACGGUCGAUGUUCGGGUCGUCC-5' (SEQ ID NO: 719)

C5-4266 Target:
5'-GCATGTGCCAGCTACAAGCCCAGCAGG-3' (SEQ ID NO: 1103)

5'-UGUGCCAGCUACAAGCCCAGCAGgg-3' (SEQ ID NO: 336)

3'-GUACACGGUCGAUGUUCGGGUCGUCCC-5' (SEQ ID NO: 720)

C5-4267 Target:
5'-CATGTGCCAGCTACAAGCCCAGCAGGG-3' (SEQ ID NO: 1104)

5'-GUGCCAGCUACAAGCCCAGCAGGga-3' (SEQ ID NO: 337)

3'-UACACGGUCGAUGUUCGGGUCGUCCCU-5' (SEQ ID NO: 721)

C5-4268 Target:
5'-ATGTGCCAGCTACAAGCCCAGCAGGGA-3' (SEQ ID NO: 1105)

5'-UGCCAGCUACAAGCCCAGCAGGGaa-3' (SEQ ID NO: 338)

3'-ACACGGUCGAUGUUCGGGUCGUCCCUU-5' (SEQ ID NO: 722)

C5-4269 Target:
5'-TGTGCCAGCTACAAGCCCAGCAGGGAA-3' (SEQ ID NO: 1106)

5'-GCCAGCUACAAGCCCAGCAGGGAag-3' (SEQ ID NO: 339)

3'-CACGGUCGAUGUUCGGGUCGUCCCUUC-5' (SEQ ID NO: 723)

TABLE 2-continued

Selected Human Anti-O5 DsiRNA Agents (Asymmetrics)

C5-4270 Target:
5'-GTGCCAGCTACAAGCCCAGCAGGGAAG-3' (SEQ ID NO: 1107)

5'-GAUGGACAUGUUAUUCUGCAACUga-3' (SEQ ID NO: 340)

3'-UUCUACCUGUACAAUAAGACGUUGACU-5' (SEQ ID NO: 724)

C5-4423 Target:
5'-AAGATGGACATGTTATTCTGCAACTGA-3' (SEQ ID NO: 1108)

5'-AUGGACAUGUUAUUCUGCAACUGaa-3' (SEQ ID NO: 341)

3'-UCUACCUGUACAAUAAGACGUUGACUU-5' (SEQ ID NO: 725)

C5-4424 Target:
5'-AGATGGACATGTTATTCTGCAACTGAA-3' (SEQ ID NO: 1109)

5'-GGACAUGUUAUUCUGCAACUGAAtt-3' (SEQ ID NO: 342)

3'-UACCUGUACAAUAAGACGUUGACUUAA-5' (SEQ ID NO: 726)

C5-4426 Target:
5'-ATGGACATGTTATTCTGCAACTGAATT-3' (SEQ ID NO: 1110)

5'-ACAUGUUAUUCUGCAACUGAAUUcg-3' (SEQ ID NO: 343)

3'-CCUGUACAAUAAGACGUUGACUUAAGC-5' (SEQ ID NO: 727)

C5-4428 Target:
5'-GGACATGTTATTCTGCAACTGAATTCG-3' (SEQ ID NO: 1111)

5'-CAUGUUAUUCUGCAACUGAAUUCga-3' (SEQ ID NO: 344)

3'-CUGUACAAUAAGACGUUGACUUAAGCU-5' (SEQ ID NO: 728)

C5-4429 Target:
5'-GACATGTTATTCTGCAACTGAATTCGA-3' (SEQ ID NO: 1112)

5'-AUGUUAUUCUGCAACUGAAUUCGat-3' (SEQ ID NO: 345)

3'-UGUACAAUAAGACGUUGACUUAAGCUA-5' (SEQ ID NO: 729)

C5-4430 Target:
5'-ACATGTTATTCTGCAACTGAATTCGAT-3' (SEQ ID NO: 1113)

5'-AUUCUGCAACUGAAUUCGAUUCCct-3' (SEQ ID NO: 346)

3'-AAUAAGACGUUGACUUAAGCUAAGGGA-5' (SEQ ID NO: 730)

C5-4435 Target:
5'-TTATTCTGCAACTGAATTCGATTCCCT-3' (SEQ ID NO: 1114)

5'-UUCUGCAACUGAAUUCGAUUCCCtc-3' (SEQ ID NO: 347)

3'-AUAAGACGUUGACUUAAGCUAAGGGAG-5' (SEQ ID NO: 731)

C5-4436 Target:
5'-TATTCTGCAACTGAATTCGATTCCCTC-3' (SEQ ID NO: 1115)

5'-GAUAAACAGUGUACCAUGUUUUAta-3' (SEQ ID NO: 348)

3'-GUCUAUUUGUCACAUGGUACAAAAUAU-5' (SEQ ID NO: 732)

C5-4558 Target:
5'-CAGATAAACAGTGTACCATGTTTTATA-3' (SEQ ID NO: 1116)

5'-AUAAACAGUGUACCAUGUUUUAUag-3' (SEQ ID NO: 349)

3'-UCUAUUUGUCACAUGGUACAAAAUAUC-5' (SEQ ID NO: 733)

C5-4559 Target:
5'-AGATAAACAGTGTACCATGTTTTATAG-3' (SEQ ID NO: 1117)

5'-AAACAGUGUACCAUGUUUUAUAGca-3' (SEQ ID NO: 350)

3'-UAUUUGUCACAUGGUACAAAAUAUCGU-5' (SEQ ID NO: 734)

C5-4561 Target:
5'-ATAAACAGTGTACCATGTTTTATAGCA-3' (SEQ ID NO: 1118)

5'-ACAGUGUACCAUGUUUUAUAGCAct-3' (SEQ ID NO: 351)

3'-UUUGUCACAUGGUACAAAAUAUCGUGA-5' (SEQ ID NO: 735)

C5-4563 Target:
5'-AAACAGTGTACCATGTTTTATAGCACT-3' (SEQ ID NO: 1119)

5'-AUAGCACUUCCAAUAUCAAAAUUca-3' (SEQ ID NO: 352)

3'-AAUAUCGUGAAGGUUAUAGUUUUAAGU-5' (SEQ ID NO: 736)

C5-4580 Target:
5'-TTATAGCACTTCCAATATCAAAATTCA-3' (SEQ ID NO: 1120)

5'-UUCAGAAAGUCUGUGAAGGAGCCgc-3' (SEQ ID NO: 353)

3'-UUAAGUCUUUCAGACACUUCCUCGGCG-5' (SEQ ID NO: 737)

C5-4601 Target:
5'-AATTCAGAAAGTCTGTGAAGGAGCCGC-3' (SEQ ID NO: 1121)

5'-UCAGAAAGUCUGUGAAGGAGCCGcg-3' (SEQ ID NO: 354)

3'-UAAGUCUUUCAGACACUUCCUCGGCGC-5' (SEQ ID NO: 738)

C5-4602 Target:
5'-ATTCAGAAAGTCTGTGAAGGAGCCGCG-3' (SEQ ID NO: 1122)

5'-CAGAAAGUCUGUGAAGGAGCCGCgt-3' (SEQ ID NO: 355)

3'-AAGUCUUUCAGACACUUCCUCGGCGCA-5' (SEQ ID NO: 739)

C5-4603 Target:
5'-TTCAGAAAGTCTGTGAAGGAGCCGCGT-3' (SEQ ID NO: 1123)

5'-AGAAAGUCUGUGAAGGAGCCGCGtg-3' (SEQ ID NO: 356)

3'-AGUCUUUCAGACACUUCCUCGGCGCAC-5' (SEQ ID NO: 740)

C5-4604 Target:
5'-TCAGAAAGTCTGTGAAGGAGCCGCGTG-3' (SEQ ID NO: 1124)

5'-CCAGAGAUUGCAUAUGCUUAUAAag-3' (SEQ ID NO: 357)

3'-UUGGUCUCUAACGUAUACGAAUAUUUC-5' (SEQ ID NO: 741)

C5-4717 Target:
5'-AACCAGAGATTGCATATGCTTATAAAG-3' (SEQ ID NO: 1125)

5'-CAGAGAUUGCAUAUGCUUAUAAAgt-3' (SEQ ID NO: 358)

3'-UGGUCUCUAACGUAUACGAAUAUUUCA-5' (SEQ ID NO: 742)

C5-4718 Target:
5'-ACCAGAGATTGCATATGCTTATAAAGT-3' (SEQ ID NO: 1126)

5'-AGAGAUUGCAUAUGCUUAUAAAGtt-3' (SEQ ID NO: 359)

3'-GGUCUCUAACGUAUACGAAUAUUCAA-5' (SEQ ID NO: 743)

C5-4719 Target:
5'-CCAGAGATTGCATATGCTTATAAAGTT-3' (SEQ ID NO: 1127)

5'-GAGAUUGCAUAUGCUUAUAAAGUta-3' (SEQ ID NO: 360)

3'-GUCUCUAACGUAUACGAAUAUUUCAAU-5' (SEQ ID NO: 744)

C5-4720 Target:
5'-CAGAGATTGCATATGCTTATAAAGTTA-3' (SEQ ID NO: 1128)

5'-AGAUUGCAUAUGCUUAUAAAGUUag-3' (SEQ ID NO: 361)

3'-UCUCUAACGUAUACGAAUAUUUCAAUC-5' (SEQ ID NO: 745)

TABLE 2-continued

Selected Human Anti-05 DsiRNA Agents (Asymmetrics)

C5-4721 Target:
5'-AGAGATTGCATATGCTTATAAAGTTAG-3' (SEQ ID NO: 1129)

5'-AGAAAAUGUUUUUGUCAAGUACAag-3' (SEQ ID NO: 362)

3'-CAUCUUUUACAAAAACAGUUCAUGUUC-5' (SEQ ID NO: 746)

C5-4764 Target:
5'-GTAGAAAATGTTTTTGTCAAGTACAAG-3' (SEQ ID NO: 1130)

5'-GAAAAUGUUUUUGUCAAGUACAgg-3' (SEQ ID NO: 363)

3'-AUCUUUUACAAAAACAGUUCAUGUUCC-5' (SEQ ID NO: 747)

C5-4765 Target:
5'-TAGAAAATGTTTTTGTCAAGTACAAGG-3' (SEQ ID NO: 1131)

5'-AAAAUGUUUUUGUCAAGUACAAGgc-3' (SEQ ID NO: 364)

3'-UCUUUUACAAAAACAGUUCAUGUUCCG-5' (SEQ ID NO: 748)

C5-4766 Target:
5'-AGAAAATGTTTTTGTCAAGTACAAGGC-3' (SEQ ID NO: 1132)

5'-AAAUGUUUUUGUCAAGUACAAGGca-3' (SEQ ID NO: 365)

3'-CUUUUACAAAAACAGUUCAUGUUCCGU-5' (SEQ ID NO: 749)

C5-4767 Target:
5'-GAAAATGTTTTTGTCAAGTACAAGGCA-3' (SEQ ID NO: 1133)

5'-AAUGUUUUUGUCAAGUACAAGGCaa-3' (SEQ ID NO: 366)

3'-UUUUACAAAAACAGUUCAUGUUCCGUU-5' (SEQ ID NO: 750)

C5-4768 Target:
5'-AAAATGTTTTTGTCAAGTACAAGGCAA-3' (SEQ ID NO: 1134)

5'-CCAGAUAAAAUACAAUUUCAGUUtc-3' (SEQ ID NO: 367)

3'-GAGGUCUAUUUUAUGUUAAAGUCAAAG-5' (SEQ ID NO: 751)

C5-4929 Target:
5'-CTCCAGATAAAATACAATTTCAGTTTC-3' (SEQ ID NO: 1135)

5'-AUGUUCAUCGUGUCAAGCAUUUUta-3' (SEQ ID NO: 368)

3'-UGUACAAGUAGCACAGUUCGUAAAAAU-5' (SEQ ID NO: 752)

C5-5013 Target:
5'-ACATGTTCATCGTGTCAAGCATTTTTA-3' (SEQ ID NO: 1136)

5'-CAUCGUGUCAAGCAUUUUUAGCUaa-3' (SEQ ID NO: 369)

3'-AAGUAGCACAGUUCGUAAAAAUCGAUU-5' (SEQ ID NO: 753)

C5-5018 Target:
5'-TTCATCGTGTCAAGCATTTTTAGCTAA-3' (SEQ ID NO: 1137)

5'-GUGUCAAGCAUUUUUAGCUAAUUta-3' (SEQ ID NO: 370)

3'-AGCACAGUUCGUAAAAAUCGAUUAAAU-5' (SEQ ID NO: 754)

C5-5022 Target:
5'-TCGTGTCAAGCATTTTTAGCTAATTTA-3' (SEQ ID NO: 1138)

5'-AAGCAUUUUUAGCUAAUUUAGAUga-3' (SEQ ID NO: 371)

3'-AGUUCGUAAAAAUCGAUUAAAUCUACU-5' (SEQ ID NO: 755)

C5-5027 Target:
5'-TCAAGCATTTTTAGCTAATTTAGATGA-3' (SEQ ID NO: 1139)

5'-UGGAUGCUAAAAUUCCUGAAGUUca-3' (SEQ ID NO: 372)

3'-UUACCUACGAUUUUAAGGACUUCAAGU-5' (SEQ ID NO: 756)

C5-5076 Target:
5'-AATGGATGCTAAAATTCCTGAAGTTCA-3' (SEQ ID NO: 1140)

5'-AUGGACUCCUGUUGUUGAAGUUCgt-3' (SEQ ID NO: 373)

3'-AAUACCUGAGGACAACAACUUCAAGCA-5' (SEQ ID NO: 757)

C5-5121 Target:
5'-TTATGGACTCCTGTTGTTGAAGTTCGT-3' (SEQ ID NO: 1141)

5'-GGACUCCUGUUGUUGAAGUUCGUtt-3' (SEQ ID NO: 374)

3'-UACCUGAGGACAACAACUUCAAGCAAA-5' (SEQ ID NO: 758)

C5-5123 Target:
5'-ATGGACTCCTGTTGTTGAAGTTCGTTT-3' (SEQ ID NO: 1142)

5'-GACUCCUGUUGUUGAAGUUCGUtt-3' (SEQ ID NO: 375)

3'-ACCUGAGGACAACAACUUCAAGCAAAA-5' (SEQ ID NO: 759)

C5-5124 Target:
5'-TGGACTCCTGTTGTTGAAGTTCGTTTT-3' (SEQ ID NO: 1143)

5'-UUGCUUUUAUUAGAGAAUGAUUUca-3' (SEQ ID NO: 376)

3'-UGAACGAAAAUAAUCUCUUACUAAAGU-5' (SEQ ID NO: 760)

C5-5224 Target:
5'-ACTTGCTTTTATTAGAGAATGATTTCA-3' (SEQ ID NO: 1144)

5'-UGCUUUUAUUAGAGAAUGAUUUCaa-3' (SEQ ID NO: 377)

3'-GAACGAAAAUAAUCUCUUACUAAAGUU-5' (SEQ ID NO: 761)

C5-5225 Target:
5'-CTTGCTTTTATTAGAGAATGATTTCAA-3' (SEQ ID NO: 1145)

5'-GCUUUUAUUAGAGAAUGAUUUCAaa-3' (SEQ ID NO: 378)

3'-AACGAAAAUAAUCUCUUACUAAAGUUU-5' (SEQ ID NO: 762)

C5-5226 Target:
5'-TTGCTTTTATTAGAGAATGATTTCAAA-3' (SEQ ID NO: 1146)

5'-CUUUUAUUAGAGAAUGAUUUCAAat-3' (SEQ ID NO: 379)

3'-ACGAAAAUAAUCUCUUACUAAAGUUUA-5' (SEQ ID NO: 763)

C5-5227 Target:
5'-TGCTTTTATTAGAGAATGATTTCAAAT-3' (SEQ ID NO: 1147)

5'-CAGAUACUCCUCCAAGGUUAUUGga-3' (SEQ ID NO: 380)

3'-CUGUCUAUGAGGAGGUUCCAAUAACCU-5' (SEQ ID NO: 764)

C5-5295 Target:
5'-GACAGATACTCCTCCAAGGTTATTGGA-3' (SEQ ID NO: 1148)

5'-CAUUAAAGCCUGAGUUUGCUUUCaa-3' (SEQ ID NO: 381)

3'-UAGUAAUUUCGGACUCAAACGAAAGUU-5' (SEQ ID NO: 765)

C5-5464 Target:
5'-ATCATTAAAGCCTGAGTTTGCTTTCAA-3' (SEQ ID NO: 1149)

5'-AUUAAAGCCUGAGUUUGCUUUCAaa-3' (SEQ ID NO: 382)

3'-AGUAAUUUCGGACUCAAACGAAAGUUU-5' (SEQ ID NO: 766)

C5-5465 Target:
5'-TCATTAAAGCCTGAGTTTGCTTTCAAA-3' (SEQ ID NO: 1150)

5'-AAAGCCUGAGUUUGCUUUCAAAaa-3' (SEQ ID NO: 383)

3'-AAUUUCGGACUCAAACGAAAGUUUUU-5' (SEQ ID NO: 767)

TABLE 2-continued

Selected Human Anti-05 DsiRNA Agents (Asymmetrics)

C5-5468 Target:
5'-TTAAAGCCTGAGTTTGCTTTCAAAAAA-3' (SEQ ID NO: 1151)

5'-A<u>A</u><u>G</u><u>C</u>CUGAGUUUG<u>C</u>UUUCAAAAAaa-3' (SEQ ID NO: 384)

3'-<u>A</u><u>U</u><u>U</u><u>U</u>CGGACUCAAA<u>C</u>GAAAGUUU<u>UUUU</u>-5' (SEQ ID NO: 768)

C5-5469 Target:
5'-TAAAGCCTGAGTTTGCTTTCAAAAAAA-3' (SEQ ID NO: 1152)

TABLE 3

Selected Human Anti-C5 DsiRNAs, Unmodified Duplexes (Asymmetrics)

5'-AUAUGUCAUUUCAGCACCAAAAAUA-3' (SEQ ID NO: 1153)
3'-UGUAUACAGUAAAGUCGUGGUUUUUAU-5' (SEQ ID NO: 385)

C5-120 Target:
5'-ACATATGTCATTTCAGCACCAAAAATA-3' (SEQ ID NO: 769)

5'-AUUGUGAUUCAAGUUUAUGGAUACA-3' (SEQ ID NO: 1154)
3'-UAUAACACUAAGUUCAAAUACCUAUGU-5' (SEQ ID NO: 386)

C5-169 Target:
5'-ATATTGTGATTCAAGTTTATGGATACA-3' (SEQ ID NO: 770)

5'-UUGUGAUUCAAGUUUAUGGAUACAC-3' (SEQ ID NO: 1155)
3'-AUAACACUAAGUUCAAAUACCUAUGUG-5' (SEQ ID NO: 387)

C5-170 Target:
5'-TATTGTGATTCAAGTTTATGGATACAC-3' (SEQ ID NO: 771)

5'-UGUGAUUCAAGUUUAUGGAUACACU-3' (SEQ ID NO: 1156)
3'-UAACACUAAGUUCAAAUACCUAUGUGA-5' (SEQ ID NO: 388)

C5-171 Target:
5'-ATTGTGATTCAAGTTTATGGATACACT-3' (SEQ ID NO: 772)

5'-GUGAUUCAAGUUUAUGGAUACACUG-3' (SEQ ID NO: 1157)
3'-AACACUAAGUUCAAAUACCUAUGUGAC-5' (SEQ ID NO: 389)

C5-172 Target:
5'-TTGTGATTCAAGTTTATGGATACACTG-3' (SEQ ID NO: 773)

5'-UGAUUCAAGUUUAUGGAUACACUGA-3' (SEQ ID NO: 1158)
3'-ACACUAAGUUCAAAUACCUAUGUGACU-5' (SEQ ID NO: 390)

C5-173 Target:
5'-TGTGATTCAAGTTTATGGATACACTGA-3' (SEQ ID NO: 774)

5'-GAUUCAAGUUUAUGGAUACACUGAA-3' (SEQ ID NO: 1159)
3'-CACUAAGUUCAAAUACCUAUGUGACUU-5' (SEQ ID NO: 391)

C5-174 Target:
5'-GTGATTCAAGTTTATGGATACACTGAA-3' (SEQ ID NO: 775)

5'-AUUCAAGUUUAUGGAUACACUGAAG-3' (SEQ ID NO: 1160)
3'-ACUAAGUUCAAAUACCUAUGUGACUUC-5' (SEQ ID NO: 392)

C5-175 Target:
5'-TGATTCAAGTTTATGGATACACTGAAG-3' (SEQ ID NO: 776)

5'-UUCAAGUUUAUGGAUACACUGAAGC-3' (SEQ ID NO: 1161)
3'-CUAAGUUCAAAUACCUAUGUGACUUCG-5' (SEQ ID NO: 393)

C5-176 Target:
5'-GATTCAAGTTTATGGATACACTGAAGC-3' (SEQ ID NO: 777)

5'-UCAAGUUUAUGGAUACACUGAAGCA-3' (SEQ ID NO: 1162)
3'-UAAGUUCAAAUACCUAUGUGACUUCGU-5' (SEQ ID NO: 394)

TABLE 3-continued

Selected Human Anti-C5 DsiRNAs, Unmodified Duplexes (Asymmetrics)

C5-177 Target:
5'-ATTCAAGTTTATGGATACACTGAAGCA-3' (SEQ ID NO: 778)

5'-CAAGUUUAUGGAUACACUGAAGCAU-3' (SEQ ID NO: 1163)
3'-AAGUUCAAAUACCUAUGUGACUUCGUA-5' (SEQ ID NO: 395)

C5-178 Target:
5'-TTCAAGTTTATGGATACACTGAAGCAT-3' (SEQ ID NO: 779)

5'-AAGUUUAUGGAUACACUGAAGCAUU-3' (SEQ ID NO: 1164)
3'-AGUUCAAAUACCUAUGUGACUUCGUAA-5' (SEQ ID NO: 396)

C5-179 Target:
5'-TCAAGTTTATGGATACACTGAAGCATT-3' (SEQ ID NO: 780)

5'-AGUUUAUGGAUACACUGAAGCAUUU-3' (SEQ ID NO: 1165)
3'-GUUCAAAUACCUAUGUGACUUCGUAAA-5' (SEQ ID NO: 397)

C5-180 Target:
5'-CAAGTTTATGGATACACTGAAGCATTT-3' (SEQ ID NO: 781)

5'-UUUAUGGAUACACUGAAGCAUUUGA-3' (SEQ ID NO: 1166)
3'-UCAAAUACCUAUGUGACUUCGUAAACU-5' (SEQ ID NO: 398)

C5-182 Target:
5'-AGTTTATGGATACACTGAAGCATTTGA-3' (SEQ ID NO: 782)

5'-UUAUGGAUACACUGAAGCAUUUGAU-3' (SEQ ID NO: 1167)
3'-CAAAUACCUAUGUGACUUCGUAAACUA-5' (SEQ ID NO: 399)

C5-183 Target:
5'-GTTTATGGATACACTGAAGCATTTGAT-3' (SEQ ID NO: 783)

5'-AUGGAUACACUGAAGCAUUUGAUGC-3' (SEQ ID NO: 1168)
3'-AAUACCUAUGUGACUUCGUAAACUACG-5' (SEQ ID NO: 400)

C5-185 Target:
5'-TTATGGATACACTGAAGCATTTGATGC-3' (SEQ ID NO: 784)

5'-GGAUACACUGAAGCAUUUGAUGCAA-3' (SEQ ID NO: 1169)
3'-UACCUAUGUGACUUCGUAAACUACGUU-5' (SEQ ID NO: 401)

C5-187 Target:
5'-ATGGATACACTGAAGCATTTGATGCAA-3' (SEQ ID NO: 785)

5'-GAUACACUGAAGCAUUUGAUGCAAC-3' (SEQ ID NO: 1170)
3'-ACCUAUGUGACUUCGUAAACUACGUUG-5' (SEQ ID NO: 402)

C5-188 Target:
5'-TGGATACACTGAAGCATTTGATGCAAC-3' (SEQ ID NO: 786)

5'-AUACACUGAAGCAUUUGAUGCAACA-3' (SEQ ID NO: 1171)
3'-CCUAUGUGACUUCGUAAACUACGUUGU-5' (SEQ ID NO: 403)

C5-189 Target:
5'-GGATACACTGAAGCATTTGATGCAACA-3' (SEQ ID NO: 787)

5'-UACACUGAAGCAUUUGAUGCAACAA-3' (SEQ ID NO: 1172)
3'-CUAUGUGACUUCGUAAACUACGUUGUU-5' (SEQ ID NO: 404)

C5-190 Target:
5'-GATACACTGAAGCATTTGATGCAACAA-3' (SEQ ID NO: 788)

5'-ACACUGAAGCAUUUGAUGCAACAAU-3' (SEQ ID NO: 1173)
3'-UAUGUGACUUCGUAAACUACGUUGUUA-5' (SEQ ID NO: 405)

C5-191 Target:
5'-ATACACTGAAGCATTTGATGCAACAAT-3' (SEQ ID NO: 789)

5'-CACUGAAGCAUUUGAUGCAACAAUC-3' (SEQ ID NO: 1174)
3'-AUGUGACUUCGUAAACUACGUUGUUAG-5' (SEQ ID NO: 406)

TABLE 3-continued

Selected Human Anti-C5 DsiRNAs, Unmodified Duplexes (Asymmetrics)

C5-192 Target:
5'-TACACTGAAGCATTTGATGCAACAATC-3' (SEQ ID NO: 790)

5'-ACUGAAGCAUUUGAUGCAACAAUCU-3' (SEQ ID NO: 1175)
3'-UGUGACUUCGUAAACUACGUUGUUAGA-5' (SEQ ID NO: 407)

C5-193 Target:
5'-ACACTGAAGCATTTGATGCAACAATCT-3' (SEQ ID NO: 791)

5'-CUGAAGCAUUUGAUGCAACAAUCUC-3' (SEQ ID NO: 1176)
3'-GUGACUUCGUAAACUACGUUGUUAGAG-5' (SEQ ID NO: 408)

C5-194 Target:
5'-CACTGAAGCATTTGATGCAACAATCTC-3' (SEQ ID NO: 792)

5'-GAAGCAUUUGAUGCAACAAUCUCUA-3' (SEQ ID NO: 1177)
3'-GACUUCGUAAACUACGUUGUUAGAGAU-5' (SEQ ID NO: 409)

C5-196 Target:
5'-CTGAAGCATTTGATGCAACAATCTCTA-3' (SEQ ID NO: 793)

5'-AGCAUUUGAUGCAACAAUCUCUAUU-3' (SEQ ID NO: 1178)
3'-CUUCGUAAACUACGUUGUUAGAGAUAA-5' (SEQ ID NO: 410)

C5-198 Target:
5'-GAAGCATTTGATGCAACAATCTCTATT-3' (SEQ ID NO: 794)

5'-CAUUUGAUGCAACAAUCUCUAUUAA-3' (SEQ ID NO: 1179)
3'-UCGUAAACUACGUUGUUAGAGAUAAUU-5' (SEQ ID NO: 411)

C5-200 Target:
5'-AGCATTTGATGCAACAATCTCTATTAA-3' (SEQ ID NO: 795)

5'-UGAUGCAACAAUCUCUAUUAAAGU-3' (SEQ ID NO: 1180)
3'-AAACUACGUUGUUAGAGAUAAUUUUCA-5' (SEQ ID NO: 412)

C5-204 Target:
5'-TTTGATGCAACAATCTCTATTAAAGT-3' (SEQ ID NO: 796)

5'-GAUGCAACAAUCUCUAUUAAAGUU-3' (SEQ ID NO: 1181)
3'-AACUACGUUGUUAGAGAUAAUUUUCAA-5' (SEQ ID NO: 413)

C5-205 Target:
5'-TTGATGCAACAATCTCTATTAAAGTT-3' (SEQ ID NO: 797)

5'-AUGCAACAAUCUCUAUUAAAGUUA-3' (SEQ ID NO: 1182)
3'-ACUACGUUGUUAGAGAUAAUUUUCAAU-5' (SEQ ID NO: 414)

C5-206 Target:
5'-TGATGCAACAATCTCTATTAAAGTTA-3' (SEQ ID NO: 798)

5'-UGCAACAAUCUCUAUUAAAGUUAU-3' (SEQ ID NO: 1183)
3'-CUACGUUGUUAGAGAUAAUUUUCAAUA-5' (SEQ ID NO: 415)

C5-207 Target:
5'-GATGCAACAATCTCTATTAAAGTTAT-3' (SEQ ID NO: 799)

5'-ACAAUCUCUAUUAAAGUUAUCCUG-3' (SEQ ID NO: 1184)
3'-GUUGUUAGAGAUAAUUUUCAAUAGGAC-5' (SEQ ID NO: 416)

C5-211 Target:
5'-CAACAATCTCTATTAAAGTTATCCTG-3' (SEQ ID NO: 800)

5'-CAAUCUCUAUUAAAGUUAUCCUGA-3' (SEQ ID NO: 1185)
3'-UUGUUAGAGAUAAUUUUCAAUAGGACU-5' (SEQ ID NO: 417)

C5-212 Target:
5'-AACAATCTCTATTAAAGTTATCCTGA-3' (SEQ ID NO: 801)

5'-CUAUUAAAGUUAUCCUGAUAAAAA-3' (SEQ ID NO: 1186)
3'-GAGAUAAUUUUCAAUAGGACUAUUUUU-5' (SEQ ID NO: 418)

C5-218 Target:
5'-CTCTATTAAAGTTATCCTGATAAAAA-3' (SEQ ID NO: 802)

5'-AUUAAAAGUUAUCCUGAUAAAAAU-3' (SEQ ID NO: 1187)
3'-GAUAAUUUUCAAUAGGACUAUUUUUUA-5' (SEQ ID NO: 419)

C5-220 Target:
5'-CTATTAAAAGTTATCCTGATAAAAAAT-3' (SEQ ID NO: 803)

5'-AAAAGUUAUCCUGAUAAAAAAUUUA-3' (SEQ ID NO: 1188)
3'-AAUUUUCAAUAGGACUAUUUUUUAAAU-5' (SEQ ID NO: 420)

C5-223 Target:
5'-TTAAAAGTTATCCTGATAAAAAATTTA-3' (SEQ ID NO: 804)

5'-AAAGUUAUCCUGAUAAAAAAUUUAG-3' (SEQ ID NO: 1189)
3'-AUUUUCAAUAGGACUAUUUUUUAAAUC-5' (SEQ ID NO: 421)

C5-224 Target:
5'-TAAAAGTTATCCTGATAAAAAATTTAG-3' (SEQ ID NO: 805)

5'-GUUAUCCUGAUAAAAAAUUUAGUUA-3' (SEQ ID NO: 1190)
3'-UUCAAUAGGACUAUUUUUUAAAUCAAU-5' (SEQ ID NO: 422)

C5-227 Target:
5'-AAGTTATCCTGATAAAAAATTTAGTTA-3' (SEQ ID NO: 806)

5'-UUAUCCUGAUAAAAAAUUUAGUUAC-3' (SEQ ID NO: 1191)
3'-UCAAUAGGACUAUUUUUUAAAUCAAUG-5' (SEQ ID NO: 423)

C5-228 Target:
5'-AGTTATCCTGATAAAAAATTTAGTTAC-3' (SEQ ID NO: 807)

5'-GUUCAUUUAUCCUCAGAGAAUAAAU-3' (SEQ ID NO: 1192)
3'-UACAAGUAAAUAGGAGUCUCUUAUUUA-5' (SEQ ID NO: 424)

C5-265 Target:
5'-ATGTTCATTTATCCTCAGAGAATAAAT-3' (SEQ ID NO: 808)

5'-UUCAUUUAUCCUCAGAGAAUAAAUU-3' (SEQ ID NO: 1193)
3'-ACAAGUAAAUAGGAGUCUCUUAUUUAA-5' (SEQ ID NO: 425)

C5-266 Target:
5'-TGTTCATTTATCCTCAGAGAATAAATT-3' (SEQ ID NO: 809)

5'-GUAUUUGGAAGUUGUAUCAAAGCAU-3' (SEQ ID NO: 1194)
3'-CACAUAAACCUUCAACAUAGUUUCGUA-5' (SEQ ID NO: 426)

C5-360 Target:
5'-GTGTATTTGGAAGTTGTATCAAAGCAT-3' (SEQ ID NO: 810)

5'-UAUUUGGAAGUUGUAUCAAAGCAUU-3' (SEQ ID NO: 1195)
3'-ACAUAAACCUUCAACAUAGUUUCGUAA-5' (SEQ ID NO: 427)

C5-361 Target:
5'-TGTATTTGGAAGTTGTATCAAAGCATT-3' (SEQ ID NO: 811)

5'-UUGGAAGUUGUAUCAAAGCAUUUUU-3' (SEQ ID NO: 1196)
3'-UAAACCUUCAACAUAGUUUCGUAAAAA-5' (SEQ ID NO: 428)

C5-364 Target:
5'-ATTTGGAAGTTGTATCAAAGCATTTTT-3' (SEQ ID NO: 812)

5'-UGGAAGUUGUAUCAAAGCAUUUUUC-3' (SEQ ID NO: 1197)
3'-AAACCUUCAACAUAGUUUCGUAAAAAG-5' (SEQ ID NO: 429)

C5-365 Target:
5'-TTTGGAAGTTGTATCAAAGCATTTTTC-3' (SEQ ID NO: 813)

5'-GGAAGUUGUAUCAAAGCAUUUUUCA-3' (SEQ ID NO: 1198)
3'-AACCUUCAACAUAGUUUCGUAAAAAGU-5' (SEQ ID NO: 430)

C5-366 Target:
5'-TTGGAAGTTGTATCAAAGCATTTTTCA-3' (SEQ ID NO: 814)

5'-GAAGUUGUAUCAAAGCAUUUUUCAA-3' (SEQ ID NO: 1199)
3'-ACCUUCAACAUAGUUUCGUAAAAAGUU-5' (SEQ ID NO: 431)

C5-367 Target:
5'-TGGAAGTTGTATCAAAGCATTTTTCAA-3' (SEQ ID NO: 815)

5'-AAGUUGUAUCAAAGCAUUUUUCAAA-3' (SEQ ID NO: 1200)
3'-CCUUCAACAUAGUUUCGUAAAAAGUUU-5' (SEQ ID NO: 432)

TABLE 3-continued

Selected Human Anti-C5 DsiRNAs, Unmodified
Duplexes (Asymmetrics)

C5-368 Target:
5'-GGAAGTTGTATCAAAGCATTTTTCAAA-3' (SEQ ID NO: 816)

5'-AGUUGUAUCAAAGCAUUUUUCAAAA-3'  (SEQ ID NO: 1201)
3'-CUUCAACAUAGUUUCGUAAAAAGUUUU-5' (SEQ ID NO: 433)

C5-369 Target:
5'-GAAGTTGTATCAAAGCATTTTTCAAAA-3' (SEQ ID NO: 817)

5'-GUUGUAUCAAAGCAUUUUUCAAAAU-3'  (SEQ ID NO: 1202)
3'-UUCAACAUAGUUUCGUAAAAAGUUUUA-5' (SEQ ID NO: 434)

C5-370 Target:
5'-AAGTTGTATCAAAGCATTTTTCAAAAT-3' (SEQ ID NO: 818)

5'-UUGUAUCAAAGCAUUUUUCAAAAUC-3'  (SEQ ID NO: 1203)
3'-UCAACAUAGUUUCGUAAAAAGUUUUAG-5' (SEQ ID NO: 435)

C5-371 Target:
5'-AGTTGTATCAAAGCATTTTTCAAAATC-3' (SEQ ID NO: 819)

5'-UGUAUCAAAGCAUUUUUCAAAAUCA-3'  (SEQ ID NO: 1204)
3'-CAACAUAGUUUCGUAAAAAGUUUUAGU-5' (SEQ ID NO: 436)

C5-372 Target:
5'-GTTGTATCAAAGCATTTTTCAAAATCA-3' (SEQ ID NO: 820)

5'-GUAUCAAAGCAUUUUUCAAAAUCAA-3'  (SEQ ID NO: 1205)
3'-AACAUAGUUUCGUAAAAAGUUUUAGUU-5' (SEQ ID NO: 437)

C5-373 Target:
5'-TTGTATCAAAGCATTTTTCAAAATCAA-3' (SEQ ID NO: 821)

5'-AAUAACCUAUGACAAUGGAUUUCUC-3'  (SEQ ID NO: 1206)
3'-GGUUAUUGGAUACUGUUACCUAAAGAG-5' (SEQ ID NO: 438)

C5-408 Target:
5'-CCAATAACCTATGACAATGGATTTCTC-3' (SEQ ID NO: 822)

5'-CUAUGACAAUGGAUUUCUCUUCAUU-3'  (SEQ ID NO: 1207)
3'-UGGAUACUGUUACCUAAAGAGAAGUAA-5' (SEQ ID NO: 439)

C5-414 Target:
5'-ACCTATGACAATGGATTTCTCTTCATT-3' (SEQ ID NO: 823)

5'-GACAAUGGAUUUCUCUUCAUUCAUA-3'  (SEQ ID NO: 1208)
3'-UACUGUUACCUAAAGAGAAGUAAGUAU-5' (SEQ ID NO: 440)

C5-418 Target:
5'-ATGACAATGGATTTCTCTTCATTCATA-3' (SEQ ID NO: 824)

5'-ACAAUGGAUUUCUCUUCAUUCAUAC-3'  (SEQ ID NO: 1209)
3'-ACUGUUACCUAAAGAGAAGUAAGUAUG-5' (SEQ ID NO: 441)

C5-419 Target:
5'-TGACAATGGATTTCTCTTCATTCATAC-3' (SEQ ID NO: 825)

5'-CAAUGGAUUUCUCUUCAUUCAUACA-3'  (SEQ ID NO: 1210)
3'-CUGUUACCUAAAGAGAAGUAAGUAUGU-5' (SEQ ID NO: 442)

C5-420 Target:
5'-GACAATGGATTTCTCTTCATTCATACA-3' (SEQ ID NO: 826)

5'-AUGGAUUUCUCUUCAUUCAUACAGA-3'  (SEQ ID NO: 1211)
3'-GUUACCUAAAGAGAAGUAAGUAUGUCU-5' (SEQ ID NO: 443)

C5-422 Target:
5'-CAATGGATTTCTCTTCATTCATACAGA-3' (SEQ ID NO: 827)

5'-UGGAUUUCUCUUCAUUCAUACAGAC-3'  (SEQ ID NO: 1212)
3'-UUACCUAAAGAGAAGUAAGUAUGUCUG-5' (SEQ ID NO: 444)

C5-423 Target:
5'-AATGGATTTCTCTTCATTCATACAGAC-3' (SEQ ID NO: 828)

5'-GAUUUCUCUUCAUUCAUACAGACAA-3'  (SEQ ID NO: 1213)
3'-ACCUAAAGAGAAGUAAGUAUGUCUGUU-5' (SEQ ID NO: 445)

TABLE 3-continued

Selected Human Anti-C5 DsiRNAs, Unmodified
Duplexes (Asymmetrics)

C5-425 Target:
5'-TGGATTTCTCTTCATTCATACAGACAA-3' (SEQ ID NO: 829)

5'-AUUCAUACAGACAAACCUGUUUAUA-3'  (SEQ ID NO: 1214)
3'-AGUAAGUAUGUCUGUUUGGACAAAUAU-5' (SEQ ID NO: 446)

C5-436 Target:
5'-TCATTCATACAGACAAACCTGTTTATA-3' (SEQ ID NO: 830)

5'-UCAUACAGACAAACCUGUUUAUACU-3'  (SEQ ID NO: 1215)
3'-UAAGUAUGUCUGUUUGGACAAAUAUGA-5' (SEQ ID NO: 447)

C5-438 Target:
5'-ATTCATACAGACAAACCTGTTTATACT-3' (SEQ ID NO: 831)

5'-CAUACAGACAAACCUGUUUAUACUC-3'  (SEQ ID NO: 1216)
3'-AAGUAUGUCUGUUUGGACAAAUAUGAG-5' (SEQ ID NO: 448)

C5-439 Target:
5'-TTCATACAGACAAACCTGTTTATACTC-3' (SEQ ID NO: 832)

5'-AUACAGACAAACCUGUUUAUACUCC-3'  (SEQ ID NO: 1217)
3'-AGUAUGUCUGUUUGGACAAAUAUGAGG-5' (SEQ ID NO: 449)

C5-440 Target:
5'-TCATACAGACAAACCTGTTTATACTCC-3' (SEQ ID NO: 833)

5'-GUUAGAGUUUAUUCGUUGAAUGACG-3'  (SEQ ID NO: 1218)
3'-UUCAAUCUCAAAUAAGCAACUUACUGC-5' (SEQ ID NO: 450)

C5-481 Target:
5'-AAGTTAGAGTTTATTCGTTGAATGACG-3' (SEQ ID NO: 834)

5'-UGACGACUUGAAGCCAGCCAAAAGA-3'  (SEQ ID NO: 1219)
3'-UUACUGCUGAACUUCGGUCGGUUUUCU-5' (SEQ ID NO: 451)

C5-501 Target:
5'-AATGACGACTTGAAGCCAGCCAAAAGA-3' (SEQ ID NO: 835)

5'-GACGACUUGAAGCCAGCCAAAAGAG-3'  (SEQ ID NO: 1220)
3'-UACUGCUGAACUUCGGUCGGUUUUCUC-5' (SEQ ID NO: 452)

C5-502 Target:
5'-ATGACGACTTGAAGCCAGCCAAAAGAG-3' (SEQ ID NO: 836)

5'-ACGACUUGAAGCCAGCCAAAAGAGA-3'  (SEQ ID NO: 1221)
3'-ACUGCUGAACUUCGGUCGGUUUUCUCU-5' (SEQ ID NO: 453)

C5-503 Target:
5'-TGACGACTTGAAGCCAGCCAAAAGAGA-3' (SEQ ID NO: 837)

5'-CGACUUGAAGCCAGCCAAAAGAGAA-3'  (SEQ ID NO: 1222)
3'-CUGCUGAACUUCGGUCGGUUUUCUCUU-5' (SEQ ID NO: 454)

C5-504 Target:
5'-GACGACTTGAAGCCAGCCAAAAGAGAA-3' (SEQ ID NO: 838)

5'-AGAAACUGUCUUAACUUUCAUAGAU-3'  (SEQ ID NO: 1223)
3'-UCUCUUUGACAGAAUUGAAAGUAUCUA-5' (SEQ ID NO: 455)

C5-525 Target:
5'-AGAGAAACTGTCTTAACTTTCATAGAT-3' (SEQ ID NO: 839)

5'-ACUGUCUUAACUUUCAUAGAUCCUG-3'  (SEQ ID NO: 1224)
3'-UUUGACAGAAUUGAAAGUAUCUAGGAC-5' (SEQ ID NO: 456)

C5-529 Target:
5'-AAACTGTCTTAACTTTCATAGATCCTG-3' (SEQ ID NO: 840)

5'-CUGUCUUAACUUUCAUAGAUCCUGA-3'  (SEQ ID NO: 1225)
3'-UUGACAGAAUUGAAAGUAUCUAGGACU-5' (SEQ ID NO: 457)

C5-530 Target:
5'-AACTGTCTTAACTTTCATAGATCCTGA-3' (SEQ ID NO: 841)

5'-GAAGGAUCAGAAGUUGACAUGGUAG-3'  (SEQ ID NO: 1226)
3'-GACUUCCUAGUCUUCAACUGUACCAUC-5' (SEQ ID NO: 458)

TABLE 3-continued

Selected Human Anti-C5 DsiRNAs, Unmodified Duplexes (Asymmetrics)

C5-553 Target:
5'-CTGAAGGATCAGAAGTTGACATGGTAG-3' (SEQ ID NO: 842)

5'-AAGGAUCAGAAGUUGACAUGGUAGA-3' (SEQ ID NO: 1227)
3'-ACUUCCUAGUCUUCAACUGUACCAUCU-5' (SEQ ID NO: 459)

C5-554 Target:
5'-TGAAGGATCAGAAGTTGACATGGTAGA-3' (SEQ ID NO: 843)

5'-GACAUGGUAGAAGAAAUUGAUCAUA-3' (SEQ ID NO: 1228)
3'-AACUGUACCAUCUUCUUUAACUAGUAU-5' (SEQ ID NO: 460)

C5-568 Target:
5'-TTGACATGGTAGAAGAAATTGATCATA-3' (SEQ ID NO: 844)

5'-ACAUGGUAGAAGAAAUUGAUCAUAU-3' (SEQ ID NO: 1229)
3'-ACUGUACCAUCUUCUUUAACUAGUAUA-5' (SEQ ID NO: 461)

C5-569 Target:
5'-TGACATGGTAGAAGAAATTGATCATAT-3' (SEQ ID NO: 845)

5'-GGUAGAAGAAAUUGAUCAUAUUGGA-3' (SEQ ID NO: 1230)
3'-UACCAUCUUCUUUAACUAGUAUAACCU-5' (SEQ ID NO: 462)

C5-573 Target:
5'-ATGGTAGAAGAAATTGATCATATTGGA-3' (SEQ ID NO: 846)

5'-GUAGAAGAAAUUGAUCAUAUUGGAA-3' (SEQ ID NO: 1231)
3'-ACCAUCUUCUUUAACUAGUAUAACCUU-5' (SEQ ID NO: 463)

C5-574 Target:
5'-TGGTAGAAGAAATTGATCATATTGGAA-3' (SEQ ID NO: 847)

5'-AAGAAAUUGAUCAUAUUGGAAUUAU-3' (SEQ ID NO: 1232)
3'-UCUUCUUUAACUAGUAUAACCUUAAUA-5' (SEQ ID NO: 464)

C5-578 Target:
5'-AGAAGAAATTGATCATATTGGAATTAT-3' (SEQ ID NO: 848)

5'-AGAAAUUGAUCAUAUUGGAAUUAUC-3' (SEQ ID NO: 1233)
3'-CUUCUUUAACUAGUAUAACCUUAAUAG-5' (SEQ ID NO: 465)

C5-579 Target:
5'-GAAGAAATTGATCATATTGGAATTATC-3' (SEQ ID NO: 849)

5'-GGAAUUAUCUCUUUUCCUGACUUCA-3' (SEQ ID NO: 1234)
3'-AACCUUAAUAGAGAAAAGGACUGAAGU-5' (SEQ ID NO: 466)

C5-595 Target:
5'-TTGGAATTATCTCTTTTCCTGACTTCA-3' (SEQ ID NO: 850)

5'-GAAUUAUCUCUUUUCCUGACUUCAA-3' (SEQ ID NO: 1235)
3'-ACCUUAAUAGAGAAAAGGACUGAAGUU-5' (SEQ ID NO: 467)

C5-596 Target:
5'-TGGAATTATCTCTTTTCCTGACTTCAA-3' (SEQ ID NO: 851)

5'-AAUUAUCUCUUUUCCUGACUUCAAG-3' (SEQ ID NO: 1236)
3'-CCUUAAUAGAGAAAAGGACUGAAGUUC-5' (SEQ ID NO: 468)

C5-597 Target:
5'-GGAATTATCTCTTTTCCTGACTTCAAG-3' (SEQ ID NO: 852)

5'-AUUAUCUCUUUUCCUGACUUCAAGA-3' (SEQ ID NO: 1237)
3'-CUUAAUAGAGAAAAGGACUGAAGUUCU-5' (SEQ ID NO: 469)

C5-598 Target:
5'-GAATTATCTCTTTTCCTGACTTCAAGA-3' (SEQ ID NO: 853)

5'-UUAUCUCUUUUCCUGACUUCAAGAU-3' (SEQ ID NO: 1238)
3'-UUAAUAGAGAAAAGGACUGAAGUUCUA-5' (SEQ ID NO: 470)

C5-599 Target:
5'-AATTATCTCTTTTCCTGACTTCAAGAT-3' (SEQ ID NO: 854)

5'-UAUCUCUUUUCCUGACUUCAAGAUU-3' (SEQ ID NO: 1239)
3'-UAAUAGAGAAAAGGACUGAAGUUCUAA-5' (SEQ ID NO: 471)

TABLE 3-continued

Selected Human Anti-C5 DsiRNAs, Unmodified Duplexes (Asymmetrics)

C5-600 Target:
5'-ATTATCTCTTTTCCTGACTTCAAGATT-3' (SEQ ID NO: 855)

5'-AUCUCUUUUCCUGACUUCAAGAUUC-3' (SEQ ID NO: 1240)
3'-AAUAGAGAAAAGGACUGAAGUUCUAAG-5' (SEQ ID NO: 472)

C5-601 Target:
5'-TTATCTCTTTTCCTGACTTCAAGATTC-3' (SEQ ID NO: 856)

5'-UCUCUUUUCCUGACUUCAAGAUUCC-3' (SEQ ID NO: 1241)
3'-AUAGAGAAAAGGACUGAAGUUCUAAGG-5' (SEQ ID NO: 473)

C5-602 Target:
5'-TATCTCTTTTCCTGACTTCAAGATTCC-3' (SEQ ID NO: 857)

5'-CUCUUUUCCUGACUUCAAGAUUCCG-3' (SEQ ID NO: 1242)
3'-UAGAGAAAAGGACUGAAGUUCUAAGGC-5' (SEQ ID NO: 474)

C5-603 Target:
5'-ATCTCTTTTCCTGACTTCAAGATTCCG-3' (SEQ ID NO: 858)

5'-UCUUUUCCUGACUUCAAGAUUCCGU-3' (SEQ ID NO: 1243)
3'-AGAGAAAAGGACUGAAGUUCUAAGGCA-5' (SEQ ID NO: 475)

C5-604 Target:
5'-TCTCTTTTCCTGACTTCAAGATTCCGT-3' (SEQ ID NO: 859)

5'-CUUUUCCUGACUUCAAGAUUCCGUC-3' (SEQ ID NO: 1244)
3'-GAGAAAAGGACUGAAGUUCUAAGGCAG-5' (SEQ ID NO: 476)

C5-605 Target:
5'-CTCTTTTCCTGACTTCAAGATTCCGTC-3' (SEQ ID NO: 860)

5'-UUUUCCUGACUUCAAGAUUCCGUCU-3' (SEQ ID NO: 1245)
3'-AGAAAAGGACUGAAGUUCUAAGGCAGA-5' (SEQ ID NO: 477)

C5-606 Target:
5'-TCTTTTCCTGACTTCAAGATTCCGTCT-3' (SEQ ID NO: 861)

5'-UUUCCUGACUUCAAGAUUCCGUCUA-3' (SEQ ID NO: 1246)
3'-GAAAAGGACUGAAGUUCUAAGGCAGAU-5' (SEQ ID NO: 478)

C5-607 Target:
5'-CTTTTCCTGACTTCAAGATTCCGTCTA-3' (SEQ ID NO: 862)

5'-UUCCUGACUUCAAGAUUCCGUCUAA-3' (SEQ ID NO: 1247)
3'-AAAAGGACUGAAGUUCUAAGGCAGAUU-5' (SEQ ID NO: 479)

C5-608 Target:
5'-TTTTCCTGACTTCAAGATTCCGTCTAA-3' (SEQ ID NO: 863)

5'-UUAAAGAAUAUGUCUUGCCACAUUU-3' (SEQ ID NO: 1248)
3'-UCAAUUUCUUAUACAGAACGGUGUAAA-5' (SEQ ID NO: 480)

C5-710 Target:
5'-AGTTAAAGAATATGTCTTGCCACATTT-3' (SEQ ID NO: 864)

5'-UAAAGAAUAUGUCUUGCCACAUUUU-3' (SEQ ID NO: 1249)
3'-CAAUUUCUUAUACAGAACGGUGUAAAA-5' (SEQ ID NO: 481)

C5-711 Target:
5'-GTTAAAGAATATGTCTTGCCACATTTT-3' (SEQ ID NO: 865)

5'-AAAGAAUAUGUCUUGCCACAUUUUU-3' (SEQ ID NO: 1250)
3'-AAUUUCUUAUACAGAACGGUGUAAAAA-5' (SEQ ID NO: 482)

C5-712 Target:
5'-TTAAAGAATATGTCTTGCCACATTTTT-3' (SEQ ID NO: 866)

5'-AAGAACUUUAAGAAUUUUGAAAUUA-3' (SEQ ID NO: 1251)
3'-UGUUCUUGAAAUUCUUAAAACUUUAAU-5' (SEQ ID NO: 483)

C5-775 Target:
5'-ACAAGAACTTTAAGAATTTTGAAATTA-3' (SEQ ID NO: 867)

5'-AGAACUUUAAGAAUUUUGAAAUUAC-3' (SEQ ID NO: 1252)
3'-GUUCUUGAAAUUCUUAAAACUUUAAUG-5' (SEQ ID NO: 484)

TABLE 3-continued

Selected Human Anti-C5 DsiRNAs, Unmodified
Duplexes (Asymmetrics)

C5-776 Target:
5'-CAAGAACTTTAAGAATTTTGAAATTAC-3' (SEQ ID NO: 868)

5'-CUUUAAGAAUUUUGAAAUUACUAUA-3' (SEQ ID NO: 1253)
3'-UUGAAAUUCUUAAAACUUUAAUGAUAU-5' (SEQ ID NO: 485)

C5-780 Target:
5'-AACTTTAAGAATTTTGAAATTACTATA-3' (SEQ ID NO: 869)

5'-GAAUUUUGAAAUUACUAUAAAAGCA-3' (SEQ ID NO: 1254)
3'-UUCUUAAAACUUUAAUGAUAUUUUCGU-5' (SEQ ID NO: 486)

C5-786 Target:
5'-AAGAATTTTGAAATTACTATAAAAGCA-3' (SEQ ID NO: 870)

5'-AAUUUUGAAAUUACUAUAAAAGCAA-3' (SEQ ID NO: 1255)
3'-UCUUAAAACUUUAAUGAUAUUUUCGUU-5' (SEQ ID NO: 487)

C5-787 Target:
5'-AGAATTTTGAAATTACTATAAAAGCAA-3' (SEQ ID NO: 871)

5'-AUUUUGAAAUUACUAUAAAAGCAAG-3' (SEQ ID NO: 1256)
3'-CUUAAAACUUUAAUGAUAUUUUCGUUC-5' (SEQ ID NO: 488)

C5-788 Target:
5'-GAATTTTGAAATTACTATAAAAGCAAG-3' (SEQ ID NO: 872)

5'-UUGAAAUUACUAUAAAAGCAAGAUA-3' (SEQ ID NO: 1257)
3'-AAAACUUUAAUGAUAUUUUCGUUCUAU-5' (SEQ ID NO: 489)

C5-791 Target:
5'-TTTTGAAATTACTATAAAAGCAAGATA-3' (SEQ ID NO: 873)

5'-UGAAAUUACUAUAAAAGCAAGAUAU-3' (SEQ ID NO: 1258)
3'-AAACUUUAAUGAUAUUUUCGUUCUAUA-5' (SEQ ID NO: 490)

C5-792 Target:
5'-TTTGAAATTACTATAAAAGCAAGATAT-3' (SEQ ID NO: 874)

5'-GAAAUUACUAUAAAAGCAAGAUAUU-3' (SEQ ID NO: 1259)
3'-AACUUUAAUGAUAUUUUCGUUCUAUAA-5' (SEQ ID NO: 491)

C5-793 Target:
5'-TTGAAATTACTATAAAAGCAAGATATT-3' (SEQ ID NO: 875)

5'-AAAGCAAGAUAUUUUUAUAAUAAAG-3' (SEQ ID NO: 1260)
3'-AUUUCGUUCUAUAAAAAUAUUAUUUC-5' (SEQ ID NO: 492)

C5-805 Target:
5'-TAAAAGCAAGATATTTTTATAATAAAG-3' (SEQ ID NO: 876)

5'-AAGCAAGAUAUUUUUAUAAUAAAGU-3' (SEQ ID NO: 1261)
3'-UUUUCGUUCUAUAAAAAUAUUAUUUCA-5' (SEQ ID NO: 493)

C5-806 Target:
5'-AAAAGCAAGATATTTTTATAATAAAGT-3' (SEQ ID NO: 877)

5'-AGCAAGAUAUUUUUAUAAUAAAGUA-3' (SEQ ID NO: 1262)
3'-UUUCGUUCUAUAAAAAUAUUAUUUCAU-5' (SEQ ID NO: 494)

C5-807 Target:
5'-AAAGCAAGATATTTTTATAATAAAGTA-3' (SEQ ID NO: 878)

5'-GCAAGAUAUUUUUAUAAUAAAGUAG-3' (SEQ ID NO: 1263)
3'-UUCGUUCUAUAAAAAUAUUAUUUCAUC-5' (SEQ ID NO: 495)

C5-808 Target:
5'-AAGCAAGATATTTTTATAATAAAGTAG-3' (SEQ ID NO: 879)

5'-CAAGAUAUUUUUAUAAUAAAGUAGU-3' (SEQ ID NO: 1264)
3'-UCGUUCUAUAAAAAUAUUAUUUCAUCA-5' (SEQ ID NO: 496)

C5-809 Target:
5'-AGCAAGATATTTTTATAATAAAGTAGT-3' (SEQ ID NO: 880)

5'-AAGAUAUUUUUAUAAUAAAGUAGUC-3' (SEQ ID NO: 1265)
3'-CGUUCUAUAAAAAUAUUAUUUCAUCAG-5' (SEQ ID NO: 497)

TABLE 3-continued

Selected Human Anti-C5 DsiRNAs, Unmodified
Duplexes (Asymmetrics)

C5-810 Target:
5'-GCAAGATATTTTTATAATAAAGTAGTC-3' (SEQ ID NO: 881)

5'-AGAUAUUUUUAUAAUAAAGUAGUCA-3' (SEQ ID NO: 1266)
3'-GUUCUAUAAAAAUAUUAUUUCAUCAGU-5' (SEQ ID NO: 498)

C5-811 Target:
5'-CAAGATATTTTTATAATAAAGTAGTCA-3' (SEQ ID NO: 882)

5'-GAUAUUUUUAUAAUAAAGUAGUCAC-3' (SEQ ID NO: 1267)
3'-UUCUAUAAAAAUAUUAUUUCAUCAGUG-5' (SEQ ID NO: 499)

C5-812 Target:
5'-AAGATATTTTTATAATAAAGTAGTCAC-3' (SEQ ID NO: 883)

5'-CAAUGUUGAUAAAUGGAAUUGCUCA-3' (SEQ ID NO: 1268)
3'-GUGUUACAACUAUUUACCUUAACGAGU-5' (SEQ ID NO: 500)

C5-923 Target:
5'-CACAATGTTGATAAATGGAATTGCTCA-3' (SEQ ID NO: 884)

5'-AAUGUUGAUAAAUGGAAUUGCUCAA-3' (SEQ ID NO: 1269)
3'-UGUUACAACUAUUUACCUUAACGAGUU-5' (SEQ ID NO: 501)

C5-924 Target:
5'-ACAATGTTGATAAATGGAATTGCTCAA-3' (SEQ ID NO: 885)

5'-UGUUGAUAAAUGGAAUUGCUCAAGU-3' (SEQ ID NO: 1270)
3'-UUACAACUAUUUACCUUAACGAGUUCA-5' (SEQ ID NO: 502)

C5-926 Target:
5'-AATGTTGATAAATGGAATTGCTCAAGT-3' (SEQ ID NO: 886)

5'-GUUGAUAAAUGGAAUUGCUCAAGUC-3' (SEQ ID NO: 1271)
3'-UACAACUAUUUACCUUAACGAGUUCAG-5' (SEQ ID NO: 503)

C5-927 Target:
5'-ATGTTGATAAATGGAATTGCTCAAGTC-3' (SEQ ID NO: 887)

5'-UUGAUAAAUGGAAUUGCUCAAGUCA-3' (SEQ ID NO: 1272)
3'-ACAACUAUUUACCUUAACGAGUUCAGU-5' (SEQ ID NO: 504)

C5-928 Target:
5'-TGTTGATAAATGGAATTGCTCAAGTCA-3' (SEQ ID NO: 888)

5'-AUAAAUGGAAUUGCUCAAGUCACAU-3' (SEQ ID NO: 1273)
3'-ACUAUUUACCUUAACGAGUUCAGUGUA-5' (SEQ ID NO: 505)

C5-931 Target:
5'-TGATAAATGGAATTGCTCAAGTCACAT-3' (SEQ ID NO: 889)

5'-AUGGAAUUGCUCAAGUCACAUUUGA-3' (SEQ ID NO: 1274)
3'-UUUACCUUAACGAGUUCAGUGUAAACU-5' (SEQ ID NO: 506)

C5-935 Target:
5'-AAATGGAATTGCTCAAGTCACATTTGA-3' (SEQ ID NO: 890)

5'-CUCAAGUCACAUUUGAUUCUGAAAC-3' (SEQ ID NO: 1275)
3'-ACGAGUUCAGUGUAAACUAAGACUUUG-5' (SEQ ID NO: 507)

C5-944 Target:
5'-TGCTCAAGTCACATTTGATTCTGAAAC-3' (SEQ ID NO: 891)

5'-CAAGUCACAUUUGAUUCUGAAACAG-3' (SEQ ID NO: 1276)
3'-GAGUUCAGUGUAAACUAAGACUUUGUC-5' (SEQ ID NO: 508)

C5-946 Target:
5'-CTCAAGTCACATTTGATTCTGAAACAG-3' (SEQ ID NO: 892)

5'-AAGUCACAUUUGAUUCUGAAACAGC-3' (SEQ ID NO: 1277)
3'-AGUUCAGUGUAAACUAAGACUUUGUCG-5' (SEQ ID NO: 509)

C5-947 Target:
5'-TCAAGTCACATTTGATTCTGAAACAGC-3' (SEQ ID NO: 893)

5'-AGUCACAUUUGAUUCUGAAACAGCA-3' (SEQ ID NO: 1278)
3'-GUUCAGUGUAAACUAAGACUUUGUCGU-5' (SEQ ID NO: 510)

TABLE 3-continued

Selected Human Anti-C5 DsiRNAs, Unmodified Duplexes (Asymmetrics)

C5-948 Target:
5'-CAAGTCACATTTGATTCTGAAACAGCA-3' (SEQ ID NO: 894)

5'-CAUUUGAUUCUGAAACAGCAGUCAA-3'  (SEQ ID NO: 1279)
3'-GUGUAAACUAAGACUUUGUCGUCAGUU-5' (SEQ ID NO: 511)

C5-953 Target:
5'-CACATTTGATTCTGAAACAGCAGTCAA-3' (SEQ ID NO: 895)

5'-UUUGAUUCUGAAACAGCAGUCAAAG-3'  (SEQ ID NO: 1280)
3'-GUAAACUAAGACUUUGUCGUCAGUUUC-5' (SEQ ID NO: 512)

C5-955 Target:
5'-CATTTGATTCTGAAACAGCAGTCAAAG-3' (SEQ ID NO: 896)

5'-UUGAUUCUGAAACAGCAGUCAAAGA-3'  (SEQ ID NO: 1281)
3'-UAAACUAAGACUUUGUCGUCAGUUUCU-5' (SEQ ID NO: 513)

C5-956 Target:
5'-ATTTGATTCTGAAACAGCAGTCAAAGA-3' (SEQ ID NO: 897)

5'-CAGCAGUCAAAGAACUGUCAUACUA-3'  (SEQ ID NO: 1282)
3'-UUGUCGUCAGUUUCUUGACAGUAUGAU-5' (SEQ ID NO: 514)

C5-968 Target:
5'-AACAGCAGTCAAAGAACTGTCATACTA-3' (SEQ ID NO: 898)

5'-GCAGUCAAAGAACUGUCAUACUACA-3'  (SEQ ID NO: 1283)
3'-GUCGUCAGUUUCUUGACAGUAUGAUGU-5' (SEQ ID NO: 515)

C5-970 Target:
5'-CAGCAGTCAAAGAACTGTCATACTACA-3' (SEQ ID NO: 899)

5'-GUCAAAGAACUGUCAUACUACAGUU-3'  (SEQ ID NO: 1284)
3'-GUCAGUUUCUUGACAGUAUGAUGUCAA-5' (SEQ ID NO: 516)

C5-973 Target:
5'-CAGTCAAAGAACTGTCATACTACAGTT-3' (SEQ ID NO: 900)

5'-AAGAACUGUCAUACUACAGUUUAGA-3'  (SEQ ID NO: 1285)
3'-GUUUCUUGACAGUAUGAUGUCAAAUCU-5' (SEQ ID NO: 517)

C5-977 Target:
5'-CAAAGAACTGTCATACTACAGTTTAGA-3' (SEQ ID NO: 901)

5'-AGAACUGUCAUACUACAGUUUAGAA-3'  (SEQ ID NO: 1286)
3'-UUUCUUGACAGUAUGAUGUCAAAUCUU-5' (SEQ ID NO: 518)

C5-978 Target:
5'-AAAGAACTGTCATACTACAGTTTAGAA-3' (SEQ ID NO: 902)

5'-AACUGUCAUACUACAGUUUAGAAGA-3'  (SEQ ID NO: 1287)
3'-UCUUGACAGUAUGAUGUCAAAUCUUCU-5' (SEQ ID NO: 519)

C5-980 Target:
5'-AGAACTGTCATACTACAGTTTAGAAGA-3' (SEQ ID NO: 903)

5'-UUAAACAACAAGUACCUUUAUAUUG-3'  (SEQ ID NO: 1288)
3'-UAAAUUUGUUGUUCAUGGAAAUAUAAC-5' (SEQ ID NO: 520)

C5-1006 Target:
5'-ATTTAAACAACAAGTACCTTTATATTG-3' (SEQ ID NO: 904)

5'-UAAACAACAAGUACCUUUAUAUUGC-3'  (SEQ ID NO: 1289)
3'-AAAUUUGUUGUUCAUGGAAAUAUAACG-5' (SEQ ID NO: 521)

C5-1007 Target:
5'-TTTAAACAACAAGTACCTTTATATTGC-3' (SEQ ID NO: 905)

5'-AAACAACAAGUACCUUUAUAUUGCU-3'  (SEQ ID NO: 1290)
3'-AAUUUGUUGUUCAUGGAAAUAUAACGA-5' (SEQ ID NO: 522)

C5-1008 Target:
5'-TTAAACAACAAGTACCTTTATATTGCT-3' (SEQ ID NO: 906)

5'-AACAACAAGUACCUUUAUAUUGCUG-3'  (SEQ ID NO: 1291)
3'-AUUUGUUGUUCAUGGAAAUAUAACGAC-5' (SEQ ID NO: 523)

TABLE 3-continued

Selected Human Anti-C5 DsiRNAs, Unmodified Duplexes (Asymmetrics)

C5-1009 Target:
5'-TAAACAACAAGTACCTTTATATTGCTG-3' (SEQ ID NO: 907)

5'-ACAACAAGUACCUUUAUAUUGCUGU-3'  (SEQ ID NO: 1292)
3'-UUUGUUGUUCAUGGAAAUAUAACGACA-5' (SEQ ID NO: 524)

C5-1010 Target:
5'-AAACAACAAGTACCTTTATATTGCTGT-3' (SEQ ID NO: 908)

5'-CAACAAGUACCUUUAUAUUGCUGUA-3'  (SEQ ID NO: 1293)
3'-UUGUUGUUCAUGGAAAUAUAACGACAU-5' (SEQ ID NO: 525)

C5-1011 Target:
5'-AACAACAAGTACCTTTATATTGCTGTA-3' (SEQ ID NO: 909)

5'-AACAAGUACCUUUAUAUUGCUGUAA-3'  (SEQ ID NO: 1294)
3'-UGUUGUUCAUGGAAAUAUAACGACAUU-5' (SEQ ID NO: 526)

C5-1012 Target:
5'-ACAACAAGTACCTTTATATTGCTGTAA-3' (SEQ ID NO: 910)

5'-ACAAGUACCUUUAUAUUGCUGUAAC-3'  (SEQ ID NO: 1295)
3'-GUUGUUCAUGGAAAUAUAACGACAUUG-5' (SEQ ID NO: 527)

C5-1013 Target:
5'-CAACAAGTACCTTTATATTGCTGTAAC-3' (SEQ ID NO: 911)

5'-CAAGUACCUUUAUAUUGCUGUAACA-3'  (SEQ ID NO: 1296)
3'-UUGUUCAUGGAAAUAUAACGACAUUGU-5' (SEQ ID NO: 528)

C5-1014 Target:
5'-AACAAGTACCTTTATATTGCTGTAACA-3' (SEQ ID NO: 912)

5'-AAGUACCUUUAUAUUGCUGUAACAG-3'  (SEQ ID NO: 1297)
3'-UGUUCAUGGAAAUAUAACGACAUUGUC-5' (SEQ ID NO: 529)

C5-1015 Target:
5'-ACAAGTACCTTTATATTGCTGTAACAG-3' (SEQ ID NO: 913)

5'-AGUACCUUUAUAUUGCUGUAACAGU-3'  (SEQ ID NO: 1298)
3'-GUUCAUGGAAAUAUAACGACAUUGUCA-5' (SEQ ID NO: 530)

C5-1016 Target:
5'-CAAGTACCTTTATATTGCTGTAACAGT-3' (SEQ ID NO: 914)

5'-GUACCUUUAUAUUGCUGUAACAGUC-3'  (SEQ ID NO: 1299)
3'-UUCAUGGAAAUAUAACGACAUUGUCAG-5' (SEQ ID NO: 531)

C5-1017 Target:
5'-AAGTACCTTTATATTGCTGTAACAGTC-3' (SEQ ID NO: 915)

5'-ACCUUUAUAUUGCUGUAACAGUCAU-3'  (SEQ ID NO: 1300)
3'-CAUGGAAAUAUAACGACAUUGUCAGUA-5' (SEQ ID NO: 532)

C5-1019 Target:
5'-GTACCTTTATATTGCTGTAACAGTCAT-3' (SEQ ID NO: 916)

5'-UCAAAUAUGUCCUCUCUCCCUACAA-3'  (SEQ ID NO: 1301)
3'-GUAGUUUAUACAGGAGAGAGGGAUGUU-5' (SEQ ID NO: 533)

C5-1088 Target:
5'-CATCAAATATGTCCTCTCTCCCTACAA-3' (SEQ ID NO: 917)

5'-CCCUACAAACUGAAUUUGGUUGCUA-3'  (SEQ ID NO: 1302)
3'-GAGGGAUGUUUGACUUAAACCAACGAU-5' (SEQ ID NO: 534)

C5-1105 Target:
5'-CTCCCTACAAACTGAATTTGGTTGCTA-3' (SEQ ID NO: 918)

5'-ACAACUGAAUUUGGUUGCUACUCC-3'   (SEQ ID NO: 1303)
3'-GAUGUUUGACUUAAACCAACGAUGAGG-5' (SEQ ID NO: 535)

C5-1109 Target:
5'-CTACAAACTGAATTTGGTTGCTACTCC-3' (SEQ ID NO: 919)

5'-CAAACUGAAUUUGGUUGCUACUCCU-3'  (SEQ ID NO: 1304)
3'-AUGUUUGACUUAAACCAACGAUGAGGA-5' (SEQ ID NO: 536)

TABLE 3-continued

Selected Human Anti-C5 DsiRNAs, Unmodified Duplexes (Asymmetrics)

C5-1110 Target:
5'-TACAAACTGAATTTGGTTGCTACTCCT-3' (SEQ ID NO: 920)

5'-CUGAAUGCACAAACAAUUGAUGUAA-3' (SEQ ID NO: 1305)
3'-GUGACUUACGUGUUUGUUAACUACAUU-5' (SEQ ID NO: 537)

C5-1222 Target:
5'-CACTGAATGCACAAACAATTGATGTAA-3' (SEQ ID NO: 921)

5'-UGAAUGCACAAACAAUUGAUGUAAA-3' (SEQ ID NO: 1306)
3'-UGACUUACGUGUUUGUUAACUACAUUU-5' (SEQ ID NO: 538)

C5-1223 Target:
5'-ACTGAATGCACAAACAATTGATGTAAA-3' (SEQ ID NO: 922)

5'-CAAGAGACAUCUGACUUGGAUCCAA-3' (SEQ ID NO: 1307)
3'-UGGUUCUCUGUAGACUGAACCUAGGUU-5' (SEQ ID NO: 539)

C5-1249 Target:
5'-ACCAAGAGACATCTGACTTGGATCCAA-3' (SEQ ID NO: 923)

5'-AAGAGACAUCUGACUUGGAUCCAAG-3' (SEQ ID NO: 1308)
3'-GGUUCUCUGUAGACUGAACCUAGGUUC-5' (SEQ ID NO: 540)

C5-1250 Target:
5'-CCAAGAGACATCTGACTTGGATCCAAG-3' (SEQ ID NO: 924)

5'-GGUUACCGAGCAAUAGCAUACUCAU-3' (SEQ ID NO: 1309)
3'-UUCCAAUGGCUCGUUAUCGUAUGAGUA-5' (SEQ ID NO: 541)

C5-1405 Target:
5'-AAGGTTACCGAGCAATAGCATACTCAT-3' (SEQ ID NO: 925)

5'-UCAGCCAAAGUUACCUUUAUAUUGA-3' (SEQ ID NO: 1310)
3'-AGAGUCGGUUUCAAUGGAAAUAUAACU-5' (SEQ ID NO: 542)

C5-1433 Target:
5'-TCTCAGCCAAAGTTACCTTTATATTGA-3' (SEQ ID NO: 926)

5'-CAGCCAAAGUUACCUUUAUAUUGAU-3' (SEQ ID NO: 1311)
3'-GAGUCGGUUUCAAUGGAAAUAUAACUA-5' (SEQ ID NO: 543)

C5-1434 Target:
5'-CTCAGCCAAAGTTACCTTTATATTGAT-3' (SEQ ID NO: 927)

5'-AGCCAAAGUUACCUUUAUAUUGAUU-3' (SEQ ID NO: 1312)
3'-AGUCGGUUUCAAUGGAAAUAUAACUAA-5' (SEQ ID NO: 544)

C5-1435 Target:
5'-TCAGCCAAAGTTACCTTTATATTGATT-3' (SEQ ID NO: 928)

5'-GCCAAAGUUACCUUUAUAUUGAUUG-3' (SEQ ID NO: 1313)
3'-GUCGGUUUCAAUGGAAAUAUAACUAAC-5' (SEQ ID NO: 545)

C5-1436 Target:
5'-CAGCCAAAGTTACCTTTATATTGATTG-3' (SEQ ID NO: 929)

5'-AAAAGCCCAUAUAUUGACAAAAUAA-3' (SEQ ID NO: 1314)
3'-GGUUUUCGGGUAUAUAACUGUUUUAUU-5' (SEQ ID NO: 546)

C5-1519 Target:
5'-CCAAAAGCCCATATATTGACAAAATAA-3' (SEQ ID NO: 930)

5'-GCCCAUAUAUUGACAAAAUAACUCA-3' (SEQ ID NO: 1315)
3'-UUCGGGUAUAUAACUGUUUUAUUGAGU-5' (SEQ ID NO: 547)

C5-1523 Target:
5'-AAGCCCATATATTGACAAAATAACTCA-3' (SEQ ID NO: 931)

5'-CCCAUAUAUUGACAAAAUAACUCAC-3' (SEQ ID NO: 1316)
3'-UCGGGUAUAUAACUGUUUUAUUGAGUG-5' (SEQ ID NO: 548)

C5-1524 Target:
5'-AGCCCATATATTGACAAAATAACTCAC-3' (SEQ ID NO: 932)

5'-CAUAUAUUGACAAAAUAACUCACUA-3' (SEQ ID NO: 1317)
3'-GGGUAUAUAACUGUUUUAUUGAGUGAU-5' (SEQ ID NO: 549)

C5-1526 Target:
5'-CCCATATATTGACAAAATAACTCACTA-3' (SEQ ID NO: 933)

5'-AUAUAUUGACAAAAUAACUCACUAU-3' (SEQ ID NO: 1318)
3'-GGUAUAUAACUGUUUUAUUGAGUGAUA-5' (SEQ ID NO: 550)

C5-1527 Target:
5'-CCATATATTGACAAAATAACTCACTAT-3' (SEQ ID NO: 934)

5'-UAUAUUGACAAAAUAACUCACUAUA-3' (SEQ ID NO: 1319)
3'-GUAUAUAACUGUUUUAUUGAGUGAUAU-5' (SEQ ID NO: 551)

C5-1528 Target:
5'-CATATATTGACAAAATAACTCACTATA-3' (SEQ ID NO: 935)

5'-AUUGACAAAAUAACUCACUAUAAUU-3' (SEQ ID NO: 1320)
3'-UAUAACUGUUUUAUUGAGUGAUAUUAA-5' (SEQ ID NO: 552)

C5-1531 Target:
5'-ATATTGACAAAATAACTCACTATAATT-3' (SEQ ID NO: 936)

5'-UGACAAAAUAACUCACUAUAAUUAC-3' (SEQ ID NO: 1321)
3'-UAACUGUUUUAUUGAGUGAUAUUAAUG-5' (SEQ ID NO: 553)

C5-1533 Target:
5'-ATTGACAAAATAACTCACTATAATTAC-3' (SEQ ID NO: 937)

5'-GACAAAAUAACUCACUAUAAUUACU-3' (SEQ ID NO: 1322)
3'-AACUGUUUUAUUGAGUGAUAUUAAUGA-5' (SEQ ID NO: 554)

C5-1534 Target:
5'-TTGACAAAATAACTCACTATAATTACT-3' (SEQ ID NO: 938)

5'-ACAAAAUAACUCACUAUAAUUACUU-3' (SEQ ID NO: 1323)
3'-ACUGUUUUAUUGAGUGAUAUUAAUGAA-5' (SEQ ID NO: 555)

C5-1535 Target:
5'-TGACAAAATAACTCACTATAATTACTT-3' (SEQ ID NO: 939)

5'-CAAAAUAACUCACUAUAAUUACUUG-3' (SEQ ID NO: 1324)
3'-CUGUUUUAUUGAGUGAUAUUAAUGAAC-5' (SEQ ID NO: 556)

C5-1536 Target:
5'-GACAAAATAACTCACTATAATTACTTG-3' (SEQ ID NO: 940)

5'-AAAAUAACUCACUAUAAUUACUUGA-3' (SEQ ID NO: 1325)
3'-UGUUUUAUUGAGUGAUAUUAAUGAACU-5' (SEQ ID NO: 557)

C5-1537 Target:
5'-ACAAAATAACTCACTATAATTACTTGA-3' (SEQ ID NO: 941)

5'-AAAUAACUCACUAUAAUUACUUGAU-3' (SEQ ID NO: 1326)
3'-GUUUUAUUGAGUGAUAUUAAUGAACUA-5' (SEQ ID NO: 558)

C5-1538 Target:
5'-CAAAATAACTCACTATAATTACTTGAT-3' (SEQ ID NO: 942)

5'-AAUAACUCACUAUAAUUACUUGAUU-3' (SEQ ID NO: 1327)
3'-UUUUAUUGAGUGAUAUUAAUGAACUAA-5' (SEQ ID NO: 559)

C5-1539 Target:
5'-AAAATAACTCACTATAATTACTTGATT-3' (SEQ ID NO: 943)

5'-AUAACUCACUAUAAUUACUUGAUUU-3' (SEQ ID NO: 1328)
3'-UUUAUUGAGUGAUAUUAAUGAACUAAA-5' (SEQ ID NO: 560)

C5-1540 Target:
5'-AAATAACTCACTATAATTACTTGATTT-3' (SEQ ID NO: 944)

5'-UACUCACUAUAAUUACUUGAUUUUU-3' (SEQ ID NO: 1329)
3'-UUAUUGAGUGAUAUUAAUGAACUAAAA-5' (SEQ ID NO: 561)

C5-1541 Target:
5'-AATAACTCACTATAATTACTTGATTTT-3' (SEQ ID NO: 945)

5'-AACUCACUAUAAUUACUUGAUUUUA-3' (SEQ ID NO: 1330)
3'-UAUUGAGUGAUAUUAAUGAACUAAAAU-5' (SEQ ID NO: 562)

TABLE 3-continued

Selected Human Anti-C5 DsiRNAs, Unmodified
Duplexes (Asymmetrics)

C5-1542 Target:
5'-ATAACTCACTATAATTACTTGATTTTA-3' (SEQ ID NO: 946)

5'-ACUCACUAUAAUUACUUGAUUUUAU-3' (SEQ ID NO: 1331)
3'-AUUGAGUGAUAUUAAUGAACUAAAAUA-5' (SEQ ID NO: 563)

C5-1543 Target:
5'-TAACTCACTATAATTACTTGATTTTAT-3' (SEQ ID NO: 947)

5'-CUCACUAUAAUUACUUGAUUUUAUC-3' (SEQ ID NO: 1332)
3'-UUGAGUGAUAUUAAUGAACUAAAAUAG-5' (SEQ ID NO: 564)

C5-1544 Target:
5'-AACTCACTATAATTACTTGATTTTATC-3' (SEQ ID NO: 948)

5'-UCACUAUAAUUACUUGAUUUUAUCC-3' (SEQ ID NO: 1333)
3'-UGAGUGAUAUUAAUGAACUAAAAUAGG-5' (SEQ ID NO: 565)

C5-1545 Target:
5'-ACTCACTATAATTACTTGATTTTATCC-3' (SEQ ID NO: 949)

5'-CACUAUAAUUACUUGAUUUUAUCCA-3' (SEQ ID NO: 1334)
3'-GAGUGAUAUUAAUGAACUAAAAUAGGU-5' (SEQ ID NO: 566)

C5-1546 Target:
5'-CTCACTATAATTACTTGATTTTATCCA-3' (SEQ ID NO: 950)

5'-ACUAUAAUUACUUGAUUUUAUCCAA-3' (SEQ ID NO: 1335)
3'-AGUGAUAUUAAUGAACUAAAAUAGGUU-5' (SEQ ID NO: 567)

C5-1547 Target:
5'-TCACTATAATTACTTGATTTTATCCAA-3' (SEQ ID NO: 951)

5'-CUAUAAUUACUUGAUUUUAUCCAAG-3' (SEQ ID NO: 1336)
3'-GUGAUAUUAAUGAACUAAAAUAGGUUC-5' (SEQ ID NO: 568)

C5-1548 Target:
5'-CACTATAATTACTTGATTTTATCCAAG-3' (SEQ ID NO: 952)

5'-UAUAAUUACUUGAUUUUAUCCAAGG-3' (SEQ ID NO: 1337)
3'-UGAUAUUAAUGAACUAAAAUAGGUUCC-5' (SEQ ID NO: 569)

C5-1549 Target:
5'-ACTATAATTACTTGATTTTATCCAAGG-3' (SEQ ID NO: 953)

5'-AUAAUUACUUGAUUUUAUCCAAGGG-3' (SEQ ID NO: 1338)
3'-GAUAUUAAUGAACUAAAAUAGGUUCCC-5' (SEQ ID NO: 570)

C5-1550 Target:
5'-CTATAATTACTTGATTTTATCCAAGGG-3' (SEQ ID NO: 954)

5'-UAAUUACUUGAUUUUAUCCAAGGGC-3' (SEQ ID NO: 1339)
3'-AUAUUAAUGAACUAAAAUAGGUUCCCG-5' (SEQ ID NO: 571)

C5-1551 Target:
5'-TATAATTACTTGATTTTATCCAAGGGC-3' (SEQ ID NO: 955)

5'-AAUUACUUGAUUUUAUCCAAGGGCA-3' (SEQ ID NO: 1340)
3'-UAUUAAUGAACUAAAAUAGGUUCCCGU-5' (SEQ ID NO: 572)

C5-1552 Target:
5'-ATAATTACTTGATTTTATCCAAGGGCA-3' (SEQ ID NO: 956)

5'-AUUACUUGAUUUUAUCCAAGGGCAA-3' (SEQ ID NO: 1341)
3'-AUUAAUGAACUAAAAUAGGUUCCCGUU-5' (SEQ ID NO: 573)

C5-1553 Target:
5'-TAATTACTTGATTTTATCCAAGGGCAA-3' (SEQ ID NO: 957)

5'-GUCUGAUUCAGUCUGGUUAAAUAUU-3' (SEQ ID NO: 1342)
3'-CACAGACUAAGUCAGACCAAUUUAUAA-5' (SEQ ID NO: 574)

C5-1719 Target:
5'-GTGTCTGATTCAGTCTGGTTAAATATT-3' (SEQ ID NO: 958)

5'-CUGAUUCAGUCUGGUUAAAUAUUGA-3' (SEQ ID NO: 1343)
3'-CAGACUAAGUCAGACCAAUUUAUAACU-5' (SEQ ID NO: 575)

TABLE 3-continued

Selected Human Anti-C5 DsiRNAs, Unmodified
Duplexes (Asymmetrics)

C5-1721 Target:
5'-GTCTGATTCAGTCTGGTTAAATATTGA-3' (SEQ ID NO: 959)

5'-UGAUUCAGUCUGGUUAAAUAUUGAA-3' (SEQ ID NO: 1344)
3'-AGACUAAGUCAGACCAAUUUAUAACUU-5' (SEQ ID NO: 576)

C5-1722 Target:
5'-TCTGATTCAGTCTGGTTAAATATTGAA-3' (SEQ ID NO: 960)

5'-GAUUCAGUCUGGUUAAAUAUUGAAG-3' (SEQ ID NO: 1345)
3'-GACUAAGUCAGACCAAUUUAUAACUUC-5' (SEQ ID NO: 577)

C5-1723 Target:
5'-CTGATTCAGTCTGGTTAAATATTGAAG-3' (SEQ ID NO: 961)

5'-AUUCAGUCUGGUUAAAUAUUGAAGA-3' (SEQ ID NO: 1346)
3'-ACUAAGUCAGACCAAUUUAUAACUUCU-5' (SEQ ID NO: 578)

C5-1724 Target:
5'-TGATTCAGTCTGGTTAAATATTGAAGA-3' (SEQ ID NO: 962)

5'-UCAGUCUGGUUAAAUAUUGAAGAAA-3' (SEQ ID NO: 1347)
3'-UAAGUCAGACCAAUUUAUAACUUCUUU-5' (SEQ ID NO: 579)

C5-1726 Target:
5'-ATTCAGTCTGGTTAAATATTGAAGAAA-3' (SEQ ID NO: 963)

5'-CAGUCUGGUUAAAUAUUGAAGAAAA-3' (SEQ ID NO: 1348)
3'-AAGUCAGACCAAUUUAUAACUUCUUUU-5' (SEQ ID NO: 580)

C5-1727 Target:
5'-TTCAGTCTGGTTAAATATTGAAGAAAA-3' (SEQ ID NO: 964)

5'-AGUCUGGUUAAAUAUUGAAGAAAAA-3' (SEQ ID NO: 1349)
3'-AGUCAGACCAAUUUAUAACUUCUUUUU-5' (SEQ ID NO: 581)

C5-1728 Target:
5'-TCAGTCTGGTTAAATATTGAAGAAAAA-3' (SEQ ID NO: 965)

5'-GUCUGGUUAAAUAUUGAAGAAAAAU-3' (SEQ ID NO: 1350)
3'-GUCAGACCAAUUUAUAACUUCUUUUUA-5' (SEQ ID NO: 582)

C5-1729 Target:
5'-CAGTCTGGTTAAATATTGAAGAAAAAT-3' (SEQ ID NO: 966)

5'-UCUGGUUAAAUAUUGAAGAAAAAUG-3' (SEQ ID NO: 1351)
3'-UCAGACCAAUUUAUAACUUCUUUUUAC-5' (SEQ ID NO: 583)

C5-1730 Target:
5'-AGTCTGGTTAAATATTGAAGAAAAATG-3' (SEQ ID NO: 967)

5'-CUGGUUAAAUAUUGAAGAAAAAUGU-3' (SEQ ID NO: 1352)
3'-CAGACCAAUUUAUAACUUCUUUUUACA-5' (SEQ ID NO: 584)

C5-1731 Target:
5'-GTCTGGTTAAATATTGAAGAAAAATGT-3' (SEQ ID NO: 968)

5'-UGGUUAAAUAUUGAAGAAAAAUGUG-3' (SEQ ID NO: 1353)
3'-AGACCAAUUUAUAACUUCUUUUUACAC-5' (SEQ ID NO: 585)

C5-1732 Target:
5'-TCTGGTTAAATATTGAAGAAAAATGTG-3' (SEQ ID NO: 969)

5'-GGUUAAAUAUUGAAGAAAAAUGUGG-3' (SEQ ID NO: 1354)
3'-GACCAAUUUAUAACUUCUUUUUACACC-5' (SEQ ID NO: 586)

C5-1733 Target:
5'-CTGGTTAAATATTGAAGAAAAATGTGG-3' (SEQ ID NO: 970)

5'-UGUGGCAACCAGCUCCAGGUUCAUC-3' (SEQ ID NO: 1355)
3'-UUACACCGUUGGUCGAGGUCCAAGUAG-5' (SEQ ID NO: 587)

C5-1753 Target:
5'-AATGTGGCAACCAGCTCCAGGTTCATC-3' (SEQ ID NO: 971)

5'-GUGGCAACCAGCUCCAGGUUCAUCU-3' (SEQ ID NO: 1356)
3'-UACACCGUUGGUCGAGGUCCAAGUAGA-5' (SEQ ID NO: 588)

TABLE 3-continued

Selected Human Anti-C5 DsiRNAs, Unmodified Duplexes (Asymmetrics)

C5-1754 Target:
5'-ATGTGGCAACCAGCTCCAGGTTCATCT-3' (SEQ ID NO: 972)

5'-CUGGGCUGUGGGGCAGGUGGUGGCC-3' (SEQ ID NO: 1357)
3'-UAGACCCGACACCCCGUCCACCACCGG-5' (SEQ ID NO: 589)

C5-1948 Target:
5'-ATCTGGGCTGTGGGGCAGGTGGTGGCC-3' (SEQ ID NO: 973)

5'-UGGGCUGUGGGGCAGGUGGUGGCCU-3' (SEQ ID NO: 1358)
3'-AGACCCGACACCCCGUCCACCACCGGA-5' (SEQ ID NO: 590)

C5-1949 Target:
5'-TCTGGGCTGTGGGGCAGGTGGTGGCCT-3' (SEQ ID NO: 974)

5'-GGGCUGUGGGGCAGGUGGUGGCCUC-3' (SEQ ID NO: 1359)
3'-GACCCGACACCCCGUCCACCACCGGAG-5' (SEQ ID NO: 591)

C5-1950 Target:
5'-CTGGGCTGTGGGGCAGGTGGTGGCCTC-3' (SEQ ID NO: 975)

5'-GGCUGUGGGGCAGGUGGUGGCCUCA-3' (SEQ ID NO: 1360)
3'-ACCCGACACCCCGUCCACCACCGGAGU-5' (SEQ ID NO: 592)

C5-1951 Target:
5'-TGGGCTGTGGGGCAGGTGGTGGCCTCA-3' (SEQ ID NO: 976)

5'-GCUGUGGGGCAGGUGGUGGCCUCAA-3' (SEQ ID NO: 1361)
3'-CCCGACACCCCGUCCACCACCGGAGUU-5' (SEQ ID NO: 593)

C5-1952 Target:
5'-GGGCTGTGGGGCAGGTGGTGGCCTCAA-3' (SEQ ID NO: 977)

5'-CUGUGGGGCAGGUGGUGGCCUCAAC-3' (SEQ ID NO: 1362)
3'-CCGACACCCCGUCCACCACCGGAGUUG-5' (SEQ ID NO: 594)

C5-1953 Target:
5'-GGCTGTGGGGCAGGTGGTGGCCTCAAC-3' (SEQ ID NO: 978)

5'-UGUGGGGCAGGUGGUGGCCUCAACA-3' (SEQ ID NO: 1363)
3'-CGACACCCCGUCCACCACCGGAGUUGU-5' (SEQ ID NO: 595)

C5-1954 Target:
5'-GCTGTGGGGCAGGTGGTGGCCTCAACA-3' (SEQ ID NO: 979)

5'-AGAAAAUGAUGAACCUUGUAAAGAA-3' (SEQ ID NO: 1364)
3'-GUUCUUUUACUACUUGGAACAUUUCUU-5' (SEQ ID NO: 596)

C5-2043 Target:
5'-CAAGAAAATGATGAACCTTGTAAAGAA-3' (SEQ ID NO: 980)

5'-AUGAUGAACCUUGUAAAGAAAUUCU-3' (SEQ ID NO: 1365)
3'-UUUACUACUUGGAACAUUUCUUUAAGA-5' (SEQ ID NO: 597)

C5-2048 Target:
5'-AAATGATGAACCTTGTAAAGAAATTCT-3' (SEQ ID NO: 981)

5'-GAUGAACCUUGUAAAGAAAUUCUCA-3' (SEQ ID NO: 1366)
3'-UACUACUUGGAACAUUUCUUUAAGAGU-5' (SEQ ID NO: 598)

C5-2050 Target:
5'-ATGATGAACCTTGTAAAGAAATTCTCA-3' (SEQ ID NO: 982)

5'-AUGAACCUUGUAAAGAAAUUCUCAG-3' (SEQ ID NO: 1367)
3'-ACUACUUGGAACAUUUCUUUAAGAGUC-5' (SEQ ID NO: 599)

C5-2051 Target:
5'-TGATGAACCTTGTAAAGAAATTCTCAG-3' (SEQ ID NO: 983)

5'-CUUGUAAAGAAAUUCUCAGGCCAAG-3' (SEQ ID NO: 1368)
3'-UGGAACAUUUCUUUAAGAGUCCGGUUC-5' (SEQ ID NO: 600)

C5-2057 Target:
5'-ACCTTGTAAAGAAATTCTCAGGCCAAG-3' (SEQ ID NO: 984)

5'-UUGUAAAGAAAUUCUCAGGCCAAGA-3' (SEQ ID NO: 1369)
3'-GGAACAUUUCUUUAAGAGUCCGGUUCU-5' (SEQ ID NO: 601)

C5-2058 Target:
5'-CCTTGTAAAGAAATTCTCAGGCCAAGA-3' (SEQ ID NO: 985)

5'-AGUAGUGAAGAAAUGUUGUUACGAU-3' (SEQ ID NO: 1370)
3'-AGUCAUCACUUCUUUACAACAAUGCUA-5' (SEQ ID NO: 602)

C5-2133 Target:
5'-TCAGTAGTGAAGAAATGTTGTTACGAT-3' (SEQ ID NO: 986)

5'-GUAGUGAAGAAAUGUUGUUACGAUG-3' (SEQ ID NO: 1371)
3'-GUCAUCACUUCUUUACAACAAUGCUAC-5' (SEQ ID NO: 603)

C5-2134 Target:
5'-CAGTAGTGAAGAAATGTTGTTACGATG-3' (SEQ ID NO: 987)

5'-GAAGACCCUGUUACCAGUAAGCAAG-3' (SEQ ID NO: 1372)
3'-UACUUCUGGGACAAUGGUCAUUCGUUC-5' (SEQ ID NO: 604)

C5-2316 Target:
5'-ATGAAGACCCTGTTACCAGTAAGCAAG-3' (SEQ ID NO: 988)

5'-CAAGCCAGAAAUUCGGAGUUAUUUU-3' (SEQ ID NO: 1373)
3'-UCGUUCGGUCUUUAAGCCUCAAUAAAA-5' (SEQ ID NO: 605)

C5-2337 Target:
5'-AGCAAGCCAGAAATTCGGAGTTATTTT-3' (SEQ ID NO: 989)

5'-UCAAGGCAAAGGUGUUCAAAGAUGU-3' (SEQ ID NO: 1374)
3'-ACAGUUCCGUUUCCACAAGUUUCUACA-5' (SEQ ID NO: 606)

C5-2498 Target:
5'-TGTCAAGGCAAAGGTGTTCAAAGATGT-3' (SEQ ID NO: 990)

5'-CAAGGCAAAGGUGUUCAAAGAUGUC-3' (SEQ ID NO: 1375)
3'-CAGUUCCGUUUCCACAAGUUUCUACAG-5' (SEQ ID NO: 607)

C5-2499 Target:
5'-GTCAAGGCAAAGGTGTTCAAAGATGTC-3' (SEQ ID NO: 991)

5'-AAGGCAAAGGUGUUCAAAGAUGUCU-3' (SEQ ID NO: 1376)
3'-AGUUCCGUUUCCACAAGUUUCUACAGA-5' (SEQ ID NO: 608)

C5-2500 Target:
5'-TCAAGGCAAAGGTGTTCAAAGATGTCT-3' (SEQ ID NO: 992)

5'-AGGCAAAGGUGUUCAAAGAUGUCUU-3' (SEQ ID NO: 1377)
3'-GUUCCGUUUCCACAAGUUUCUACAGAA-5' (SEQ ID NO: 609)

C5-2501 Target:
5'-CAAGGCAAAGGTGTTCAAAGATGTCTT-3' (SEQ ID NO: 993)

5'-GAUGUCUUCCUGGAAAUGAAUAUAC-3' (SEQ ID NO: 1378)
3'-UUCUACAGAAGGACCUUUACUUAUAUG-5' (SEQ ID NO: 610)

C5-2518 Target:
5'-AAGATGTCTTCCTGGAAATGAATATAC-3' (SEQ ID NO: 994)

5'-CUGGAAAUGAAUAUACCAUAUUCUG-3' (SEQ ID NO: 1379)
3'-AGGACCUUUACUUAUAUGGUAUAAGAC-5' (SEQ ID NO: 611)

C5-2527 Target:
5'-TCCTGGAAATGAATATACCATATTCTG-3' (SEQ ID NO: 995)

5'-UGGAAAUGAAUAUACCAUAUUCUGU-3' (SEQ ID NO: 1380)
3'-GGACCUUUACUUAUAUGGUAUAAGACA-5' (SEQ ID NO: 612)

C5-2528 Target:
5'-CCTGGAAATGAATATACCATATTCTGT-3' (SEQ ID NO: 996)

5'-GGAAAUGAAUAUACCAUAUUCUGUU-3' (SEQ ID NO: 1381)
3'-GACCUUUACUUAUAUGGUAUAAGACAA-5' (SEQ ID NO: 613)

C5-2529 Target:
5'-CTGGAAATGAATATACCATATTCTGTT-3' (SEQ ID NO: 997)

5'-GAAAUGAAUAUACCAUAUUCUGUUG-3' (SEQ ID NO: 1382)
3'-ACCUUUACUUAUAUGGUAUAAGACAAC-5' (SEQ ID NO: 614)

TABLE 3-continued

Selected Human Anti-C5 DsiRNAs, Unmodified Duplexes (Asymmetrics)

C5-2530 Target:
5'-TGGAAATGAATATACCATATTCTGTTG-3' (SEQ ID NO: 998)

5'-AAAUGAAUAUACCAUAUUCUGUUGU-3' (SEQ ID NO: 1383)
3'-CCUUUACUUAUAUGGUAUAAGACAACA-5' (SEQ ID NO: 615)

C5-2531 Target:
5'-GGAAATGAATATACCATATTCTGTTGT-3' (SEQ ID NO: 999)

5'-AAUGAAUAUACCAUAUUCUGUUGUA-3' (SEQ ID NO: 1384)
3'-CUUUACUUAUAUGGUAUAAGACAACAU-5' (SEQ ID NO: 616)

C5-2532 Target:
5'-GAAATGAATATACCATATTCTGTTGTA-3' (SEQ ID NO: 1000)

5'-AUGAAUAUACCAUAUUCUGUUGUAC-3' (SEQ ID NO: 1385)
3'-UUUACUUAUAUGGUAUAAGACAACAUG-5' (SEQ ID NO: 617)

C5-2533 Target:
5'-AAATGAATATACCATATTCTGTTGTAC-3' (SEQ ID NO: 1001)

5'-UGAAUAUACCAUAUUCUGUUGUACG-3' (SEQ ID NO: 1386)
3'-UUACUUAUAUGGUAUAAGACAACAUGC-5' (SEQ ID NO: 618)

C5-2534 Target:
5'-AATGAATATACCATATTCTGTTGTACG-3' (SEQ ID NO: 1002)

5'-GAAUAUACCAUAUUCUGUUGUACGA-3' (SEQ ID NO: 1387)
3'-UACUUAUAUGGUAUAAGACAACAUGCU-5' (SEQ ID NO: 619)

C5-2535 Target:
5'-ATGAATATACCATATTCTGTTGTACGA-3' (SEQ ID NO: 1003)

5'-AAUAUACCAUAUUCUGUUGUACGAG-3' (SEQ ID NO: 1388)
3'-ACUUAUAUGGUAUAAGACAACAUGCUC-5' (SEQ ID NO: 620)

C5-2536 Target:
5'-TGAATATACCATATTCTGTTGTACGAG-3' (SEQ ID NO: 1004)

5'-AUAUACCAUAUUCUGUUGUACGAGG-3' (SEQ ID NO: 1389)
3'-CUUAUAUGGUAUAAGACAACAUGCUCC-5' (SEQ ID NO: 621)

C5-2537 Target:
5'-GAATATACCATATTCTGTTGTACGAGG-3' (SEQ ID NO: 1005)

5'-CGAGGAGAACAGAUCCAAUUGAAAG-3' (SEQ ID NO: 1390)
3'-AUGCUCCUCUUGUCUAGGUUAACUUUC-5' (SEQ ID NO: 622)

C5-2557 Target:
5'-TACGAGGAGAACAGATCCAATTGAAAG-3' (SEQ ID NO: 1006)

5'-GAGGAGAACAGAUCCAAUUGAAAGG-3' (SEQ ID NO: 1391)
3'-UGCUCCUCUUGUCUAGGUUAACUUUCC-5' (SEQ ID NO: 623)

C5-2558 Target:
5'-ACGAGGAGAACAGATCCAATTGAAAGG-3' (SEQ ID NO: 1007)

5'-AGGAGAACAGAUCCAAUUGAAAGGA-3' (SEQ ID NO: 1392)
3'-GCUCCUCUUGUCUAGGUUAACUUUCCU-5' (SEQ ID NO: 624)

C5-2559 Target:
5'-CGAGGAGAACAGATCCAATTGAAGGA-3' (SEQ ID NO: 1008)

5'-GGAGAACAGAUCCAAUUGAAAGGAA-3' (SEQ ID NO: 1393)
3'-CUCCUCUUGUCUAGGUUAACUUUCCUU-5' (SEQ ID NO: 625)

C5-2560 Target:
5'-GAGGAGAACAGATCCAATTGAAAGGAA-3' (SEQ ID NO: 1009)

5'-GAGAACAGAUCCAAUUGAAAGGAAC-3' (SEQ ID NO: 1394)
3'-UCCUCUUGUCUAGGUUAACUUUCCUUG-5' (SEQ ID NO: 626)

C5-2561 Target:
5'-AGGAGAACAGATCCAATTGAAAGGAAC-3' (SEQ ID NO: 1010)

5'-AGAACAGAUCCAAUUGAAAGGAACU-3' (SEQ ID NO: 1395)
3'-CCUCUUGUCUAGGUUAACUUUCCUUGA-5' (SEQ ID NO: 627)

TABLE 3-continued

Selected Human Anti-C5 DsiRNAs, Unmodified Duplexes (Asymmetrics)

C5-2562 Target:
5'-GGAGAACAGATCCAATTGAAAGGAACT-3' (SEQ ID NO: 1011)

5'-GAACAGAUCCAAUUGAAAGGAACUG-3' (SEQ ID NO: 1396)
3'-CUCUUGUCUAGGUUAACUUUCCUUGAC-5' (SEQ ID NO: 628)

C5-2563 Target:
5'-GAGAACAGATCCAATTGAAAGGAACTG-3' (SEQ ID NO: 1012)

5'-AACAGAUCCAAUUGAAAGGAACUGU-3' (SEQ ID NO: 1397)
3'-UCUUGUCUAGGUUAACUUUCCUUGACA-5' (SEQ ID NO: 629)

C5-2564 Target:
5'-AGAACAGATCCAATTGAAAGGAACTGT-3' (SEQ ID NO: 1013)

5'-ACAGAUCCAAUUGAAAGGAACUGUU-3' (SEQ ID NO: 1398)
3'-CUUGUCUAGGUUAACUUUCCUUGACAA-5' (SEQ ID NO: 630)

C5-2565 Target:
5'-GAACAGATCCAATTGAAAGGAACTGTT-3' (SEQ ID NO: 1014)

5'-CAGAUCCAAUUGAAAGGAACUGUUU-3' (SEQ ID NO: 1399)
3'-UUGUCUAGGUUAACUUUCCUUGACAAA-5' (SEQ ID NO: 631)

C5-2566 Target:
5'-AACAGATCCAATTGAAAGGAACTGTTT-3' (SEQ ID NO: 1015)

5'-AGAUCCAAUUGAAAGGAACUGUUUA-3' (SEQ ID NO: 1400)
3'-UGUCUAGGUUAACUUUCCUUGACAAAU-5' (SEQ ID NO: 632)

C5-2567 Target:
5'-ACAGATCCAATTGAAAGGAACTGTTTA-3' (SEQ ID NO: 1016)

5'-GAUCCAAUUGAAAGGAACUGUUUAC-3' (SEQ ID NO: 1401)
3'-GUCUAGGUUAACUUUCCUUGACAAAUG-5' (SEQ ID NO: 633)

C5-2568 Target:
5'-CAGATCCAATTGAAAGGAACTGTTTAC-3' (SEQ ID NO: 1017)

5'-AUCCAAUUGAAAGGAACUGUUUACA-3' (SEQ ID NO: 1402)
3'-UCUAGGUUAACUUUCCUUGACAAAUGU-5' (SEQ ID NO: 634)

C5-2569 Target:
5'-AGATCCAATTGAAAGGAACTGTTTACA-3' (SEQ ID NO: 1018)

5'-UCCAAUUGAAAGGAACUGUUUACAA-3' (SEQ ID NO: 1403)
3'-CUAGGUUAACUUUCCUUGACAAAUGUU-5' (SEQ ID NO: 635)

C5-2570 Target:
5'-GATCCAATTGAAAGGAACTGTTTACAA-3' (SEQ ID NO: 1019)

5'-CCAAUUGAAAGGAACUGUUUACAAC-3' (SEQ ID NO: 1404)
3'-UAGGUUAACUUUCCUUGACAAAUGUUG-5' (SEQ ID NO: 636)

C5-2571 Target:
5'-ATCCAATTGAAAGGAACTGTTTACAAC-3' (SEQ ID NO: 1020)

5'-CAAUUGAAAGGAACUGUUUACAACU-3' (SEQ ID NO: 1405)
3'-AGGUUAACUUUCCUUGACAAAUGUUGA-5' (SEQ ID NO: 637)

C5-2572 Target:
5'-TCCAATTGAAAGGAACTGTTTACAACT-3' (SEQ ID NO: 1021)

5'-AAUUGAAAGGAACUGUUUACAACUA-3' (SEQ ID NO: 1406)
3'-GGUUAACUUUCCUUGACAAAUGUUGAU-5' (SEQ ID NO: 638)

C5-2573 Target:
5'-CCAATTGAAAGGAACTGTTTACAACTA-3' (SEQ ID NO: 1022)

5'-AUUGAAAGGAACUGUUUACAACUAU-3' (SEQ ID NO: 1407)
3'-GUUAACUUUCCUUGACAAAUGUUGAUA-5' (SEQ ID NO: 639)

C5-2574 Target:
5'-CAATTGAAAGGAACTGTTTACAACTAT-3' (SEQ ID NO: 1023)

5'-UUGAAAGGAACUGUUUACAACUAUA-3' (SEQ ID NO: 1408)
3'-UUAACUUUCCUUGACAAAUGUUGAUAU-5' (SEQ ID NO: 640)

TABLE 3-continued

Selected Human Anti-C5 DsiRNAs, Unmodified Duplexes (Asymmetrics)

C5-2575 Target:
5'-AATTGAAAGGAACTGTTTACAACTATA-3' (SEQ ID NO: 1024)

5'-UGAAAGGAACUGUUUACAACUAUAG-3' (SEQ ID NO: 1409)
3'-UAACUUUCCUUGACAAAUGUUGAUAUC-5' (SEQ ID NO: 641)

C5-2576 Target:
5'-ATTGAAAGGAACTGTTTACAACTATAG-3' (SEQ ID NO: 1025)

5'-GAAAGGAACUGUUUACAACUAUAGG-3' (SEQ ID NO: 1410)
3'-AACUUUCCUUGACAAAUGUUGAUAUCC-5' (SEQ ID NO: 642)

C5-2577 Target:
5'-TTGAAAGGAACTGTTTACAACTATAGG-3' (SEQ ID NO: 1026)

5'-AAAGGAACUGUUUACAACUAUAGGA-3' (SEQ ID NO: 1411)
3'-ACUUUCCUUGACAAAUGUUGAUAUCCU-5' (SEQ ID NO: 643)

C5-2578 Target:
5'-TGAAAGGAACTGTTTACAACTATAGGA-3' (SEQ ID NO: 1027)

5'-AAGGAACUGUUUACAACUAUAGGAC-3' (SEQ ID NO: 1412)
3'-CUUUCCUUGACAAAUGUUGAUAUCCUG-5' (SEQ ID NO: 644)

C5-2579 Target:
5'-GAAAGGAACTGTTTACAACTATAGGAC-3' (SEQ ID NO: 1028)

5'-AGGAACUGUUUACAACUAUAGGACU-3' (SEQ ID NO: 1413)
3'-UUUCCUUGACAAAUGUUGAUAUCCUGA-5' (SEQ ID NO: 645)

C5-2580 Target:
5'-AAAGGAACTGTTTACAACTATAGGACT-3' (SEQ ID NO: 1029)

5'-GGAACUGUUUACAACUAUAGGACUU-3' (SEQ ID NO: 1414)
3'-UUCCUUGACAAAUGUUGAUAUCCUGAA-5' (SEQ ID NO: 646)

C5-2581 Target:
5'-AAGGAACTGTTTACAACTATAGGACTT-3' (SEQ ID NO: 1030)

5'-GUUAAAAUGUCUGCUGUGGAGGGAA-3' (SEQ ID NO: 1415)
3'-CACAAUUUUACAGACGACACCUCCCUU-5' (SEQ ID NO: 647)

C5-2623 Target:
5'-GTGTTAAAATGTCTGCTGTGGAGGGAA-3' (SEQ ID NO: 1031)

5'-UUAAAAUGUCUGCUGUGGAGGGAAU-3' (SEQ ID NO: 1416)
3'-ACAAUUUUACAGACGACACCUCCCUUA-5' (SEQ ID NO: 648)

C5-2624 Target:
5'-TGTTAAAATGTCTGCTGTGGAGGGAAT-3' (SEQ ID NO: 1032)

5'-UAAAAUGUCUGCUGUGGAGGGAAUC-3' (SEQ ID NO: 1417)
3'-CAAUUUUACAGACGACACCUCCCUUAG-5' (SEQ ID NO: 649)

C5-2625 Target:
5'-GTTAAAATGTCTGCTGTGGAGGGAATC-3' (SEQ ID NO: 1033)

5'-AAAAUGUCUGCUGUGGAGGGAAUCU-3' (SEQ ID NO: 1418)
3'-AAUUUUACAGACGACACCUCCCUUAGA-5' (SEQ ID NO: 650)

C5-2626 Target:
5'-TTAAAATGTCTGCTGTGGAGGGAATCT-3' (SEQ ID NO: 1034)

5'-AAAUGUCUGCUGUGGAGGGAAUCUG-3' (SEQ ID NO: 1419)
3'-AUUUUACAGACGACACCUCCCUUAGAC-5' (SEQ ID NO: 651)

C5-2627 Target:
5'-TAAAATGTCTGCTGTGGAGGGAATCTG-3' (SEQ ID NO: 1035)

5'-UGCUUCCUCUGGAAAUUGGCCUUCA-3' (SEQ ID NO: 1420)
3'-ACACGAAGGAGACCUUUAACCGGAAGU-5' (SEQ ID NO: 652)

C5-2753 Target:
5'-TGTGCTTCCTCTGGAAATTGGCCTTCA-3' (SEQ ID NO: 1036)

5'-GCUUCCUCUGGAAAUUGGCCUUCAC-3' (SEQ ID NO: 1421)
3'-CACGAAGGAGACCUUUAACCGGAAGUG-5' (SEQ ID NO: 653)

C5-2754 Target:
5'-GTGCTTCCTCTGGAAATTGGCCTTCAC-3' (SEQ ID NO: 1037)

5'-CUUCCUCUGGAAAUUGGCCUUCACA-3' (SEQ ID NO: 1422)
3'-ACGAAGGAGACCUUUAACCGGAAGUGU-5' (SEQ ID NO: 654)

C5-2755 Target:
5'-TGCTTCCTCTGGAAATTGGCCTTCACA-3' (SEQ ID NO: 1038)

5'-UUCCUCUGGAAAUUGGCCUUCACAA-3' (SEQ ID NO: 1423)
3'-CGAAGGAGACCUUUAACCGGAAGUGUU-5' (SEQ ID NO: 655)

C5-2756 Target:
5'-GCTTCCTCTGGAAATTGGCCTTCACAA-3' (SEQ ID NO: 1039)

5'-UCCUCUGGAAAUUGGCCUUCACAAC-3' (SEQ ID NO: 1424)
3'-GAAGGAGACCUUUAACCGGAAGUGUUG-5' (SEQ ID NO: 656)

C5-2757 Target:
5'-CTTCCTCTGGAAATTGGCCTTCACAAC-3' (SEQ ID NO: 1040)

5'-CCUCUGGAAAUUGGCCUUCACAACA-3' (SEQ ID NO: 1425)
3'-AAGGAGACCUUUAACCGGAAGUGUUGU-5' (SEQ ID NO: 657)

C5-2758 Target:
5'-TTCCTCTGGAAATTGGCCTTCACAACA-3' (SEQ ID NO: 1041)

5'-CUCUGGAAAUUGGCCUUCACAACAU-3' (SEQ ID NO: 1426)
3'-AGGAGACCUUUAACCGGAAGUGUUGUA-5' (SEQ ID NO: 658)

C5-2759 Target:
5'-TCCTCTGGAAATTGGCCTTCACAACAT-3' (SEQ ID NO: 1042)

5'-UCUGGAAAUUGGCCUUCACAACAUC-3' (SEQ ID NO: 1427)
3'-GGAGACCUUUAACCGGAAGUGUUGUAG-5' (SEQ ID NO: 659)

C5-2760 Target:
5'-CCTCTGGAAATTGGCCTTCACAACATC-3' (SEQ ID NO: 1043)

5'-AGAAAUCAAAGGAUUUUGAGUGUA-3' (SEQ ID NO: 1428)
3'-UGUCUUUAGUUUUCCUAAAACUCACAU-5' (SEQ ID NO: 660)

C5-2967 Target:
5'-ACAGAAATCAAAGGATTTTGAGTGTA-3' (SEQ ID NO: 1044)

5'-GAAAUCAAAGGAUUUUGAGUGUAA-3' (SEQ ID NO: 1429)
3'-GUCUUUAGUUUUCCUAAAACUCACAUU-5' (SEQ ID NO: 661)

C5-2968 Target:
5'-CAGAAATCAAAGGATTTTGAGTGTAA-3' (SEQ ID NO: 1045)

5'-CAAAAGGAUUUUGAGUGUAAAAGGA-3' (SEQ ID NO: 1430)
3'-UAGUUUUCCUAAAACUCACAUUUUCCU-5' (SEQ ID NO: 662)

C5-2973 Target:
5'-ATCAAAGGATTTTGAGTGTAAAAGGA-3' (SEQ ID NO: 1046)

5'-AUCCUAACCCACCUCCCCAAAGGGA-3' (SEQ ID NO: 1431)
3'-UAUAGGAUUGGGUGGAGGGGUUUCCCU-5' (SEQ ID NO: 663)

C5-3049 Target:
5'-ATATCCTAACCCACCTCCCCAAAGGGA-3' (SEQ ID NO: 1047)

5'-UCCUAACCCACCUCCCCAAAGGGAG-3' (SEQ ID NO: 1432)
3'-AUAGGAUUGGGUGGAGGGGUUUCCCUC-5' (SEQ ID NO: 664)

C5-3050 Target:
5'-TATCCTAACCCACCTCCCCAAAGGGAG-3' (SEQ ID NO: 1048)

5'-CCAGUAUUCUAUGUUUUUCACUACC-3' (SEQ ID NO: 1433)
3'-AGGGUCAUAAGAUACAAAAAGUGAUGG-5' (SEQ ID NO: 665)

C5-3103 Target:
5'-TCCCAGTATTCTATGTTTTTCACTACC-3' (SEQ ID NO: 1049)

5'-AGGAAAUCAUUGGAACAUUUUUCAU-3' (SEQ ID NO: 1434)
3'-UGUCCUUUAGUAACCUUGUAAAAAGUA-5' (SEQ ID NO: 666)

TABLE 3-continued

Selected Human Anti-C5 DsiRNAs, Unmodified
Duplexes (Asymmetrics)

C5-3135 Target:
5'-ACAGGAAATCATTGGAACATTTTTCAT-3' (SEQ ID NO: 1050)

5'-GGAAAUCAUUGGAACAUUUUUCAUU-3' (SEQ ID NO: 1435)
3'-GUCCUUUAGUAACCUUGUAAAAGUAA-5' (SEQ ID NO: 667)

C5-3136 Target:
5'-CAGGAAATCATTGGAACATTTTTCATT-3' (SEQ ID NO: 1051)

5'-GAGCAUUAUGUCCUACAGAAAUGCU-3' (SEQ ID NO: 1436)
3'-AACUCGUAAUACAGGAUGUCUUUACGA-5' (SEQ ID NO: 668)

C5-3216 Target:
5'-TTGAGCATTATGTCCTACAGAAATGCT-3' (SEQ ID NO: 1052)

5'-CUUGGUUAACAGCUUUUGCUUUAAG-3' (SEQ ID NO: 1437)
3'-GUGAACCAAUUGUCGAAAACGAAAUUC-5' (SEQ ID NO: 669)

C5-3281 Target:
5'-CACTTGGTTAACAGCTTTTGCTTTAAG-3' (SEQ ID NO: 1053)

5'-GGUUAACAGCUUUUGCUUUAAGAGU-3' (SEQ ID NO: 1438)
3'-AACCAAUUGUCGAAAACGAAAUUCUCA-5' (SEQ ID NO: 670)

C5-3284 Target:
5'-TTGGTTAACAGCTTTTGCTTTAAGAGT-3' (SEQ ID NO: 1054)

5'-GUUAACAGCUUUUGCUUUAAGAGUA-3' (SEQ ID NO: 1439)
3'-ACCAAUUGUCGAAAACGAAAUUCUCAU-5' (SEQ ID NO: 671)

C5-3285 Target:
5'-TGGTTAACAGCTTTTGCTTTAAGAGTA-3' (SEQ ID NO: 1055)

5'-GCUUUAAGAGUACUUGGACAAGUAA-3' (SEQ ID NO: 1440)
3'-AACGAAAUUCUCAUGAACCUGUUCAUU-5' (SEQ ID NO: 672)

C5-3298 Target:
5'-TTGCTTTAAGAGTACTTGGACAAGTAA-3' (SEQ ID NO: 1056)

5'-CUUUAAGAGUACUUGGACAAGUAAA-3' (SEQ ID NO: 1441)
3'-ACGAAAUUCUCAUGAACCUGUUCAUUU-5' (SEQ ID NO: 673)

C5-3299 Target:
5'-TGCTTTAAGAGTACTTGGACAAGTAAA-3' (SEQ ID NO: 1057)

5'-UAAGAGUACUUGGACAAGUAAAUAA-3' (SEQ ID NO: 1442)
3'-AAAUUCUCAUGAACCUGUUCAUUUAUU-5' (SEQ ID NO: 674)

C5-3302 Target:
5'-TTTAAGAGTACTTGGACAAGTAAATAA-3' (SEQ ID NO: 1058)

5'-AAGAGUACUUGGACAAGUAAAUAAA-3' (SEQ ID NO: 1443)
3'-AAUUCUCAUGAACCUGUUCAUUUAUUU-5' (SEQ ID NO: 675)

C5-3303 Target:
5'-TTAAGAGTACTTGGACAAGTAAATAAA-3' (SEQ ID NO: 1059)

5'-UAGAGCAGAACCAAAAUUCAAUUUG-3' (SEQ ID NO: 1444)
3'-GCAUCUCGUCUUGGUUUUAAGUUAAAC-5' (SEQ ID NO: 676)

C5-3332 Target:
5'-CGTAGAGCAGAACCAAAATTCAATTTG-3' (SEQ ID NO: 1060)

5'-AGAGCAGAACCAAAAUUCAAUUUGU-3' (SEQ ID NO: 1445)
3'-CAUCUCGUCUUGGUUUUAAGUUAAACA-5' (SEQ ID NO: 677)

C5-3333 Target:
5'-GTAGAGCAGAACCAAAATTCAATTTGT-3' (SEQ ID NO: 1061)

5'-GAGCAGAACCAAAAUUCAAUUUGUA-3' (SEQ ID NO: 1446)
3'-AUCUCGUCUUGGUUUUAAGUUAAACAU-5' (SEQ ID NO: 678)

C5-3334 Target:
5'-TAGAGCAGAACCAAAATTCAATTTGTA-3' (SEQ ID NO: 1062)

5'-AGCAGAACCAAAAUUCAAUUUGUAA-3' (SEQ ID NO: 1447)
3'-UCUCGUCUUGGUUUUAAGUUAAACAUU-5' (SEQ ID NO: 679)

TABLE 3-continued

Selected Human Anti-C5 DsiRNAs, Unmodified
Duplexes (Asymmetrics)

C5-3335 Target:
5'-AGAGCAGAACCAAAATTCAATTTGTAA-3' (SEQ ID NO: 1063)

5'-CACAGUAUCAACCAAUAAAAUUACA-3' (SEQ ID NO: 1448)
3'-AAGUGUCAUAGUUGGUUAUUUUAAUGU-5' (SEQ ID NO: 680)

C5-3419 Target:
5'-TTCACAGTATCAACCAATAAAATTACA-3' (SEQ ID NO: 1064)

5'-ACCAAUAAAAUUACAGGGUACCUUG-3' (SEQ ID NO: 1449)
3'-GUUGGUUAUUUUAAUGUCCCAUGGAAC-5' (SEQ ID NO: 681)

C5-3429 Target:
5'-CAACCAATAAAATTACAGGGTACCTTG-3' (SEQ ID NO: 1065)

5'-CCAAUAAAAUUACAGGGUACCUUGC-3' (SEQ ID NO: 1450)
3'-UUGGUUAUUUUAAUGUCCCAUGGAACG-5' (SEQ ID NO: 682)

C5-3430 Target:
5'-AACCAATAAAATTACAGGGTACCTTGC-3' (SEQ ID NO: 1066)

5'-CAAUAAAAUUACAGGGUACCUUGCC-3' (SEQ ID NO: 1451)
3'-UGGUUAUUUUAAUGUCCCAUGGAACGG-5' (SEQ ID NO: 683)

C5-3431 Target:
5'-ACCAATAAAATTACAGGGTACCTTGCC-3' (SEQ ID NO: 1067)

5'-CUGUGAUUGGAAUUAGAAAGGCUUU-3' (SEQ ID NO: 1452)
3'-AUGACACUAACCUUAAUCUUUCCGAAA-5' (SEQ ID NO: 684)

C5-3497 Target:
5'-TACTGTGATTGGAATTAGAAAGGCTTT-3' (SEQ ID NO: 1068)

5'-UGUGAUUGGAAUUAGAAAGGCUUUC-3' (SEQ ID NO: 1453)
3'-UGACACUAACCUUAAUCUUUCCGAAAG-5' (SEQ ID NO: 685)

C5-3498 Target:
5'-ACTGTGATTGGAATTAGAAAGGCTTTC-3' (SEQ ID NO: 1069)

5'-GUGAUUGGAAUUAGAAAGGCUUUCG-3' (SEQ ID NO: 1454)
3'-GACACUAACCUUAAUCUUUCCGAAAGC-5' (SEQ ID NO: 686)

C5-3499 Target:
5'-CTGTGATTGGAATTAGAAAGGCTTTCG-3' (SEQ ID NO: 1070)

5'-UGAUUGGAAUUAGAAAGGCUUUCGA-3' (SEQ ID NO: 1455)
3'-ACACUAACCUUAAUCUUUCCGAAAGCU-5' (SEQ ID NO: 687)

C5-3500 Target:
5'-TGTGATTGGAATTAGAAAGGCTTTCGA-3' (SEQ ID NO: 1071)

5'-UUCAAUUGUUUCAGCUUUGAAGAGA-3' (SEQ ID NO: 1456)
3'-GCAAGUUAACAAAGUCGAAACUUCUCU-5' (SEQ ID NO: 688)

C5-3672 Target:
5'-CGTTCAATTGTTTCAGCTTTGAAGAGA-3' (SEQ ID NO: 1072)

5'-GAAGAGAGAAGCUUUGGUUAAAGGU-3' (SEQ ID NO: 1457)
3'-AACUUCUCUCUUCGAAACCAAUUUCCA-5' (SEQ ID NO: 689)

C5-3690 Target:
5'-TTGAAGAGAGAAGCTTTGGTTAAAGGT-3' (SEQ ID NO: 1073)

5'-AAGAGAGAAGCUUUGGUUAAAGGUA-3' (SEQ ID NO: 1458)
3'-ACUUCUCUCUUCGAAACCAAUUUCCAU-5' (SEQ ID NO: 690)

C5-3691 Target:
5'-TGAAGAGAGAAGCTTTGGTTAAAGGTA-3' (SEQ ID NO: 1074)

5'-AGAGAGAAGCUUUGGUUAAAGGUAA-3' (SEQ ID NO: 1459)
3'-CUUCUCUCUUCGAAACCAAUUUCCAUU-5' (SEQ ID NO: 691)

C5-3692 Target:
5'-GAAGAGAGAAGCTTTGGTTAAAGGTAA-3' (SEQ ID NO: 1075)

5'-AGAAGCUUUGGUUAAAGGUAAUCCA-3' (SEQ ID NO: 1460)
3'-UCUCUUCGAAACCAAUUUCCAUUAGGU-5' (SEQ ID NO: 692)

TABLE 3-continued

Selected Human Anti-C5 DsiRNAs, Unmodified Duplexes (Asymmetrics)

C5-3696 Target:
5'-AGAGAAGCTTTGGTTAAAGGTAATCCA-3' (SEQ ID NO: 1076)

5'-GAAGCUUUGGUUAAAGGUAAUCCAC-3' (SEQ ID NO: 1461)
3'-CUCUUCGAAACCAAUUUCCAUUAGGUG-5' (SEQ ID NO: 693)

C5-3697 Target:
5'-GAGAAGCTTTGGTTAAAGGTAATCCAC-3' (SEQ ID NO: 1077)

5'-CCAUUUAUCGUUUUUGGAAAGACAA-3' (SEQ ID NO: 1462)
3'-UGGGUAAAUAGCAAAAACCUUUCUGUU-5' (SEQ ID NO: 694)

C5-3722 Target:
5'-ACCCATTTATCGTTTTTGGAAAGACAA-3' (SEQ ID NO: 1078)

5'-GCUUUACUCACCAGUCUGAACUUGA-3' (SEQ ID NO: 1463)
3'-UACGAAAUGAGUGGUCAGACUUGAACU-5' (SEQ ID NO: 695)

C5-3814 Target:
5'-ATGCTTTACTCACCAGTCTGAACTTGA-3' (SEQ ID NO: 1079)

5'-CUUUACUCACCAGUCUGAACUUGAA-3' (SEQ ID NO: 1464)
3'-ACGAAAUGAGUGGUCAGACUUGAACUU-5' (SEQ ID NO: 696)

C5-3815 Target:
5'-TGCTTTACTCACCAGTCTGAACTTGAA-3' (SEQ ID NO: 1080)

5'-CUCACCAGUCUGAACUUGAAAGAUA-3' (SEQ ID NO: 1465)
3'-AUGAGUGGUCAGACUUGAACUUUCUAU-5' (SEQ ID NO: 697)

C5-3820 Target:
5'-TACTCACCAGTCTGAACTTGAAAGATA-3' (SEQ ID NO: 1081)

5'-CCAGUCUGAACUUGAAAGAUAUAAA-3' (SEQ ID NO: 1466)
3'-GUGGUCAGACUUGAACUUUCUAUAUUU-5' (SEQ ID NO: 698)

C5-3824 Target:
5'-CACCAGTCTGAACTTGAAAGATATAAA-3' (SEQ ID NO: 1082)

5'-GAAGAGCAGAGGUAUGGAGGUGGCU-3' (SEQ ID NO: 1467)
3'-GUCUUCUCGUCUCCAUACCUCCACCGA-5' (SEQ ID NO: 699)

C5-3880 Target:
5'-CAGAAGAGCAGAGGTATGGAGGTGGCT-3' (SEQ ID NO: 1083)

5'-AAGAGCAGAGGUAUGGAGGUGGCUU-3' (SEQ ID NO: 1468)
3'-UCUUCUCGUCUCCAUACCUCCACCGAA-5' (SEQ ID NO: 700)

C5-3881 Target:
5'-AGAAGAGCAGAGGTATGGAGGTGGCTT-3' (SEQ ID NO: 1084)

5'-GAAUAUUCACUCCUGGUUAAACAAC-3' (SEQ ID NO: 1469)
3'-GCCUUAUAAGUGAGGACCAAUUUGUUG-5' (SEQ ID NO: 701)

C5-3949 Target:
5'-CGGAATATTCACTCCTGGTTAAACAAC-3' (SEQ ID NO: 1085)

5'-CCUUACAUAAUUAUAAAAUGACAGA-3' (SEQ ID NO: 1470)
3'-ACGGAAUGUAUUAAUAUUUUACUGUCU-5' (SEQ ID NO: 702)

C5-4019 Target:
5'-TGCCTTACATAATTATAAAATGACAGA-3' (SEQ ID NO: 1086)

5'-CAUGUAACAACUGUAGUUCACAAAA-3' (SEQ ID NO: 1471)
3'-AUGUACAUUGUUGACAUCAAGUGUUUU-5' (SEQ ID NO: 703)

C5-4132 Target:
5'-TACATGTAACAACTGTAGTTCACAAAA-3' (SEQ ID NO: 1087)

5'-GAGGAAGUUUGCAGCUUUUAUUUGA-3' (SEQ ID NO: 1472)
3'-GACUCCUUCAAACGUCGAAAAUAAACU-5' (SEQ ID NO: 704)

C5-4168 Target:
5'-CTGAGGAAGTTTGCAGCTTTTATTTGA-3' (SEQ ID NO: 1088)

5'-AGGAAGUUUGCAGCUUUUAUUUGAA-3' (SEQ ID NO: 1473)
3'-ACUCCUUCAAACGUCGAAAAUAAACUU-5' (SEQ ID NO: 705)

C5-4169 Target:
5'-TGAGGAAGTTTGCAGCTTTTATTTGAA-3' (SEQ ID NO: 1089)

5'-GGAAGUUUGCAGCUUUUAUUUGAAA-3' (SEQ ID NO: 1474)
3'-CUCCUUCAAACGUCGAAAAUAAACUUU-5' (SEQ ID NO: 706)

C5-4170 Target:
5'-GAGGAAGTTTGCAGCTTTTATTTGAAA-3' (SEQ ID NO: 1090)

5'-GAAGUUUGCAGCUUUUAUUUGAAAA-3' (SEQ ID NO: 1475)
3'-UCCUUCAAACGUCGAAAAUAAACUUUU-5' (SEQ ID NO: 707)

C5-4171 Target:
5'-AGGAAGTTTGCAGCTTTTATTTGAAAA-3' (SEQ ID NO: 1091)

5'-AAGUUUGCAGCUUUUAUUUGAAAAU-3' (SEQ ID NO: 1476)
3'-CCUUCAAACGUCGAAAAUAAACUUUUA-5' (SEQ ID NO: 708)

C5-4172 Target:
5'-GGAAGTTTGCAGCTTTTATTTGAAAAT-3' (SEQ ID NO: 1092)

5'-AGUUUGCAGCUUUUAUUUGAAAAUC-3' (SEQ ID NO: 1477)
3'-CUUCAAACGUCGAAAAUAAACUUUUAG-5' (SEQ ID NO: 709)

C5-4173 Target:
5'-GAAGTTTGCAGCTTTTATTTGAAAATC-3' (SEQ ID NO: 1093)

5'-GUUUGCAGCUUUUAUUUGAAAAUCG-3' (SEQ ID NO: 1478)
3'-UUCAAACGUCGAAAAUAAACUUUUAGC-5' (SEQ ID NO: 710)

C5-4174 Target:
5'-AAGTTTGCAGCTTTTATTTGAAAATCG-3' (SEQ ID NO: 1094)

5'-UUUGCAGCUUUUAUUUGAAAAUCGA-3' (SEQ ID NO: 1479)
3'-UCAAACGUCGAAAAUAAACUUUUAGCU-5' (SEQ ID NO: 711)

C5-4175 Target:
5'-AGTTTGCAGCTTTTATTTGAAAATCGA-3' (SEQ ID NO: 1095)

5'-GCAGCUUUUAUUUGAAAAUCGAUAC-3' (SEQ ID NO: 1480)
3'-AACGUCGAAAAUAAACUUUUAGCUAUG-5' (SEQ ID NO: 712)

C5-4178 Target:
5'-TTGCAGCTTTTATTTGAAAATCGATAC-3' (SEQ ID NO: 1096)

5'-AUACUCAGGAUAUUGAAGCAUCCCA-3' (SEQ ID NO: 1481)
3'-GCUAUGAGUCCUAUAACUUCGUAGGGU-5' (SEQ ID NO: 713)

C5-4199 Target:
5'-CGATACTCAGGATATTGAAGCATCCA-3' (SEQ ID NO: 1097)

5'-CAGGAUAUUGAAGCAUCCCACUACA-3' (SEQ ID NO: 1482)
3'-GAGUCCUAUAACUUCGUAGGGUGAUGU-5' (SEQ ID NO: 714)

C5-4204 Target:
5'-CTCAGGATATTGAAGCATCCCACTACA-3' (SEQ ID NO: 1098)

5'-UAGCAUGUGCCAGCUACAAGCCCAG-3' (SEQ ID NO: 1483)
3'-UCAUCGUACACGGUCGAUGUUCGGGUC-5' (SEQ ID NO: 715)

C5-4262 Target:
5'-AGTAGCATGTGCCAGCTACAAGCCCAG-3' (SEQ ID NO: 1099)

5'-AGCAUGUGCCAGCUACAAGCCCAGC-3' (SEQ ID NO: 1484)
3'-CAUCGUACACGGUCGAUGUUCGGGUCG-5' (SEQ ID NO: 716)

C5-4263 Target:
5'-GTAGCATGTGCCAGCTACAAGCCCAGC-3' (SEQ ID NO: 1100)

5'-GCAUGUGCCAGCUACAAGCCCAGCA-3' (SEQ ID NO: 1485)
3'-AUCGUACACGGUCGAUGUUCGGGUCGU-5' (SEQ ID NO: 717)

C5-4264 Target:
5'-TAGCATGTGCCAGCTACAAGCCCAGCA-3' (SEQ ID NO: 1101)

5'-CAUGUGCCAGCUACAAGCCCAGCAG-3' (SEQ ID NO: 1486)
3'-UCGUACACGGUCGAUGUUCGGGUCGUC-5' (SEQ ID NO: 718)

TABLE 3-continued

Selected Human Anti-C5 DsiRNAs, Unmodified Duplexes (Asymmetrics)

C5-4265 Target:
5'-AGCATGTGCCAGCTACAAGCCCAGCAG-3' (SEQ ID NO: 1102)

5'-AUGUGCCAGCUACAAGCCCAGCAGG-3' (SEQ ID NO: 1487)
3'-CGUACACGGUCGAUGUUCGGGUCGUCC-5' (SEQ ID NO: 719)

C5-4266 Target:
5'-GCATGTGCCAGCTACAAGCCCAGCAGG-3' (SEQ ID NO: 1103)

5'-UGUGCCAGCUACAAGCCCAGCAGGG-3' (SEQ ID NO: 1488)
3'-GUACACGGUCGAUGUUCGGGUCGUCCC-5' (SEQ ID NO: 720)

C5-4267 Target:
5'-CATGTGCCAGCTACAAGCCCAGCAGGG-3' (SEQ ID NO: 1104)

5'-GUGCCAGCUACAAGCCCAGCAGGGA-3' (SEQ ID NO: 1489)
3'-UACACGGUCGAUGUUCGGGUCGUCCCU-5' (SEQ ID NO: 721)

C5-4268 Target:
5'-ATGTGCCAGCTACAAGCCCAGCAGGGA-3' (SEQ ID NO: 1105)

5'-UGCCAGCUACAAGCCCAGCAGGGAA-3' (SEQ ID NO: 1490)
3'-ACACGGUCGAUGUUCGGGUCGUCCCUU-5' (SEQ ID NO: 722)

C5-4269 Target:
5'-TGTGCCAGCTACAAGCCCAGCAGGGAA-3' (SEQ ID NO: 1106)

5'-GCCAGCUACAAGCCCAGCAGGGAAG-3' (SEQ ID NO: 1491)
3'-CACGGUCGAUGUUCGGGUCGUCCCUUC-5' (SEQ ID NO: 723)

C5-4270 Target:
5'-GTGCCAGCTACAAGCCCAGCAGGGAAG-3' (SEQ ID NO: 1107)

5'-GAUGGACAUGUUAUUCUGCAACUGA-3' (SEQ ID NO: 1492)
3'-UUCUACCUGUACAAUAAGACGUUGACU-5' (SEQ ID NO: 724)

C5-4423 Target:
5'-AAGATGGACATGTTATTCTGCAACTGA-3' (SEQ ID NO: 1108)

5'-AUGGACAUGUUAUUCUGCAACUGAA-3' (SEQ ID NO: 1493)
3'-UCUACCUGUACAAUAAGACGUUGACUU-5' (SEQ ID NO: 725)

C5-4424 Target:
5'-AGATGGACATGTTATTCTGCAACTGAA-3' (SEQ ID NO: 1109)

5'-GGACAUGUUAUUCUGCAACUGAAUU-3' (SEQ ID NO: 1494)
3'-UACCUGUACAAUAAGACGUUGACUUAA-5' (SEQ ID NO: 726)

C5-4426 Target:
5'-ATGGACATGTTATTCTGCAACTGAATT-3' (SEQ ID NO: 1110)

5'-ACAUGUUAUUCUGCAACUGAAUUCG-3' (SEQ ID NO: 1495)
3'-CCUGUACAAUAAGACGUUGACUUAAGC-5' (SEQ ID NO: 727)

C5-4428 Target:
5'-GGACATGTTATTCTGCAACTGAATTCG-3' (SEQ ID NO: 1111)

5'-CAUGUUAUUCUGCAACUGAAUUCGA-3' (SEQ ID NO: 1496)
3'-CUGUACAAUAAGACGUUGACUUAAGCU-5' (SEQ ID NO: 728)

C5-4429 Target:
5'-GACATGTTATTCTGCAACTGAATTCGA-3' (SEQ ID NO: 1112)

5'-AUGUUAUUCUGCAACUGAAUUCGAU-3' (SEQ ID NO: 1497)
3'-UGUACAAUAAGACGUUGACUUAAGCUA-5' (SEQ ID NO: 729)

C5-4430 Target:
5'-ACATGTTATTCTGCAACTGAATTCGAT-3' (SEQ ID NO: 1113)

5'-AUUCUGCAACUGAAUUCGAUUCCCU-3' (SEQ ID NO: 1498)
3'-AAUAAGACGUUGACUUAAGCUAAGGGA-5' (SEQ ID NO: 730)

C5-4435 Target:
5'-TTATTCTGCAACTGAATTCGATTCCCT-3' (SEQ ID NO: 1114)

5'-UUCUGCAACUGAAUUCGAUUCCCUC-3' (SEQ ID NO: 1499)
3'-AUAAGACGUUGACUUAAGCUAAGGGAG-5' (SEQ ID NO: 731)

C5-4436 Target:
5'-TATTCTGCAACTGAATTCGATTCCCTC-3' (SEQ ID NO: 1115)

5'-GAUAAACAGUGUACCAUGUUUUAUA-3' (SEQ ID NO: 1500)
3'-GUCUAUUUGUCACAUGGUACAAAAUAU-5' (SEQ ID NO: 732)

C5-4558 Target:
5'-CAGATAAACAGTGTACCATGTTTTATA-3' (SEQ ID NO: 1116)

5'-AUAAACAGUGUACCAUGUUUUAUAG-3' (SEQ ID NO: 1501)
3'-UCUAUUUGUCACAUGGUACAAAAUAUC-5' (SEQ ID NO: 733)

C5-4559 Target:
5'-AGATAAACAGTGTACCATGTTTTATAG-3' (SEQ ID NO: 1117)

5'-AAACAGUGUACCAUGUUUUAUAGCA-3' (SEQ ID NO: 1502)
3'-UAUUUGUCACAUGGUACAAAAUAUCGU-5' (SEQ ID NO: 734)

C5-4561 Target:
5'-ATAAACAGTGTACCATGTTTTATAGCA-3' (SEQ ID NO: 1118)

5'-ACAGUGUACCAUGUUUUAUAGCACU-3' (SEQ ID NO: 1503)
3'-UUUGUCACAUGGUACAAAAUAUCGUGA-5' (SEQ ID NO: 735)

C5-4563 Target:
5'-AAACAGTGTACCATGTTTTATAGCACT-3' (SEQ ID NO: 1119)

5'-AUAGCACUUCCAAUAUCAAAAUUCA-3' (SEQ ID NO: 1504)
3'-AAUAUCGUGAAGGUUAUAGUUUUAAGU-5' (SEQ ID NO: 736)

C5-4580 Target:
5'-TTATAGCACTTCCAATATCAAAATTCA-3' (SEQ ID NO: 1120)

5'-UUCAGAAAGUCUGUGAAGGAGCCGC-3' (SEQ ID NO: 1505)
3'-UUAAGUCUUUCAGACACUUCCUCGGCG-5' (SEQ ID NO: 737)

C5-4601 Target:
5'-AATTCAGAAAGTCTGTGAAGGAGCCGC-3' (SEQ ID NO: 1121)

5'-UCAGAAAGUCUGUGAAGGAGCCGCG-3' (SEQ ID NO: 1506)
3'-UAAGUCUUUCAGACACUUCCUCGGCGC-5' (SEQ ID NO: 738)

C5-4602 Target:
5'-ATTCAGAAAGTCTGTGAAGGAGCCGCG-3' (SEQ ID NO: 1122)

5'-CAGAAAGUCUGUGAAGGAGCCGCGU-3' (SEQ ID NO: 1507)
3'-AAGUCUUUCAGACACUUCCUCGGCGCA-5' (SEQ ID NO: 739)

C5-4603 Target:
5'-TTCAGAAAGTCTGTGAAGGAGCCGCGT-3' (SEQ ID NO: 1123)

5'-AGAAAGUCUGUGAAGGAGCCGCGUG-3' (SEQ ID NO: 1508)
3'-AGUCUUUCAGACACUUCCUCGGCGCAC-5' (SEQ ID NO: 740)

C5-4604 Target:
5'-TCAGAAAGTCTGTGAAGGAGCCGCGTG-3' (SEQ ID NO: 1124)

5'-CCAGAGAUUGCAUAUGCUUAUAAAG-3' (SEQ ID NO: 1509)
3'-UUGGUCUCUAACGUAUACGAAUAUUUC-5' (SEQ ID NO: 741)

C5-4717 Target:
5'-AACCAGAGATTGCATATGCTTATAAAG-3' (SEQ ID NO: 1125)

5'-CAGAGAUUGCAUAUGCUUAUAAAGU-3' (SEQ ID NO: 1510)
3'-UGGUCUCUAACGUAUACGAAUAUUUCA-5' (SEQ ID NO: 742)

C5-4718 Target:
5'-ACCAGAGATTGCATATGCTTATAAAGT-3' (SEQ ID NO: 1126)

5'-AGAGAUUGCAUAUGCUUAUAAAGUU-3' (SEQ ID NO: 1511)
3'-GGUCUCUAACGUAUACGAAUAUUUCAA-5' (SEQ ID NO: 743)

C5-4719 Target:
5'-CCAGAGATTGCATATGCTTATAAAGTT-3' (SEQ ID NO: 1127)

5'-GAGAUUGCAUAUGCUUAUAAAGUUA-3' (SEQ ID NO: 1512)
3'-GUCUCUAACGUAUACGAAUAUUUCAAU-5' (SEQ ID NO: 744)

TABLE 3-continued

Selected Human Anti-C5 DsiRNAs, Unmodified Duplexes (Asymmetrics)

C5-4720 Target:
5'-CAGAGATTGCATATGCTTATAAAGTTA-3' (SEQ ID NO: 1128)

5'-AGAUUGCAUAUGCUUAUAAAGUUAG-3' (SEQ ID NO: 1513)
3'-UCUCUAACGUAUACGAAUAUUUCAAUC-5' (SEQ ID NO: 745)

C5-4721 Target:
5'-AGAGATTGCATATGCTTATAAAGTTAG-3' (SEQ ID NO: 1129)

5'-AGAAAAUGUUUUUGUCAAGUACAAG-3' (SEQ ID NO: 1514)
3'-CAUCUUUUACAAAAACAGUUCAUGUUC-5' (SEQ ID NO: 746)

C5-4764 Target:
5'-GTAGAAAATGTTTTTGTCAAGTACAAG-3' (SEQ ID NO: 1130)

5'-GAAAAUGUUUUUGUCAAGUACAAGG-3' (SEQ ID NO: 1515)
3'-AUCUUUUACAAAAACAGUUCAUGUUCC-5' (SEQ ID NO: 747)

C5-4765 Target:
5'-TAGAAAATGTTTTTGTCAAGTACAAGG-3' (SEQ ID NO: 1131)

5'-AAAAUGUUUUUGUCAAGUACAAGGC-3' (SEQ ID NO: 1516)
3'-UCUUUUACAAAAACAGUUCAUGUUCCG-5' (SEQ ID NO: 748)

C5-4766 Target:
5'-AGAAAATGTTTTTGTCAAGTACAAGGC-3' (SEQ ID NO: 1132)

5'-AAAUGUUUUUGUCAAGUACAAGGCA-3' (SEQ ID NO: 1517)
3'-CUUUUACAAAAACAGUUCAUGUUCCGU-5' (SEQ ID NO: 749)

C5-4767 Target:
5'-GAAAATGTTTTTGTCAAGTACAAGGCA-3' (SEQ ID NO: 1133)

5'-AAUGUUUUUGUCAAGUACAAGGCAA-3' (SEQ ID NO: 1518)
3'-UUUUACAAAAACAGUUCAUGUUCCGUU-5' (SEQ ID NO: 750)

C5-4768 Target:
5'-AAAATGTTTTTGTCAAGTACAAGGCAA-3' (SEQ ID NO: 1134)

5'-CCAGAUAAAAUACAAUUUCAGUUUC-3' (SEQ ID NO: 1519)
3'-GAGGUCUAUUUUAUGUUAAAGUCAAAG-5' (SEQ ID NO: 751)

C5-4929 Target:
5'-CTCCAGATAAAATACAATTTCAGTTTC-3' (SEQ ID NO: 1135)

5'-AUGUUCAUCGUGUCAAGCAUUUUUA-3' (SEQ ID NO: 1520)
3'-UGUACAAGUAGCACAGUUCGUAAAAAU-5' (SEQ ID NO: 752)

C5-5013 Target:
5'-ACATGTTCATCGTGTCAAGCATTTTTA-3' (SEQ ID NO: 1136)

5'-CAUCGUGUCAAGCAUUUUUAGCUAA-3' (SEQ ID NO: 1521)
3'-AAGUAGCACAGUUCGUAAAAAUCGAUU-5' (SEQ ID NO: 753)

C5-5018 Target:
5'-TTCATCGTGTCAAGCATTTTTAGCTAA-3' (SEQ ID NO: 1137)

5'-GUGUCAAGCAUUUUUAGCUAAUUUA-3' (SEQ ID NO: 1522)
3'-AGCACAGUUCGUAAAAAUCGAUUAAAU-5' (SEQ ID NO: 754)

C5-5022 Target:
5'-TCGTGTCAAGCATTTTTAGCTAATTTA-3' (SEQ ID NO: 1138)

5'-AAGCAUUUUUAGCUAAUUUAGAUGA-3' (SEQ ID NO: 1523)
3'-AGUUCGUAAAAAUCGAUUAAAUCUACU-5' (SEQ ID NO: 755)

C5-5027 Target:
5'-TCAAGCATTTTTAGCTAATTTAGATGA-3' (SEQ ID NO: 1139)

5'-UGGAUGCUAAAAUUCCUGAAGUUCA-3' (SEQ ID NO: 1524)
3'-UUACCUACGAUUUUAAGGACUUCAAGU-5' (SEQ ID NO: 756)

C5-5076 Target:
5'-AATGGATGCTAAAATTCCTGAAGTTCA-3' (SEQ ID NO: 1140)

5'-AUGGACUCCUGUUGUUGAAGUUCGU-3' (SEQ ID NO: 1525)
3'-AAUACCUGAGGACAACAACUUCAAGCA-5' (SEQ ID NO: 757)

C5-5121 Target:
5'-TTATGGACTCCTGTTGTTGAAGTTCGT-3' (SEQ ID NO: 1141)

5'-GGACUCCGUUGUUGAAGUUCGUUU-3' (SEQ ID NO: 1526)
3'-UACCUGAGGACAACAACUUCAAGCAAA-5' (SEQ ID NO: 758)

C5-5123 Target:
5'-ATGGACTCCTGTTGTTGAAGTTCGTTT-3' (SEQ ID NO: 1142)

5'-GACUCCUGUUGUUGAAGUUCGUUUU-3' (SEQ ID NO: 1527)
3'-ACCUGAGGACAACAACUUCAAGCAAAA-5' (SEQ ID NO: 759)

C5-5124 Target:
5'-TGGACTCCTGTTGTTGAAGTTCGTTTT-3' (SEQ ID NO: 1143)

5'-UUGCUUUUAUUAGAGAAUGAUUUCA-3' (SEQ ID NO: 1528)
3'-UGAACGAAAAUAAUCUCUUACUAAAGU-5' (SEQ ID NO: 760)

C5-5224 Target:
5'-ACTTGCTTTTATTAGAGAATGATTTCA-3' (SEQ ID NO: 1144)

5'-UGCUUUUAUUAGAGAAUGAUUUCAA-3' (SEQ ID NO: 1529)
3'-GAACGAAAAUAAUCUCUUACUAAAGUU-5' (SEQ ID NO: 761)

C5-5225 Target:
5'-CTTGCTTTTATTAGAGAATGATTTCAA-3' (SEQ ID NO: 1145)

5'-GCUUUUAUUAGAGAAUGAUUUCAAA-3' (SEQ ID NO: 1530)
3'-AACGAAAAUAAUCUCUUACUAAAGUUU-5' (SEQ ID NO: 762)

C5-5226 Target:
5'-TTGCTTTTATTAGAGAATGATTTCAAA-3' (SEQ ID NO: 1146)

5'-CUUUUAUUAGAGAAUGAUUUCAAAU-3' (SEQ ID NO: 1531)
3'-ACGAAAAUAAUCUCUUACUAAAGUUUA-5' (SEQ ID NO: 763)

C5-5227 Target:
5'-TGCTTTTATTAGAGAATGATTTCAAAT-3' (SEQ ID NO: 1147)

5'-CAGAUACUCCUCCAAGGUUAUUGGA-3' (SEQ ID NO: 1532)
3'-CUGUCUAUGAGGAGGUUCCAAUAACCU-5' (SEQ ID NO: 764)

C5-5295 Target:
5'-GACAGATACTCCTCCAAGGTTATTGGA-3' (SEQ ID NO: 1148)

5'-CAUUAAAGCCUGAGUUUGCUUUCAA-3' (SEQ ID NO: 1533)
3'-UAGUAAUUUCGGACUCAAACGAAAGUU-5' (SEQ ID NO: 765)

C5-5464 Target:
5'-ATCATTAAAGCCTGAGTTTGCTTTCAA-3' (SEQ ID NO: 1149)

5'-AUUAAAGCCUGAGUUUGCUUUCAAA-3' (SEQ ID NO: 1534)
3'-AGUAAUUUCGGACUCAAACGAAAGUUU-5' (SEQ ID NO: 766)

C5-5465 Target:
5'-TCATTAAAGCCTGAGTTTGCTTTCAAA-3' (SEQ ID NO: 1150)

5'-AAAGCCUGAGUUUGCUUUCAAAAAA-3' (SEQ ID NO: 1535)
3'-AAUUUCGGACUCAAACGAAAGUUUUUU-5' (SEQ ID NO: 767)

C5-5468 Target:
5'-TTAAAGCCTGAGTTTGCTTTCAAAAAA-3' (SEQ ID NO: 1151)

5'-AAGCCUGAGUUUGCUUUCAAAAAAA-3' (SEQ ID NO: 1536)
3'-AUUUCGGACUCAAACGAAAGUUUUUUU-5' (SEQ ID NO: 768)

C5-5469 Target:
5'-TAAAGCCTGAGTTTGCTTTCAAAAAAA-3' (SEQ ID NO: 1152)

TABLE 4

| DsiRNA Target Sequences (21 mers) in C5 mRNA |
|---|
| C5-120 21 nt Target:<br>5'-ACAUAUGUCAUUUCAGCACCA-3' (SEQ ID NO: 1537) |
| C5-169 21 nt Target:<br>5'-AUAUUGUGAUUCAAGUUUAUG-3' (SEQ ID NO: 1538) |
| C5-170 21 nt Target:<br>5'-UAUUGUGAUUCAAGUUUAUGG-3' (SEQ ID NO: 1539) |
| C5-171 21 nt Target:<br>5'-AUUGUGAUUCAAGUUUAUGGA-3' (SEQ ID NO: 1540) |
| C5-172 21 nt Target:<br>5'-UUGUGAUUCAAGUUUAUGGAU-3' (SEQ ID NO: 1541) |
| C5-173 21 nt Target:<br>5'-UGUGAUUCAAGUUUAUGGAUA-3' (SEQ ID NO: 1542) |
| C5-174 21 nt Target:<br>5'-GUGAUUCAAGUUUAUGGAUAC-3' (SEQ ID NO: 1543) |
| C5-175 21 nt Target:<br>5'-UGAUUCAAGUUUAUGGAUACA-3' (SEQ ID NO: 1544) |
| C5-176 21 nt Target:<br>5'-GAUUCAAGUUUAUGGAUACAC-3' (SEQ ID NO: 1545) |
| C5-177 21 nt Target:<br>5'-AUUCAAGUUUAUGGAUACACU-3' (SEQ ID NO: 1546) |
| C5-178 21 nt Target:<br>5'-UUCAAGUUUAUGGAUACACUG-3' (SEQ ID NO: 1547) |
| C5-179 21 nt Target:<br>5'-UCAAGUUUAUGGAUACACUGA-3' (SEQ ID NO: 1548) |
| C5-180 21 nt Target:<br>5'-CAAGUUUAUGGAUACACUGAA-3' (SEQ ID NO: 1549) |
| C5-182 21 nt Target:<br>5'-AGUUUAUGGAUACACUGAAGC-3' (SEQ ID NO: 1550) |
| C5-183 21 nt Target:<br>5'-GUUUAUGGAUACACUGAAGCA-3' (SEQ ID NO: 1551) |
| C5-185 21 nt Target:<br>5'-UUUAUGGAUACACUGAAGCAUU-3' (SEQ ID NO: 1552) |
| C5-187 21 nt Target:<br>5'-AUGGAUACACUGAAGCAUUUG-3' (SEQ ID NO: 1553) |
| C5-188 21 nt Target:<br>5'-UGGAUACACUGAAGCAUUUGA-3' (SEQ ID NO: 1554) |
| C5-189 21 nt Target:<br>5'-GGAUACACUGAAGCAUUUGAU-3' (SEQ ID NO: 1555) |
| C5-190 21 nt Target:<br>5'-GAUACACUGAAGCAUUUGAUG-3' (SEQ ID NO: 1556) |
| C5-191 21 nt Target:<br>5'-AUACACUGAAGCAUUUGAUGC-3' (SEQ ID NO: 1557) |
| C5-192 21 nt Target:<br>5'-UACACUGAAGCAUUUGAUGCA-3' (SEQ ID NO: 1558) |
| C5-193 21 nt Target:<br>5'-ACACUGAAGCAUUUGAUGCAA-3' (SEQ ID NO: 1559) |
| C5-194 21 nt Target:<br>5'-CACUGAAGCAUUUGAUGCAAC-3' (SEQ ID NO: 1560) |
| C5-196 21 nt Target:<br>5'-CUGAAGCAUUUGAUGCAACAA-3' (SEQ ID NO: 1561) |
| C5-198 21 nt Target:<br>5'-GAAGCAUUUGAUGCAACAAUC-3' (SEQ ID NO: 1562) |

TABLE 4-continued

| DsiRNA Target Sequences (21 mers) in C5 mRNA |
|---|
| C5-200 21 nt Target:<br>5'-AGCAUUUGAUGCAACAAUCUC-3' (SEQ ID NO: 1563) |
| C5-204 21 nt Target:<br>5'-UUUGAUGCAACAAUCUCUAUU-3' (SEQ ID NO: 1564) |
| C5-205 21 nt Target:<br>5'-UUGAUGCAACAAUCUCUAUUA-3' (SEQ ID NO: 1565) |
| C5-206 21 nt Target:<br>5'-UGAUGCAACAAUCUCUAUUAA-3' (SEQ ID NO: 1566) |
| C5-207 21 nt Target:<br>5'-GAUGCAACAAUCUCUAUUAAA-3' (SEQ ID NO: 1567) |
| C5-211 21 nt Target:<br>5'-CAACAAUCUCUAUUAAAGUU-3' (SEQ ID NO: 1568) |
| C5-212 21 nt Target:<br>5'-AACAAUCUCUAUUAAAGUUA-3' (SEQ ID NO: 1569) |
| C5-218 21 nt Target:<br>5'-CUCUAUUAAAGUUAUCCUGA-3' (SEQ ID NO: 1570) |
| C5-220 21 nt Target:<br>5'-CUAUUAAAGUUAUCCUGAUA-3' (SEQ ID NO: 1571) |
| C5-223 21 nt Target:<br>5'-UUAAAGUUAUCCUGAUAAAA-3' (SEQ ID NO: 1572) |
| C5-224 21 nt Target:<br>5'-UAAAAGUUAUCCUGAUAAAAA-3' (SEQ ID NO: 1573) |
| C5-227 21 nt Target:<br>5'-AAGUUAUCCUGAUAAAAAUU-3' (SEQ ID NO: 1574) |
| C5-228 21 nt Target:<br>5'-AGUUAUCCUGAUAAAAAUUU-3' (SEQ ID NO: 1575) |
| C5-265 21 nt Target:<br>5'-AUGUUCAUUUAUCCUCAGAGA-3' (SEQ ID NO: 1576) |
| C5-266 21 nt Target:<br>5'-UGUUCAUUUAUCCUCAGAGAA-3' (SEQ ID NO: 1577) |
| C5-360 21 nt Target:<br>5'-GUGUAUUGGAAGUUGUAUCA-3' (SEQ ID NO: 1578) |
| C5-361 21 nt Target:<br>5'-UGUAUUGGAAGUUGUAUCAA-3' (SEQ ID NO: 1579) |
| C5-364 21 nt Target:<br>5'-AUUUGGAAGUUGUAUCAAAGC-3' (SEQ ID NO: 1580) |
| C5-365 21 nt Target:<br>5'-UUUGGAAGUUGUAUCAAAGCA-3' (SEQ ID NO: 1581) |
| C5-366 21 nt Target:<br>5'-UUGGAAGUUGUAUCAAAGCAU-3' (SEQ ID NO: 1582) |
| C5-367 21 nt Target:<br>5'-UGGAAGUUGUAUCAAAGCAUU-3' (SEQ ID NO: 1583) |
| C5-368 21 nt Target:<br>5'-GGAAGUUGUAUCAAAGCAUUU-3' (SEQ ID NO: 1584) |
| C5-369 21 nt Target:<br>5'-GAAGUUGUAUCAAAGCAUUUU-3' (SEQ ID NO: 1585) |
| C5-370 21 nt Target:<br>5'-AAGUUGUAUCAAAGCAUUUUU-3' (SEQ ID NO: 1586) |
| C5-371 21 nt Target:<br>5'-AGUUGUAUCAAAGCAUUUUUC-3' (SEQ ID NO: 1587) |
| C5-372 21 nt Target:<br>5'-GUUGUAUCAAAGCAUUUUUCA-3' (SEQ ID NO: 1588) |

TABLE 4-continued

DsiRNA Target Sequences (21 mers) in C5 mRNA

C5-373 21 nt Target:
5'-UUGUAUCAAAGCAUUUUUCAA-3' (SEQ ID NO: 1589)

C5-408 21 nt Target:
5'-CCAAUAACCUAUGACAAUGGA-3' (SEQ ID NO: 1590)

C5-414 21 nt Target:
5'-ACCUAUGACAAUGGAUUUCUC-3' (SEQ ID NO: 1591)

C5-418 21 nt Target:
5'-AUGACAAUGGAUUUCUCUUCA-3' (SEQ ID NO: 1592)

C5-419 21 nt Target:
5'-UGACAAUGGAUUUCUCUUCAU-3' (SEQ ID NO: 1593)

C5-420 21 nt Target:
5'-GACAAUGGAUUUCUCUUCAUU-3' (SEQ ID NO: 1594)

C5-422 21 nt Target:
5'-CAAUGGAUUUCUCUUCAUUCA-3' (SEQ ID NO: 1595)

C5-423 21 nt Target:
5'-AAUGGAUUUCUCUUCAUUCAU-3' (SEQ ID NO: 1596)

C5-425 21 nt Target:
5'-UGGAUUUCUCUUCAUUCAUAC-3' (SEQ ID NO: 1597)

C5-436 21 nt Target:
5'-UCAUUCAUACAGACAAACCUG-3' (SEQ ID NO: 1598)

C5-438 21 nt Target:
5'-AUUCAUACAGACAAACCUGUU-3' (SEQ ID NO: 1599)

C5-439 21 nt Target:
5'-UUCAUACAGACAAACCUGUUU-3' (SEQ ID NO: 1600)

C5-440 21 nt Target:
5'-UCAUACAGACAAACCUGUUUA-3' (SEQ ID NO: 1601)

C5-481 21 nt Target:
5'-AAGUUAGAGUUUAUUCGUUGA-3' (SEQ ID NO: 1602)

C5-501 21 nt Target:
5'-AAUGACGACUUGAAGCCAGCC-3' (SEQ ID NO: 1603)

C5-502 21 nt Target:
5'-AUGACGACUUGAAGCCAGCCA-3' (SEQ ID NO: 1604)

C5-503 21 nt Target:
5'-UGACGACUUGAAGCCAGCCAA-3' (SEQ ID NO: 1605)

C5-504 21 nt Target:
5'-GACGACUUGAAGCCAGCCAAA-3' (SEQ ID NO: 1606)

C5-525 21 nt Target:
5'-AGAGAAACUGUCUUAACUUUC-3' (SEQ ID NO: 1607)

C5-529 21 nt Target:
5'-AAACUGUCUUAACUUUCAUAG-3' (SEQ ID NO: 1608)

C5-530 21 nt Target:
5'-AACUGUCUUAACUUUCAUAGA-3' (SEQ ID NO: 1609)

C5-553 21 nt Target:
5'-CUGAAGGAUCAGAAGUUGACA-3' (SEQ ID NO: 1610)

C5-554 21 nt Target:
5'-UGAAGGAUCAGAAGUUGACAU-3' (SEQ ID NO: 1611)

C5-568 21 nt Target:
5'-UUGACAUGGUAGAAGAAAUUG-3' (SEQ ID NO: 1612)

C5-569 21 nt Target:
5'-UGACAUGGUAGAAGAAAUUGA-3' (SEQ ID NO: 1613)

C5-573 21 nt Target:
5'-AUGGUAGAAGAAAUUGAUCAU-3' (SEQ ID NO: 1614)

C5-574 21 nt Target:
5'-UGGUAGAAGAAAUUGAUCAUA-3' (SEQ ID NO: 1615)

C5-578 21 nt Target:
5'-AGAAGAAAUUGAUCAUAUUGG-3' (SEQ ID NO: 1616)

C5-579 21 nt Target:
5'-GAAGAAAUUGAUCAUAUUGGA-3' (SEQ ID NO: 1617)

C5-595 21 nt Target:
5'-UUGGAAUUAUCUCUUUUCCUG-3' (SEQ ID NO: 1618)

C5-596 21 nt Target:
5'-UGGAAUUAUCUCUUUUCCUGA-3' (SEQ ID NO: 1619)

C5-597 21 nt Target:
5'-GGAAUUAUCUCUUUUCCUGAC-3' (SEQ ID NO: 1620)

C5-598 21 nt Target:
5'-GAAUUAUCUCUUUUCCUGACU-3' (SEQ ID NO: 1621)

C5-599 21 nt Target:
5'-AAUUAUCUCUUUUCCUGACUU-3' (SEQ ID NO: 1622)

C5-600 21 nt Target:
5'-AUUAUCUCUUUUCCUGACUUC-3' (SEQ ID NO: 1623)

C5-601 21 nt Target:
5'-UUAUCUCUUUUCCUGACUUCA-3' (SEQ ID NO: 1624)

C5-602 21 nt Target:
5'-UAUCUCUUUUCCUGACUUCAA-3' (SEQ ID NO: 1625)

C5-603 21 nt Target:
5'-AUCUCUUUUCCUGACUUCAAG-3' (SEQ ID NO: 1626)

C5-604 21 nt Target:
5'-UCUCUUUUCCUGACUUCAAGA-3' (SEQ ID NO: 1627)

C5-605 21 nt Target:
5'-CUCUUUUCCUGACUUCAAGAU-3' (SEQ ID NO: 1628)

C5-606 21 nt Target:
5'-UCUUUUCCUGACUUCAAGAUU-3' (SEQ ID NO: 1629)

C5-607 21 nt Target:
5'-CUUUUCCUGACUUCAAGAUUC-3' (SEQ ID NO: 1630)

C5-608 21 nt Target:
5'-UUUUCCUGACUUCAAGAUUCC-3' (SEQ ID NO: 1631)

C5-710 21 nt Target:
5'-AGUUAAAGAAUAUGUCUUGCC-3' (SEQ ID NO: 1632)

C5-711 21 nt Target:
5'-GUUAAAGAAUAUGUCUUGCCA-3' (SEQ ID NO: 1633)

C5-712 21 nt Target:
5'-UUAAAGAAUAUGUCUUGCCAC-3' (SEQ ID NO: 1634)

C5-775 21 nt Target:
5'-ACAAGAACUUUAAGAAUUUUG-3' (SEQ ID NO: 1635)

C5-776 21 nt Target:
5'-CAAGAACUUUAAGAAUUUUGA-3' (SEQ ID NO: 1636)

C5-780 21 nt Target:
5'-AACUUUAAGAAUUUUGAAAUU-3' (SEQ ID NO: 1637)

C5-786 21 nt Target:
5'-AAGAAUUUUGAAAUUACUAUA-3' (SEQ ID NO: 1638)

C5-787 21 nt Target:
5'-AGAAUUUUGAAAUUACUAUAA-3' (SEQ ID NO: 1639)

C5-788 21 nt Target:
5'-GAAUUUUGAAAUUACUAUAAA-3' (SEQ ID NO: 1640)

TABLE 4-continued

DsiRNA Target Sequences (21 mers) in C5 mRNA

C5-791 21 nt Target:
5'-UUUUGAAAUUACUAUAAAAGC-3' (SEQ ID NO: 1641)

C5-792 21 nt Target:
5'-UUUGAAAUUACUAUAAAAGCA-3' (SEQ ID NO: 1642)

C5-793 21 nt Target:
5'-UUGAAAUUACUAUAAAAGCAA-3' (SEQ ID NO: 1643)

C5-805 21 nt Target:
5'-UAAAAGCAAGAUAUUUUUAUA-3' (SEQ ID NO: 1644)

C5-806 21 nt Target:
5'-AAAAGCAAGAUAUUUUUAUAA-3' (SEQ ID NO: 1645)

C5-807 21 nt Target:
5'-AAAGCAAGAUAUUUUUAUAAU-3' (SEQ ID NO: 1646)

C5-808 21 nt Target:
5'-AAGCAAGAUAUUUUUAUAAUA-3' (SEQ ID NO: 1647)

C5-809 21 nt Target:
5'-AGCAAGAUAUUUUUAUAAUAA-3' (SEQ ID NO: 1648)

C5-810 21 nt Target:
5'-GCAAGAUAUUUUUAUAAUAAA-3' (SEQ ID NO: 1649)

C5-811 21 nt Target:
5'-CAAGAUAUUUUUAUAAUAAAG-3' (SEQ ID NO: 1650)

C5-812 21 nt Target:
5'-AAGAUAUUUUUAUAAUAAAGU-3' (SEQ ID NO: 1651)

C5-923 21 nt Target:
5'-CACAAUGUUGAUAAAUGGAAU-3' (SEQ ID NO: 1652)

C5-924 21 nt Target:
5'-ACAAUGUUGAUAAAUGGAAUU-3' (SEQ ID NO: 1653)

C5-926 21 nt Target:
5'-AAUGUUGAUAAAUGGAAUUGC-3' (SEQ ID NO: 1654)

C5-927 21 nt Target:
5'-AUGUUGAUAAAUGGAAUUGCU-3' (SEQ ID NO: 1655)

C5-928 21 nt Target:
5'-UGUUGAUAAAUGGAAUUGCUC-3' (SEQ ID NO: 1656)

C5-931 21 nt Target:
5'-UGAUAAAUGGAAUUGCUCAAG-3' (SEQ ID NO: 1657)

C5-935 21 nt Target:
5'-AAAUGGAAUUGCUCAAGUCAC-3' (SEQ ID NO: 1658)

C5-944 21 nt Target:
5'-UGCUCAAGUCACAUUUGAUUC-3' (SEQ ID NO: 1659)

C5-946 21 nt Target:
5'-CUCAAGUCACAUUUGAUUCUG-3' (SEQ ID NO: 1660)

C5-947 21 nt Target:
5'-UCAAGUCACAUUUGAUUCUGA-3' (SEQ ID NO: 1661)

C5-948 21 nt Target:
5'-CAAGUCACAUUUGAUUCUGAA-3' (SEQ ID NO: 1662)

C5-953 21 nt Target:
5'-CACAUUUGAUUCUGAAACAGC-3' (SEQ ID NO: 1663)

C5-955 21 nt Target:
5'-CAUUUGAUUCUGAAACAGCAG-3' (SEQ ID NO: 1664)

C5-956 21 nt Target:
5'-AUUUGAUUCUGAAACAGCAGU-3' (SEQ ID NO: 1665)

C5-968 21 nt Target:
5'-AACAGCAGUCAAAGAACUGUC-3' (SEQ ID NO: 1666)

C5-970 21 nt Target:
5'-CAGCAGUCAAAGAACUGUCAU-3' (SEQ ID NO: 1667)

C5-973 21 nt Target:
5'-CAGUCAAAGAACUGUCAUACU-3' (SEQ ID NO: 1668)

C5-977 21 nt Target:
5'-CAAAGAACUGUCAUACUACAG-3' (SEQ ID NO: 1669)

C5-978 21 nt Target:
5'-AAAGAACUGUCAUACUACAGU-3' (SEQ ID NO: 1670)

C5-980 21 nt Target:
5'-AGAACUGUCAUACUACAGUUU-3' (SEQ ID NO: 1671)

C5-1006 21 nt Target:
5'-AUUUAAACAACAAGUACCUUU-3' (SEQ ID NO: 1672)

C5-1007 21 nt Target:
5'-UUUAAACAACAAGUACCUUUA-3' (SEQ ID NO: 1673)

C5-1008 21 nt Target:
5'-UUAAACAACAAGUACCUUUAU-3' (SEQ ID NO: 1674)

C5-1009 21 nt Target:
5'-UAAACAACAAGUACCUUUAUA-3' (SEQ ID NO: 1675)

C5-1010 21 nt Target:
5'-AAACAACAAGUACCUUUAUAU-3' (SEQ ID NO: 1676)

C5-1011 21 nt Target:
5'-AACAACAAGUACCUUUAUAUU-3' (SEQ ID NO: 1677)

C5-1012 21 nt Target:
5'-ACAACAAGUACCUUUAUAUUG-3' (SEQ ID NO: 1678)

C5-1013 21 nt Target:
5'-CAACAAGUACCUUUAUAUUGC-3' (SEQ ID NO: 1679)

C5-1014 21 nt Target:
5'-AACAAGUACCUUUAUAUUGCU-3' (SEQ ID NO: 1680)

C5-1015 21 nt Target:
5'-ACAAGUACCUUUAUAUUGCUG-3' (SEQ ID NO: 1681)

C5-1016 21 nt Target:
5'-CAAGUACCUUUAUAUUGCUGU-3' (SEQ ID NO: 1682)

C5-1017 21 nt Target:
5'-AAGUACCUUUAUAUUGCUGUA-3' (SEQ ID NO: 1683)

C5-1019 21 nt Target:
5'-GUACCUUUAUAUUGCUGUAAC-3' (SEQ ID NO: 1684)

C5-1088 21 nt Target:
5'-CAUCAAAUAUGUCCUCUCUCC-3' (SEQ ID NO: 1685)

C5-1105 21 nt Target:
5'-CUCCCUACAAACUGAAUUUGG-3' (SEQ ID NO: 1686)

C5-1109 21 nt Target:
5'-CUACAAACUGAAUUUGGUUGC-3' (SEQ ID NO: 1687)

C5-1110 21 nt Target:
5'-UACAAACUGAAUUUGGUUGCU-3' (SEQ ID NO: 1688)

C5-1222 21 nt Target:
5'-CACUGAAUGCACAAACAAUUG-3' (SEQ ID NO: 1689)

C5-1223 21 nt Target:
5'-ACUGAAUGCACAAACAAUUGA-3' (SEQ ID NO: 1690)

C5-1249 21 nt Target:
5'-ACCAAGAGACAUCUGACUUGG-3' (SEQ ID NO: 1691)

C5-1250 21 nt Target:
5'-CCAAGAGACAUCUGACUUGGA-3' (SEQ ID NO: 1692)

TABLE 4-continued

DsiRNA Target Sequences (21 mers) in C5 mRNA

C5-1405 21 nt Target:
5'-AAGGUUACCGAGCAAUAGCAU-3' (SEQ ID NO: 1693)

C5-1433 21 nt Target:
5'-UCUCAGCCAAAGUUACCUUUA-3' (SEQ ID NO: 1694)

C5-1434 21 nt Target:
5'-CUCAGCCAAAGUUACCUUUAU-3' (SEQ ID NO: 1695)

C5-1435 21 nt Target:
5'-UCAGCCAAAGUUACCUUUAUA-3' (SEQ ID NO: 1696)

C5-1436 21 nt Target:
5'-CAGCCAAAGUUACCUUUAUAU-3' (SEQ ID NO: 1697)

C5-1519 21 nt Target:
5'-CCAAAAGCCCAUAUAUUGACA-3' (SEQ ID NO: 1698)

C5-1523 21 nt Target:
5'-AAGCCCAUAUAUUGACAAAAU-3' (SEQ ID NO: 1699)

C5-1524 21 nt Target:
5'-AGCCCAUAUAUUGACAAAAUA-3' (SEQ ID NO: 1700)

C5-1526 21 nt Target:
5'-CCCAUAUAUUGACAAAAUAAC-3' (SEQ ID NO: 1701)

C5-1527 21 nt Target:
5'-CCAUAUAUUGACAAAAUAACU-3' (SEQ ID NO: 1702)

C5-1528 21 nt Target:
5'-CAUAUAUUGACAAAAUAACUC-3' (SEQ ID NO: 1703)

C5-1531 21 nt Target:
5'-AUAUUGACAAAAUAACUCACU-3' (SEQ ID NO: 1704)

C5-1533 21 nt Target:
5'-AUUGACAAAAUAACUCACUAU-3' (SEQ ID NO: 1705)

C5-1534 21 nt Target:
5'-UUGACAAAAUAACUCACUAUA-3' (SEQ ID NO: 1706)

C5-1535 21 nt Target:
5'-UGACAAAAUAACUCACUAUAA-3' (SEQ ID NO: 1707)

C5-1536 21 nt Target:
5'-GACAAAAUAACUCACUAUAAU-3' (SEQ ID NO: 1708)

C5-1537 21 nt Target:
5'-ACAAAAUAACUCACUAUAAUU-3' (SEQ ID NO: 1709)

C5-1538 21 nt Target:
5'-CAAAAUAACUCACUAUAAUUA-3' (SEQ ID NO: 1710)

C5-1539 21 nt Target:
5'-AAAAUAACUCACUAUAAUUAC-3' (SEQ ID NO: 1711)

C5-1540 21 nt Target:
5'-AAAUAACUCACUAUAAUUACU-3' (SEQ ID NO: 1712)

C5-1541 21 nt Target:
5'-AAUAACUCACUAUAAUUACUU-3' (SEQ ID NO: 1713)

C5-1542 21 nt Target:
5'-AUAACUCACUAUAAUUACUUG-3' (SEQ ID NO: 1714)

C5-1543 21 nt Target:
5'-UAACUCACUAUAAUUACUUGA-3' (SEQ ID NO: 1715)

C5-1544 21 nt Target:
5'-AACUCACUAUAAUUACUUGAU-3' (SEQ ID NO: 1716)

C5-1545 21 nt Target:
5'-ACUCACUAUAAUUACUUGAUU-3' (SEQ ID NO: 1717)

C5-1546 21 nt Target:
5'-CUCACUAUAAUUACUUGAUUU-3' (SEQ ID NO: 1718)

C5-1547 21 nt Target:
5'-UCACUAUAAUUACUUGAUUUU-3' (SEQ ID NO: 1719)

C5-1548 21 nt Target:
5'-CACUAUAAUUACUUGAUUUUA-3' (SEQ ID NO: 1720)

C5-1549 21 nt Target:
5'-ACUAUAAUUACUUGAUUUUAU-3' (SEQ ID NO: 1721)

C5-1550 21 nt Target:
5'-CUAUAAUUACUUGAUUUUAUC-3' (SEQ ID NO: 1722)

C5-1551 21 nt Target:
5'-UAUAAUUACUUGAUUUUAUCC-3' (SEQ ID NO: 1723)

C5-1552 21 nt Target:
5'-AUAAUUACUUGAUUUUAUCCA-3' (SEQ ID NO: 1724)

C5-1553 21 nt Target:
5'-UAAUUACUUGAUUUUAUCCAA-3' (SEQ ID NO: 1725)

C5-1719 21 nt Target:
5'-GUGUCUGAUUCAGUCUGGUUA-3' (SEQ ID NO: 1726)

C5-1721 21 nt Target:
5'-GUCUGAUUCAGUCUGGUUAAA-3' (SEQ ID NO: 1727)

C5-1722 21 nt Target:
5'-UCUGAUUCAGUCUGGUUAAAU-3' (SEQ ID NO: 1728)

C5-1723 21 nt Target:
5'-CUGAUUCAGUCUGGUUAAAUA-3' (SEQ ID NO: 1729)

C5-1724 21 nt Target:
5'-UGAUUCAGUCUGGUUAAAUAU-3' (SEQ ID NO: 1730)

C5-1726 21 nt Target:
5'-AUUCAGUCUGGUUAAAUAUUG-3' (SEQ ID NO: 1731)

C5-1727 21 nt Target:
5'-UUCAGUCUGGUUAAAUAUUGA-3' (SEQ ID NO: 1732)

C5-1728 21 nt Target:
5'-UCAGUCUGGUUAAAUAUUGAA-3' (SEQ ID NO: 1733)

C5-1729 21 nt Target:
5'-CAGUCUGGUUAAAUAUUGAAG-3' (SEQ ID NO: 1734)

C5-1730 21 nt Target:
5'-AGUCUGGUUAAAUAUUGAAGA-3' (SEQ ID NO: 1735)

C5-1731 21 nt Target:
5'-GUCUGGUUAAAUAUUGAAGAA-3' (SEQ ID NO: 1736)

C5-1732 21 nt Target:
5'-UCUGGUUAAAUAUUGAAGAAA-3' (SEQ ID NO: 1737)

C5-1733 21 nt Target:
5'-CUGGUUAAAUAUUGAAGAAAA-3' (SEQ ID NO: 1738)

C5-1753 21 nt Target:
5'-AAUGUGGCAACCAGCUCCAGG-3' (SEQ ID NO: 1739)

C5-1754 21 nt Target:
5'-AUGUGGCAACCAGCUCCAGGU-3' (SEQ ID NO: 1740)

C5-1948 21 nt Target:
5'-AUCUGGGCUGUGGGGCAGGUG-3' (SEQ ID NO: 1741)

C5-1949 21 nt Target:
5'-UCUGGGCUGUGGGGCAGGUGG-3' (SEQ ID NO: 1742)

C5-1950 21 nt Target:
5'-CUGGGCUGUGGGGCAGGUGGU-3' (SEQ ID NO: 1743)

C5-1951 21 nt Target:
5'-UGGGCUGUGGGGCAGGUGGUG-3' (SEQ ID NO: 1744)

TABLE 4-continued

DsiRNA Target Sequences (21 mers) in C5 mRNA

C5-1952 21 nt Target:
5'-GGGCUGUGGGGCAGGUGGUGG-3' (SEQ ID NO: 1745)

C5-1953 21 nt Target:
5'-GGCUGUGGGGCAGGUGGUGGC-3' (SEQ ID NO: 1746)

C5-1954 21 nt Target:
5'-GCUGUGGGGCAGGUGGUGGCC-3' (SEQ ID NO: 1747)

C5-2043 21 nt Target:
5'-CAAGAAAAUGAUGAACCUUGU-3' (SEQ ID NO: 1748)

C5-2048 21 nt Target:
5'-AAAUGAUGAACCUUGUAAAGA-3' (SEQ ID NO: 1749)

C5-2050 21 nt Target:
5'-AUGAUGAACCUUGUAAAGAAA-3' (SEQ ID NO: 1750)

C5-2051 21 nt Target:
5'-UGAUGAACCUUGUAAAGAAAU-3' (SEQ ID NO: 1751)

C5-2057 21 nt Target:
5'-ACCUUGUAAAGAAAUUCUCAG-3' (SEQ ID NO: 1752)

C5-2058 21 nt Target:
5'-CCUUGUAAAGAAAUUCUCAGG-3' (SEQ ID NO: 1753)

C5-2133 21 nt Target:
5'-UCAGUAGUGAAGAAAUGUUGU-3' (SEQ ID NO: 1754)

C5-2134 21 nt Target:
5'-CAGUAGUGAAGAAAUGUUGUU-3' (SEQ ID NO: 1755)

C5-2316 21 nt Target:
5'-AUGAAGACCCUGUUACCAGUA-3' (SEQ ID NO: 1756)

C5-2337 21 nt Target:
5'-AGCAAGCCAGAAAUUCGGAGU-3' (SEQ ID NO: 1757)

C5-2498 21 nt Target:
5'-UGUCAAGGCAAAGGUGUUCAA-3' (SEQ ID NO: 1758)

C5-2499 21 nt Target:
5'-GUCAAGGCAAAGGUGUUCAAA-3' (SEQ ID NO: 1759)

C5-2500 21 nt Target:
5'-UCAAGGCAAAGGUGUUCAAAG-3' (SEQ ID NO: 1760)

C5-2501 21 nt Target:
5'-CAAGGCAAAGGUGUUCAAAGA-3' (SEQ ID NO: 1761)

C5-2518 21 nt Target:
5'-AAGAUGUCUUCCUGGAAAUGA-3' (SEQ ID NO: 1762)

C5-2527 21 nt Target:
5'-UCCUGGAAAUGAAUAUACCAU-3' (SEQ ID NO: 1763)

C5-2528 21 nt Target:
5'-CCUGGAAAUGAAUAUACCAUA-3' (SEQ ID NO: 1764)

C5-2529 21 nt Target:
5'-CUGGAAAUGAAUAUACCAUAU-3' (SEQ ID NO: 1765)

C5-2530 21 nt Target:
5'-UGGAAAUGAAUAUACCAUAUU-3' (SEQ ID NO: 1766)

C5-2531 21 nt Target:
5'-GGAAAUGAAUAUACCAUAUUC-3' (SEQ ID NO: 1767)

C5-2532 21 nt Target:
5'-GAAAUGAAUAUACCAUAUUCU-3' (SEQ ID NO: 1768)

C5-2533 21 nt Target:
5'-AAAUGAAUAUACCAUAUUCUG-3' (SEQ ID NO: 1769)

C5-2534 21 nt Target:
5'-AAUGAAUAUACCAUAUUCUGU-3' (SEQ ID NO: 1770)

C5-2535 21 nt Target:
5'-AUGAAUAUACCAUAUUCUGUU-3' (SEQ ID NO: 1771)

C5-2536 21 nt Target:
5'-UGAAUAUACCAUAUUCUGUUG-3' (SEQ ID NO: 1772)

C5-2537 21 nt Target:
5'-GAAUAUACCAUAUUCUGUUGU-3' (SEQ ID NO: 1773)

C5-2557 21 nt Target:
5'-UACGAGGAGAACAGAUCCAAU-3' (SEQ ID NO: 1774)

C5-2558 21 nt Target:
5'-ACGAGGAGAACAGAUCCAAUU-3' (SEQ ID NO: 1775)

C5-2559 21 nt Target:
5'-CGAGGAGAACAGAUCCAAUUG-3' (SEQ ID NO: 1776)

C5-2560 21 nt Target:
5'-GAGGAGAACAGAUCCAAUUGA-3' (SEQ ID NO: 1777)

C5-2561 21 nt Target:
5'-AGGAGAACAGAUCCAAUUGAA-3' (SEQ ID NO: 1778)

C5-2562 21 nt Target:
5'-GGAGAACAGAUCCAAUUGAAA-3' (SEQ ID NO: 1779)

C5-2563 21 nt Target:
5'-GAGAACAGAUCCAAUUGAAAG-3' (SEQ ID NO: 1780)

C5-2564 21 nt Target:
5'-AGAACAGAUCCAAUUGAAAGG-3' (SEQ ID NO: 1781)

C5-2565 21 nt Target:
5'-GAACAGAUCCAAUUGAAAGGA-3' (SEQ ID NO: 1782)

C5-2566 21 nt Target:
5'-AACAGAUCCAAUUGAAAGGAA-3' (SEQ ID NO: 1783)

C5-2567 21 nt Target:
5'-ACAGAUCCAAUUGAAAGGAAC-3' (SEQ ID NO: 1784)

C5-2568 21 nt Target:
5'-CAGAUCCAAUUGAAAGGAACU-3' (SEQ ID NO: 1785)

C5-2569 21 nt Target:
5'-AGAUCCAAUUGAAAGGAACUG-3' (SEQ ID NO: 1786)

C5-2570 21 nt Target:
5'-GAUCCAAUUGAAAGGAACUGU-3' (SEQ ID NO: 1787)

C5-2571 21 nt Target:
5'-AUCCAAUUGAAAGGAACUGUU-3' (SEQ ID NO: 1788)

C5-2572 21 nt Target:
5'-UCCAAUUGAAAGGAACUGUUU-3' (SEQ ID NO: 1789)

C5-2573 21 nt Target:
5'-CCAAUUGAAAGGAACUGUUUA-3' (SEQ ID NO: 1790)

C5-2574 21 nt Target:
5'-CAAUUGAAAGGAACUGUUUAC-3' (SEQ ID NO: 1791)

C5-2575 21 nt Target:
5'-AAUUGAAAGGAACUGUUUACA-3' (SEQ ID NO: 1792)

C5-2576 21 nt Target:
5'-AUUGAAAGGAACUGUUUACAA-3' (SEQ ID NO: 1793)

C5-2577 21 nt Target:
5'-UUGAAAGGAACUGUUUACAAC-3' (SEQ ID NO: 1794)

C5-2578 21 nt Target:
5'-UGAAAGGAACUGUUUACAACU-3' (SEQ ID NO: 1795)

C5-2579 21 nt Target:
5'-GAAAGGAACUGUUUACAACUA-3' (SEQ ID NO: 1796)

TABLE 4-continued

DsiRNA Target Sequences (21 mers) in C5 mRNA

C5-2580 21 nt Target:
5'-AAAGGAACUGUUUACAACUAU-3' (SEQ ID NO: 1797)

C5-2581 21 nt Target:
5'-AAGGAACUGUUUACAACUAUA-3' (SEQ ID NO: 1798)

C5-2623 21 nt Target:
5'-GUGUUAAAAUGUCUGCUGUGG-3' (SEQ ID NO: 1799)

C5-2624 21 nt Target:
5'-UGUUAAAAUGUCUGCUGUGGA-3' (SEQ ID NO: 1800)

C5-2625 21 nt Target:
5'-GUUAAAAUGUCUGCUGUGGAG-3' (SEQ ID NO: 1801)

C5-2626 21 nt Target:
5'-UUAAAAUGUCUGCUGUGGAGG-3' (SEQ ID NO: 1802)

C5-2627 21 nt Target:
5'-UAAAAUGUCUGCUGUGGAGGG-3' (SEQ ID NO: 1803)

C5-2753 21 nt Target:
5'-UGUGCUUCCUCUGGAAAUUGG-3' (SEQ ID NO: 1804)

C5-2754 21 nt Target:
5'-GUGCUUCCUCUGGAAAUUGGC-3' (SEQ ID NO: 1805)

C5-2755 21 nt Target:
5'-UGCUUCCUCUGGAAAUUGGCC-3' (SEQ ID NO: 1806)

C5-2756 21 nt Target:
5'-GCUUCCUCUGGAAAUUGGCCU-3' (SEQ ID NO: 1807)

C5-2757 21 nt Target:
5'-CUUCCUCUGGAAAUUGGCCUU-3' (SEQ ID NO: 1808)

C5-2758 21 nt Target:
5'-UUCCUCUGGAAAUUGGCCUUC-3' (SEQ ID NO: 1809)

C5-2759 21 nt Target:
5'-UCCUCUGGAAAUUGGCCUUCA-3' (SEQ ID NO: 1810)

C5-2760 21 nt Target:
5'-CCUCUGGAAAUUGGCCUUCAC-3' (SEQ ID NO: 1811)

C5-2967 21 nt Target:
5'-ACAGAAAUCAAAGGAUUUUG-3' (SEQ ID NO: 1812)

C5-2968 21 nt Target:
5'-CAGAAAUCAAAGGAUUUUGA-3' (SEQ ID NO: 1813)

C5-2973 21 nt Target:
5'-AUCAAAGGAUUUUGAGUGUA-3' (SEQ ID NO: 1814)

C5-3049 21 nt Target:
5'-AUAUCCUAACCCACCUCCCCA-3' (SEQ ID NO: 1815)

C5-3050 21 nt Target:
5'-UAUCCUAACCCACCUCCCCAA-3' (SEQ ID NO: 1816)

C5-3103 21 nt Target:
5'-UCCCAGUAUUCUAUGUUUUC-3' (SEQ ID NO: 1817)

C5-3135 21 nt Target:
5'-ACAGGAAAUCAUUGGAACAUU-3' (SEQ ID NO: 1818)

C5-3136 21 nt Target:
5'-CAGGAAAUCAUUGGAACAUUU-3' (SEQ ID NO: 1819)

C5-3216 21 nt Target:
5'-UUGAGCAUUAUGUCCUACAGA-3' (SEQ ID NO: 1820)

C5-3281 21 nt Target:
5'-CACUUGGUUAACAGCUUUUGC-3' (SEQ ID NO: 1821)

C5-3284 21 nt Target:
5'-UUGGUUAACAGCUUUUGCUUU-3' (SEQ ID NO: 1822)

C5-3285 21 nt Target:
5'-UGGUUAACAGCUUUUGCUUUA-3' (SEQ ID NO: 1823)

C5-3298 21 nt Target:
5'-UUGCUUUAAGAGUACUUGGAC-3' (SEQ ID NO: 1824)

C5-3299 21 nt Target:
5'-UGCUUUAAGAGUACUUGGACA-3' (SEQ ID NO: 1825)

C5-3302 21 nt Target:
5'-UUUAAGAGUACUUGGACAAGU-3' (SEQ ID NO: 1826)

C5-3303 21 nt Target:
5'-UUAAGAGUACUUGGACAAGUA-3' (SEQ ID NO: 1827)

C5-3332 21 nt Target:
5'-CGUAGAGCAGAACCAAAAUUC-3' (SEQ ID NO: 1828)

C5-3333 21 nt Target:
5'-GUAGAGCAGAACCAAAAUUCA-3' (SEQ ID NO: 1829)

C5-3334 21 nt Target:
5'-UAGAGCAGAACCAAAAUUCAA-3' (SEQ ID NO: 1830)

C5-3335 21 nt Target:
5'-AGAGCAGAACCAAAAUUCAAU-3' (SEQ ID NO: 1831)

C5-3419 21 nt Target:
5'-UUCACAGUAUCAACCAAUAAA-3' (SEQ ID NO: 1832)

C5-3429 21 nt Target:
5'-CAACCAAUAAAAUUACAGGGU-3' (SEQ ID NO: 1833)

C5-3430 21 nt Target:
5'-AACCAAUAAAAUUACAGGGUA-3' (SEQ ID NO: 1834)

C5-3431 21 nt Target:
5'-ACCAAUAAAAUUACAGGGUAC-3' (SEQ ID NO: 1835)

C5-3497 21 nt Target:
5'-UACUGUGAUUGGAAUUAGAAA-3' (SEQ ID NO: 1836)

C5-3498 21 nt Target:
5'-ACUGUGAUUGGAAUUAGAAAG-3' (SEQ ID NO: 1837)

C5-3499 21 nt Target:
5'-CUGUGAUUGGAAUUAGAAAGG-3' (SEQ ID NO: 1838)

C5-3500 21 nt Target:
5'-UGUGAUUGGAAUUAGAAAGGC-3' (SEQ ID NO: 1839)

C5-3672 21 nt Target:
5'-CGUUCAAUUGUUUCAGCUUUG-3' (SEQ ID NO: 1840)

C5-3690 21 nt Target:
5'-UUGAAGAGAAGCUUUGGUU-3' (SEQ ID NO: 1841)

C5-3691 21 nt Target:
5'-UGAAGAGAAGCUUUGGUUA-3' (SEQ ID NO: 1842)

C5-3692 21 nt Target:
5'-GAAGAGAAGCUUUGGUUAA-3' (SEQ ID NO: 1843)

C5-3696 21 nt Target:
5'-AGAGAAGCUUUGGUUAAAGGU-3' (SEQ ID NO: 1844)

C5-3697 21 nt Target:
5'-GAGAAGCUUUGGUUAAAGGUA-3' (SEQ ID NO: 1845)

C5-3722 21 nt Target:
5'-ACCCAUUUAUCGUUUUUGGAA-3' (SEQ ID NO: 1846)

C5-3814 21 nt Target:
5'-AUGCUUUACUCACCAGUCUGA-3' (SEQ ID NO: 1847)

C5-3815 21 nt Target:
5'-UGCUUUACUCACCAGUCUGAA-3' (SEQ ID NO: 1848)

TABLE 4-continued

DsiRNA Target Sequences (21 mers) in C5 mRNA

C5-3820 21 nt Target:
5'-UACUCACCAGUCUGAACUUGA-3' (SEQ ID NO: 1849)

C5-3824 21 nt Target:
5'-CACCAGUCUGAACUUGAAAGA-3' (SEQ ID NO: 1850)

C5-3880 21 nt Target:
5'-CAGAAGAGCAGAGGUAUGGAG-3' (SEQ ID NO: 1851)

C5-3881 21 nt Target:
5'-AGAAGAGCAGAGGUAUGGAGG-3' (SEQ ID NO: 1852)

C5-3949 21 nt Target:
5'-CGGAAUAUUCACUCCUGGUUA-3' (SEQ ID NO: 1853)

C5-4019 21 nt Target:
5'-UGCCUUACAUAAUUAUAAAAU-3' (SEQ ID NO: 1854)

C5-4132 21 nt Target:
5'-UACAUGUAACAACUGUAGUUC-3' (SEQ ID NO: 1855)

C5-4168 21 nt Target:
5'-CUGAGGAAGUUUGCAGCUUUU-3' (SEQ ID NO: 1856)

C5-4169 21 nt Target:
5'-UGAGGAAGUUUGCAGCUUUUA-3' (SEQ ID NO: 1857)

C5-4170 21 nt Target:
5'-GAGGAAGUUUGCAGCUUUUAU-3' (SEQ ID NO: 1858)

C5-4171 21 nt Target:
5'-AGGAAGUUUGCAGCUUUUAUU-3' (SEQ ID NO: 1859)

C5-4172 21 nt Target:
5'-GGAAGUUUGCAGCUUUUAUUU-3' (SEQ ID NO: 1860)

C5-4173 21 nt Target:
5'-GAAGUUUGCAGCUUUUAUUUG-3' (SEQ ID NO: 1861)

C5-4174 21 nt Target:
5'-AAGUUUGCAGCUUUUAUUUGA-3' (SEQ ID NO: 1862)

C5-4175 21 nt Target:
5'-AGUUUGCAGCUUUUAUUUGAA-3' (SEQ ID NO: 1863)

C5-4178 21 nt Target:
5'-UUGCAGCUUUUAUUUGAAAAU-3' (SEQ ID NO: 1864)

C5-4199 21 nt Target:
5'-CGAUACUCAGGAUAUUGAAGC-3' (SEQ ID NO: 1865)

C5-4204 21 nt Target:
5'-CUCAGGAUAUUGAAGCAUCCC-3' (SEQ ID NO: 1866)

C5-4262 21 nt Target:
5'-AGUAGCAUGUGCCAGCUACAA-3' (SEQ ID NO: 1867)

C5-4263 21 nt Target:
5'-GUAGCAUGUGCCAGCUACAAG-3' (SEQ ID NO: 1868)

C5-4264 21 nt Target:
5'-UAGCAUGUGCCAGCUACAAGC-3' (SEQ ID NO: 1869)

C5-4265 21 nt Target:
5'-AGCAUGUGCCAGCUACAAGCC-3' (SEQ ID NO: 1870)

C5-4266 21 nt Target:
5'-GCAUGUGCCAGCUACAAGCCC-3' (SEQ ID NO: 1871)

C5-4267 21 nt Target:
5'-CAUGUGCCAGCUACAAGCCCA-3' (SEQ ID NO: 1872)

C5-4268 21 nt Target:
5'-AUGUGCCAGCUACAAGCCCAG-3' (SEQ ID NO: 1873)

C5-4269 21 nt Target:
5'-UGUGCCAGCUACAAGCCCAGC-3' (SEQ ID NO: 1874)

C5-4270 21 nt Target:
5'-GUGCCAGCUACAAGCCCAGCA-3' (SEQ ID NO: 1875)

C5-4423 21 nt Target:
5'-AAGAUGGACAUGUUAUUCUGC-3' (SEQ ID NO: 1876)

C5-4424 21 nt Target:
5'-AGAUGGACAUGUUAUUCUGCA-3' (SEQ ID NO: 1877)

C5-4426 21 nt Target:
5'-AUGGACAUGUUAUUCUGCAAC-3' (SEQ ID NO: 1878)

C5-4428 21 nt Target:
5'-GGACAUGUUAUUCUGCAACUG-3' (SEQ ID NO: 1879)

C5-4429 21 nt Target:
5'-GACAUGUUAUUCUGCAACUGA-3' (SEQ ID NO: 1880)

C5-4430 21 nt Target:
5'-ACAUGUUAUUCUGCAACUGAA-3' (SEQ ID NO: 1881)

C5-4435 21 nt Target:
5'-UUAUUCUGCAACUGAAUUCGA-3' (SEQ ID NO: 1882)

C5-4436 21 nt Target:
5'-UAUUCUGCAACUGAAUUCGAU-3' (SEQ ID NO: 1883)

C5-4558 21 nt Target:
5'-CAGAUAAACAGUGUACCAUGU-3' (SEQ ID NO: 1884)

C5-4559 21 nt Target:
5'-AGAUAAACAGUGUACCAUGUU-3' (SEQ ID NO: 1885)

C5-4561 21 nt Target:
5'-AUAAACAGUGUACCAUGUUU-3' (SEQ ID NO: 1886)

C5-4563 21 nt Target:
5'-AAACAGUGUACCAUGUUUUAU-3' (SEQ ID NO: 1887)

C5-4580 21 nt Target:
5'-UUAUAGCACUUCCAAUAUCAA-3' (SEQ ID NO: 1888)

C5-4601 21 nt Target:
5'-AAUUCAGAAAGUCUGUGAAGG-3' (SEQ ID NO: 1889)

C5-4602 21 nt Target:
5'-AUUCAGAAAGUCUGUGAAGGA-3' (SEQ ID NO: 1890)

C5-4603 21 nt Target:
5'-UUCAGAAAGUCUGUGAAGGAG-3' (SEQ ID NO: 1891)

C5-4604 21 nt Target:
5'-UCAGAAAGUCUGUGAAGGAGC-3' (SEQ ID NO: 1892)

C5-4717 21 nt Target:
5'-AACCAGAGAUUGCAUAUGCUU-3' (SEQ ID NO: 1893)

C5-4718 21 nt Target:
5'-ACCAGAGAUUGCAUAUGCUUA-3' (SEQ ID NO: 1894)

C5-4719 21 nt Target:
5'-CCAGAGAUUGCAUAUGCUUAU-3' (SEQ ID NO: 1895)

C5-4720 21 nt Target:
5'-CAGAGAUUGCAUAUGCUUAUA-3' (SEQ ID NO: 1896)

C5-4721 21 nt Target:
5'-AGAGAUUGCAUAUGCUUAUAA-3' (SEQ ID NO: 1897)

C5-4764 21 nt Target:
5'-GUAGAAAAUGUUUUUGUCAAG-3' (SEQ ID NO: 1898)

C5-4765 21 nt Target:
5'-UAGAAAAUGUUUUUGUCAAGU-3' (SEQ ID NO: 1899)

C5-4766 21 nt Target:
5'-AGAAAAUGUUUUUGUCAAGUA-3' (SEQ ID NO: 1900)

TABLE 4-continued

DsiRNA Target Sequences (21 mers) in C5 mRNA

C5-4767 21 nt Target:
5'-GAAAAUGUUUUUGUCAAGUAC-3' (SEQ ID NO: 1901)

C5-4768 21 nt Target:
5'-AAAAUGUUUUUGUCAAGUACA-3' (SEQ ID NO: 1902)

C5-4929 21 nt Target:
5'-CUCCAGAUAAAAUACAAUUUC-3' (SEQ ID NO: 1903)

C5-5013 21 nt Target:
5'-ACAUGUUCAUCGUGUCAAGCA-3' (SEQ ID NO: 1904)

C5-5018 21 nt Target:
5'-UUCAUCGUGUCAAGCAUUUUU-3' (SEQ ID NO: 1905)

C5-5022 21 nt Target:
5'-UCGUGUCAAGCAUUUUUAGCU-3' (SEQ ID NO: 1906)

C5-5027 21 nt Target:
5'-UCAAGCAUUUUUAGCUAAUUU-3' (SEQ ID NO: 1907)

C5-5076 21 nt Target:
5'-AAUGGAUGCUAAAAUUCCUGA-3' (SEQ ID NO: 1908)

C5-5121 21 nt Target:
5'-UUAUGGACUCCUGUUGUUGAA-3' (SEQ ID NO: 1909)

C5-5123 21 nt Target:
5'-AUGGACUCCUGUUGUUGAAGU-3' (SEQ ID NO: 1910)

C5-5124 21 nt Target:
5'-UGGACUCCUGUUGUUGAAGUU-3' (SEQ ID NO: 1911)

C5-5224 21 nt Target:
5'-ACUUGCUUUUAUUAGAGAAUG-3' (SEQ ID NO: 1912)

C5-5225 21 nt Target:
5'-CUUGCUUUUAUUAGAGAAUGA-3' (SEQ ID NO: 1913)

C5-5226 21 nt Target:
5'-UUGCUUUUAUUAGAGAAUGAU-3' (SEQ ID NO: 1914)

C5-5227 21 nt Target:
5'-UGCUUUUAUUAGAGAAUGAUU-3' (SEQ ID NO: 1915)

C5-5295 21 nt Target:
5'-GACAGAUACUCCUCCAAGGUU-3' (SEQ ID NO: 1916)

C5-5464 21 nt Target:
5'-AUCAUUAAAGCCUGAGUUUGC-3' (SEQ ID NO: 1917)

C5-5465 21 nt Target:
5'-UCAUUAAAGCCUGAGUUUGCU-3' (SEQ ID NO: 1918)

C5-5468 21 nt Target:
5'-UUAAAGCCUGAGUUUGCUUUC-3' (SEQ ID NO: 1919)

C5-5469 21 nt Target:
5'-UAAAGCCUGAGUUUGCUUUCA-3' (SEQ ID NO: 1920)

Table 5

Selected Human Anti-C5 "Blunt/Blunt" DsiRNAs

5'-ACAUAUGUCAUUUCAGCACCAAAAAUA-3' (SEQ ID NO: 1921)

3'-UGUAUACAGUAAAGUCGUGGUUUUUAU-5' (SEQ ID NO: 385)

C5-120 Target:
5'-ACATATGTCATTTCAGCACCAAAAATA-3' (SEQ ID NO: 769)

5'-AUAUUGUGAUUCAAGUUUAUGGAUACA-3' (SEQ ID NO: 1922)

3'-UAUAACACUAAGUUCAAAUACCUAUGU-5' (SEQ ID NO: 386)

Table 5-continued

Selected Human Anti-C5 "Blunt/Blunt" DsiRNAs

C5-169 Target:
5'-ATATTGTGATTCAAGTTTATGGATACA-3' (SEQ ID NO: 770)

5'-UAUUGUGAUUCAAGUUUAUGGAUACAC-3' (SEQ ID NO: 1923)

3'-AUAACACUAAGUUCAAAUACCUAUGUG-5' (SEQ ID NO: 387)

C5-170 Target:
5'-TATTGTGATTCAAGTTTATGGATACAC-3' (SEQ ID NO: 771)

5'-AUUGUGAUUCAAGUUUAUGGAUACACU-3' (SEQ ID NO: 1924)

3'-UAACACUAAGUUCAAAUACCUAUGUGA-5' (SEQ ID NO: 388)

C5-171 Target:
5'-ATTGTGATTCAAGTTTATGGATACACT-3' (SEQ ID NO: 772)

5'-UUGUGAUUCAAGUUUAUGGAUACACUG-3' (SEQ ID NO: 1925)

3'-AACACUAAGUUCAAAUACCUAUGUGAC-5' (SEQ ID NO: 389)

C5-172 Target:
5'-TTGTGATTCAAGTTTATGGATACACTG-3' (SEQ ID NO: 773)

5'-UGUGAUUCAAGUUUAUGGAUACACUGA-3' (SEQ ID NO: 1926)

3'-ACACUAAGUUCAAAUACCUAUGUGACU-5' (SEQ ID NO: 390)

C5-173 Target:
5'-TGTGATTCAAGTTTATGGATACACTGA-3' (SEQ ID NO: 774)

5'-GUGAUUCAAGUUUAUGGAUACACUGAA-3' (SEQ ID NO: 1927)

3'-CACUAAGUUCAAAUACCUAUGUGACUU-5' (SEQ ID NO: 391)

C5-174 Target:
5'-GTGATTCAAGTTTATGGATACACTGAA-3' (SEQ ID NO: 775)

5'-UGAUUCAAGUUUAUGGAUACACUGAAG-3' (SEQ ID NO: 1928)

3'-ACUAAGUUCAAAUACCUAUGUGACUUC-5' (SEQ ID NO: 392)

C5-175 Target:
5'-TGATTCAAGTTTATGGATACACTGAAG-3' (SEQ ID NO: 776)

5'-GAUUCAAGUUUAUGGAUACACUGAAGC-3' (SEQ ID NO: 1929)

3'-CUAAGUUCAAAUACCUAUGUGACUUCG-5' (SEQ ID NO: 393)

C5-176 Target:
5'-GATTCAAGTTTATGGATACACTGAAGC-3' (SEQ ID NO: 777)

5'-AUUCAAGUUUAUGGAUACACUGAAGCA-3' (SEQ ID NO: 1930)

3'-UAAGUUCAAAUACCUAUGUGACUUCGU-5' (SEQ ID NO: 394)

C5-177 Target:
5'-ATTCAAGTTTATGGATACACTGAAGCA-3' (SEQ ID NO: 778)

5'-UUCAAGUUUAUGGAUACACUGAAGCAU-3' (SEQ ID NO: 1931)

3'-AAGUUCAAAUACCUAUGUGACUUCGUA-5' (SEQ ID NO: 395)

C5-178 Target:
5'-TTCAAGTTTATGGATACACTGAAGCAT-3' (SEQ ID NO: 779)

5'-UCAAGUUUAUGGAUACACUGAAGCAUU-3' (SEQ ID NO: 1932)

3'-AGUUCAAAUACCUAUGUGACUUCGUAA-5' (SEQ ID NO: 396)

C5-179 Target:
5'-TCAAGTTTATGGATACACTGAAGCATT-3' (SEQ ID NO: 780)

5'-CAAGUUUAUGGAUACACUGAAGCAUUU-3' (SEQ ID NO: 1933)

3'-GUUCAAAUACCUAUGUGACUUCGUAAA-5' (SEQ ID NO: 397)

Table 5-continued

Selected Human Anti-C5 "Blunt/Blunt" DsiRNAs

C5-180 Target:
5'-CAAGTTTATGGATACACTGAAGCATTT-3' (SEQ ID NO: 781)

5'-AGUUUAUGGAUACACUGAAGCAUUUGA-3' (SEQ ID NO: 1934)

3'-UCAAAUACCUAUGUGACUUCGUAAACU-5' (SEQ ID NO: 398)

C5-182 Target:
5'-AGTTTATGGATACACTGAAGCATTTGA-3' (SEQ ID NO: 782)

5'-GUUUAUGGAUACACUGAAGCAUUUGAU-3' (SEQ ID NO: 1935)

3'-CAAAUACCUAUGUGACUUCGUAAACUA-5' (SEQ ID NO: 399)

C5-183 Target:
5'-GTTTATGGATACACTGAAGCATTTGAT-3' (SEQ ID NO: 783)

5'-UUUAUGGAUACACUGAAGCAUUUGAUGC-3' (SEQ ID NO: 1936)

3'-AAUACCUAUGUGACUUCGUAAACUACG-5' (SEQ ID NO: 400)

C5-185 Target:
5'-TTATGGATACACTGAAGCATTTGATGC-3' (SEQ ID NO: 784)

5'-AUGGAUACACUGAAGCAUUUGAUGCAA-3' (SEQ ID NO: 1937)

3'-UACCUAUGUGACUUCGUAAACUACGUU-5' (SEQ ID NO: 401)

C5-187 Target:
5'-ATGGATACACTGAAGCATTTGATGCAA-3' (SEQ ID NO: 785)

5'-UGGAUACACUGAAGCAUUUGAUGCAAC-3' (SEQ ID NO: 1938)

3'-ACCUAUGUGACUUCGUAAACUACGUUG-5' (SEQ ID NO: 402)

C5-188 Target:
5'-TGGATACACTGAAGCATTTGATGCAAC-3' (SEQ ID NO: 786)

5'-GGAUACACUGAAGCAUUUGAUGCAACA-3' (SEQ ID NO: 1939)

3'-CCUAUGUGACUUCGUAAACUACGUUGU-5' (SEQ ID NO: 403)

C5-189 Target:
5'-GGATACACTGAAGCATTTGATGCAACA-3' (SEQ ID NO: 787)

5'-GAUACACUGAAGCAUUUGAUGCAACAA-3' (SEQ ID NO: 1940)

3'-CUAUGUGACUUCGUAAACUACGUUGUU-5' (SEQ ID NO: 404)

C5-190 Target:
5'-GATACACTGAAGCATTTGATGCAACAA-3' (SEQ ID NO: 788)

5'-AUACACUGAAGCAUUUGAUGCAACAAU-3' (SEQ ID NO: 1941)

3'-UAUGUGACUUCGUAAACUACGUUGUUA-5' (SEQ ID NO: 405)

C5-191 Target:
5'-ATACACTGAAGCATTTGATGCAACAAT-3' (SEQ ID NO: 789)

5'-UACACUGAAGCAUUUGAUGCAACAAUC-3' (SEQ ID NO: 1942)

3'-AUGUGACUUCGUAAACUACGUUGUUAG-5' (SEQ ID NO: 406)

C5-192 Target:
5'-TACACTGAAGCATTTGATGCAACAATC-3' (SEQ ID NO: 790)

5'-ACACUGAAGCAUUUGAUGCAACAAUCU-3' (SEQ ID NO: 1943)

3'-UGUGACUUCGUAAACUACGUUGUUAGA-5' (SEQ ID NO: 407)

C5-193 Target:
5'-ACACTGAAGCATTTGATGCAACAATCT-3' (SEQ ID NO: 791)

5'-CACUGAAGCAUUUGAUGCAACAAUCUC-3' (SEQ ID NO: 1944)

3'-GUGACUUCGUAAACUACGUUGUUAGAG-5' (SEQ ID NO: 408)

C5-194 Target:
5'-CACTGAAGCATTTGATGCAACAATCTC-3' (SEQ ID NO: 792)

5'-CUGAAGCAUUUGAUGCAACAAUCUCUA-3' (SEQ ID NO: 1945)

3'-GACUUCGUAAACUACGUUGUUAGAGAU-5' (SEQ ID NO: 409)

C5-196 Target:
5'-CTGAAGCATTTGATGCAACAATCTCTA-3' (SEQ ID NO: 793)

5'-GAAGCAUUUGAUGCAACAAUCUCUAUU-3' (SEQ ID NO: 1946)

3'-CUUCGUAAACUACGUUGUUAGAGAUAA-5' (SEQ ID NO: 410)

C5-198 Target:
5'-GAAGCATTTGATGCAACAATCTCTATT-3' (SEQ ID NO: 794)

5'-AGCAUUUGAUGCAACAAUCUCUAUUAA-3' (SEQ ID NO: 1947)

3'-UCGUAAACUACGUUGUUAGAGAUAAUU-5' (SEQ ID NO: 411)

C5-200 Target:
5'-AGCATTTGATGCAACAATCTCTATTAA-3' (SEQ ID NO: 795)

5'-UUUGAUGCAACAAUCUCUAUUAAAGU-3' (SEQ ID NO: 1948)

3'-AAACUACGUUGUUAGAGAUAAUUUUCA-5' (SEQ ID NO: 412)

C5-204 Target:
5'-TTTGATGCAACAATCTCTATTAAAAGT-3' (SEQ ID NO: 796)

5'-UUGAUGCAACAAUCUCUAUUAAAAGUU-3' (SEQ ID NO: 1949)

3'-AACUACGUUGUUAGAGAUAAUUUUCAA-5' (SEQ ID NO: 413)

C5-205 Target:
5'-TTGATGCAACAATCTCTATTAAAAGTT-3' (SEQ ID NO: 797)

5'-UGAUGCAACAAUCUCUAUUAAAAGUUA-3' (SEQ ID NO: 1950)

3'-ACUACGUUGUUAGAGAUAAUUUUCAAU-5' (SEQ ID NO: 414)

C5-206 Target:
5'-TGATGCAACAATCTCTATTAAAAGTTA-3' (SEQ ID NO: 798)

5'-GAUGCAACAAUCUCUAUUAAAAGUUAU-3' (SEQ ID NO: 1951)

3'-CUACGUUGUUAGAGAUAAUUUUCAAUA-5' (SEQ ID NO: 415)

C5-207 Target:
5'-GATGCAACAATCTCTATTAAAAGTTAT-3' (SEQ ID NO: 799)

5'-CAACAAUCUCUAUUAAAAGUUAUCCUG-3' (SEQ ID NO: 1952)

3'-GUUGUUAGAGAUAAUUUUCAAUAGGAC-5' (SEQ ID NO: 416)

C5-211 Target:
5'-CAACAATCTCTATTAAAAGTTATCCTG-3' (SEQ ID NO: 800)

5'-AACAAUCUCUAUUAAAAGUUAUCCUGA-3' (SEQ ID NO: 1953)

3'-UUGUUAGAGAUAAUUUUCAAUAGGACU-5' (SEQ ID NO: 417)

C5-212 Target:
5'-AACAATCTCTATTAAAAGTTATCCTGA-3' (SEQ ID NO: 801)

5'-CUCUAUUAAAAGUUAUCCUGAUAAAAA-3' (SEQ ID NO: 1954)

3'-GAGAUAAUUUUCAAUAGGACUAUUUUU-5' (SEQ ID NO: 418)

C5-218 Target:
5'-CTCTATTAAAAGTTATCCTGATAAAAA-3' (SEQ ID NO: 802)

5'-CUAUUAAAAGUUAUCCUGAUAAAAAAU-3' (SEQ ID NO: 1955)

3'-GAUAAUUUUCAAUAGGACUAUUUUUUA-5' (SEQ ID NO: 419)

Table 5-continued

Selected Human Anti-C5 "Blunt/Blunt" DsiRNAs

C5-220 Target:
5'-CTATTAAAAGTTATCCTGATAAAAAAT-3' (SEQ ID NO: 803)

5'-UUAAAAGUUAUCCUGAUAAAAAAUUUA-3' (SEQ ID NO: 1956)

3'-AAUUUUCAAUAGGACUAUUUUUUAAAU-5' (SEQ ID NO: 420)

C5-223 Target:
5'-TTAAAAGTTATCCTGATAAAAAATTTA-3' (SEQ ID NO: 804)

5'-UAAAAGUUAUCCUGAUAAAAAAUUUAG-3' (SEQ ID NO: 1957)

3'-AUUUUCAAUAGGACUAUUUUUUAAAUC-5' (SEQ ID NO: 421)

C5-224 Target:
5'-TAAAAGTTATCCTGATAAAAAATTTAG-3' (SEQ ID NO: 805)

5'-AAGUUAUCCUGAUAAAAAAUUUAGUUA-3' (SEQ ID NO: 1958)

3'-UUCAAUAGGACUAUUUUUUAAAUCAAU-5' (SEQ ID NO: 422)

C5-227 Target:
5'-AAGTTATCCTGATAAAAAATTTAGTTA-3' (SEQ ID NO: 806)

5'-AGUUAUCCUGAUAAAAAAUUUAGUUAC-3' (SEQ ID NO: 1959)

3'-UCAAUAGGACUAUUUUUUAAAUCAAUG-5' (SEQ ID NO: 423)

C5-228 Target:
5'-AGTTATCCTGATAAAAAATTTAGTTAC-3' (SEQ ID NO: 807)

5'-AUGUUCAUUUAUCCUCAGAGAAUAAAU-3' (SEQ ID NO: 1960)

3'-UACAAGUAAAUAGGAGUCUCUUAUUUA-5' (SEQ ID NO: 424)

C5-265 Target:
5'-ATGTTCATTTATCCTCAGAGAATAAAT-3' (SEQ ID NO: 808)

5'-UGUUCAUUUAUCCUCAGAGAAUAAAUU-3' (SEQ ID NO: 1961)

3'-ACAAGUAAAUAGGAGUCUCUUAUUUAA-5' (SEQ ID NO: 425)

C5-266 Target:
5'-TGTTCATTTATCCTCAGAGAATAAATT-3' (SEQ ID NO: 809)

5'-GUGUAUUUGGAAGUUGUAUCAAAGCAU-3' (SEQ ID NO: 1962)

3'-CACAUAAACCUUCAACAUAGUUUCGUA-5' (SEQ ID NO: 426)

C5-360 Target:
5'-GTGTATTTGGAAGTTGTATCAAAGCAT-3' (SEQ ID NO: 810)

5'-UGUAUUUGGAAGUUGUAUCAAAGCAUU-3' (SEQ ID NO: 1963)

3'-ACAUAAACCUUCAACAUAGUUUCGUAA-5' (SEQ ID NO: 427)

C5-361 Target:
5'-TGTATTTGGAAGTTGTATCAAAGCATT-3' (SEQ ID NO: 811)

5'-AUUUGGAAGUUGUAUCAAAGCAUUUUU-3' (SEQ ID NO: 1964)

3'-UAAACCUUCAACAUAGUUUCGUAAAAA-5' (SEQ ID NO: 428)

C5-364 Target:
5'-ATTTGGAAGTTGTATCAAAGCATTTTT-3' (SEQ ID NO: 812)

5'-UUUGGAAGUUGUAUCAAAGCAUUUUUC-3' (SEQ ID NO: 1965)

3'-AAACCUUCAACAUAGUUUCGUAAAAAG-5' (SEQ ID NO: 429)

C5-365 Target:
5'-TTTGGAAGTTGTATCAAAGCATTTTTC-3' (SEQ ID NO: 813)

5'-UUGGAAGUUGUAUCAAAGCAUUUUUCA-3' (SEQ ID NO: 1966)

3'-AACCUUCAACAUAGUUUCGUAAAAAGU-5' (SEQ ID NO: 430)

C5-366 Target:
5'-TTGGAAGTTGTATCAAAGCATTTTTCA-3' (SEQ ID NO: 814)

5'-UGGAAGUUGUAUCAAAGCAUUUUUCAA-3' (SEQ ID NO: 1967)

3'-ACCUUCAACAUAGUUUCGUAAAAAGUU-5' (SEQ ID NO: 431)

C5-367 Target:
5'-TGGAAGTTGTATCAAAGCATTTTTCAA-3' (SEQ ID NO: 815)

5'-GGAAGUUGUAUCAAAGCAUUUUUCAAA-3' (SEQ ID NO: 1968)

3'-CCUUCAACAUAGUUUCGUAAAAAGUUU-5' (SEQ ID NO: 432)

C5-368 Target:
5'-GGAAGTTGTATCAAAGCATTTTTCAAA-3' (SEQ ID NO: 816)

5'-GAAGUUGUAUCAAAGCAUUUUUCAAAA-3' (SEQ ID NO: 1969)

3'-CUUCAACAUAGUUUCGUAAAAAGUUUU-5' (SEQ ID NO: 433)

C5-369 Target:
5'-GAAGTTGTATCAAAGCATTTTTCAAAA-3' (SEQ ID NO: 817)

5'-AAGUUGUAUCAAAGCAUUUUUCAAAAU-3' (SEQ ID NO: 1970)

3'-UUCAACAUAGUUUCGUAAAAAGUUUUA-5' (SEQ ID NO: 434)

C5-370 Target:
5'-AAGTTGTATCAAAGCATTTTTCAAAAT-3' (SEQ ID NO: 818)

5'-AGUUGUAUCAAAGCAUUUUUCAAAAUC-3' (SEQ ID NO: 1971)

3'-UCAACAUAGUUUCGUAAAAAGUUUUAG-5' (SEQ ID NO: 435)

C5-371 Target:
5'-AGTTGTATCAAAGCATTTTTCAAAATC-3' (SEQ ID NO: 819)

5'-GUUGUAUCAAAGCAUUUUUCAAAAUCA-3' (SEQ ID NO: 1972)

3'-CAACAUAGUUUCGUAAAAAGUUUUAGU-5' (SEQ ID NO: 436)

C5-372 Target:
5'-GTTGTATCAAAGCATTTTTCAAAATCA-3' (SEQ ID NO: 820)

5'-UUGUAUCAAAGCAUUUUUCAAAAUCAA-3' (SEQ ID NO: 1973)

3'-AACAUAGUUUCGUAAAAAGUUUUAGUU-5' (SEQ ID NO: 437)

C5-373 Target:
5'-TTGTATCAAAGCATTTTTCAAAATCAA-3' (SEQ ID NO: 821)

5'-CCAAUAACCUAUGACAAUGGAUUUCUC-3' (SEQ ID NO: 1974)

3'-GGUUAUUGGAUACUGUUACCUAAAGAG-5' (SEQ ID NO: 438)

C5-408 Target:
5'-CCAATAACCTATGACAATGGATTTCTC-3' (SEQ ID NO: 822)

5'-ACCUAUGACAAUGGAUUUCUCUUCAUU-3' (SEQ ID NO: 1975)

3'-UGGAUACUGUUACCUAAAGAGAAGUAA-5' (SEQ ID NO: 439)

C5-414 Target:
5'-ACCTATGACAATGGATTTCTCTTCATT-3' (SEQ ID NO: 823)

5'-AUGACAAUGGAUUUCUCUUCAUUCAUA-3' (SEQ ID NO: 1976)

3'-UACUGUUACCUAAAGAGAAGUAAGUAU-5' (SEQ ID NO: 440)

C5-418 Target:
5'-ATGACAATGGATTTCTCTTCATTCATA-3' (SEQ ID NO: 824)

5'-UGACAAUGGAUUUCUCUUCAUUCAUAC-3' (SEQ ID NO: 1977)

3'-ACUGUUACCUAAAGAGAAGUAAGUAUG-5' (SEQ ID NO: 441)

Table 5-continued

Selected Human Anti-C5 "Blunt/Blunt" DsiRNAs

C5-419 Target:
5'-TGACAATGGATTTCTCTTCATTCATAC-3' (SEQ ID NO: 825)

5'-GACAAUGGAUUUCUCUUCAUUCAUACA-3' (SEQ ID NO: 1978)

3'-CUGUUACCUAAAGAGAAGUAAGUAUGU-5' (SEQ ID NO: 442)

C5-420 Target:
5'-GACAATGGATTTCTCTTCATTCATACA-3' (SEQ ID NO: 826)

5'-CAAUGGAUUUCUCUUCAUUCAUACAGA-3' (SEQ ID NO: 1979)

3'-GUUACCUAAAGAGAAGUAAGUAUGUCU-5' (SEQ ID NO: 443)

C5-422 Target:
5'-CAATGGATTTCTCTTCATTCATACAGA-3' (SEQ ID NO: 827)

5'-AAUGGAUUUCUCUUCAUUCAUACAGAC-3' (SEQ ID NO: 1980)

3'-UUACCUAAAGAGAAGUAAGUAUGUCUG-5' (SEQ ID NO: 444)

C5-423 Target:
5'-AATGGATTTCTCTTCATTCATACAGAC-3' (SEQ ID NO: 828)

5'-UGGAUUUCUCUUCAUUCAUACAGACAA-3' (SEQ ID NO: 1981)

3'-ACCUAAAGAGAAGUAAGUAUGUCUGUU-5' (SEQ ID NO: 445)

C5-425 Target:
5'-TGGATTTCTCTTCATTCATACAGACAA-3' (SEQ ID NO: 829)

5'-UCAUUCAUACAGACAAACCUGUUUAUA-3' (SEQ ID NO: 1982)

3'-AGUAAGUAUGUCUGUUUGGACAAAUAU-5' (SEQ ID NO: 446)

C5-436 Target:
5'-TCATTCATACAGACAAACCTGTTTATA-3' (SEQ ID NO: 830)

5'-AUUCAUACAGACAAACCUGUUUAUACU-3' (SEQ ID NO: 1983)

3'-UAAGUAUGUCUGUUUGGACAAAUAUGA-5' (SEQ ID NO: 447)

C5-438 Target:
5'-ATTCATACAGACAAACCTGTTTATACT-3' (SEQ ID NO: 831)

5'-UUCAUACAGACAAACCUGUUUAUACUC-3' (SEQ ID NO: 1984)

3'-AAGUAUGUCUGUUUGGACAAAUAUGAG-5' (SEQ ID NO: 448)

C5-439 Target:
5'-TTCATACAGACAAACCTGTTTATACTC-3' (SEQ ID NO: 832)

5'-UCAUACAGACAAACCUGUUUAUACUCC-3' (SEQ ID NO: 1985)

3'-AGUAUGUCUGUUUGGACAAAUAUGAGG-5' (SEQ ID NO: 449)

C5-440 Target:
5'-TCATACAGACAAACCTGTTTATACTCC-3' (SEQ ID NO: 833)

5'-AAGUUAGAGUUUAUUCGUUGAAUGACG-3' (SEQ ID NO: 1986)

3'-UUCAAUCUCAAAUAAGCAACUUACUGC-5' (SEQ ID NO: 450)

C5-481 Target:
5'-AAGTTAGAGTTTATTCGTTGAATGACG-3' (SEQ ID NO: 834)

5'-AAUGACGACUUGAAGCCAGCCAAAAGA-3' (SEQ ID NO: 1987)

3'-UUACUGCUGAACUUCGGUCGGUUUUCU-5' (SEQ ID NO: 451)

C5-501 Target:
5'-AATGACGACTTGAAGCCAGCCAAAAGA-3' (SEQ ID NO: 835)

5'-AUGACGACUUGAAGCCAGCCAAAAGAG-3' (SEQ ID NO: 1988)

3'-UACUGCUGAACUUCGGUCGGUUUUCUC-5' (SEQ ID NO: 452)

C5-502 Target:
5'-ATGACGACTTGAAGCCAGCCAAAAGAG-3' (SEQ ID NO: 836)

5'-UGACGACUUGAAGCCAGCCAAAAGAGA-3' (SEQ ID NO: 1989)

3'-ACUGCUGAACUUCGGUCGGUUUUCUCU-5' (SEQ ID NO: 453)

C5-503 Target:
5'-TGACGACTTGAAGCCAGCCAAAAGAGA-3' (SEQ ID NO: 837)

5'-GACGACUUGAAGCCAGCCAAAAGAGAA-3' (SEQ ID NO: 1990)

3'-CUGCUGAACUUCGGUCGGUUUUCUCUU-5' (SEQ ID NO: 454)

C5-504 Target:
5'-GACGACTTGAAGCCAGCCAAAAGAGAA-3' (SEQ ID NO: 838)

5'-AGAGAAACUGUCUUAACUUUCAUAGAU-3' (SEQ ID NO: 1991)

3'-UCUCUUUGACAGAAUUGAAAGUAUCUA-5' (SEQ ID NO: 455)

C5-525 Target:
5'-AGAGAAACTGTCTTAACTTTCATAGAT-3' (SEQ ID NO: 839)

5'-AAACUGUCUUAACUUUCAUAGAUCCUG-3' (SEQ ID NO: 1992)

3'-UUUGACAGAAUUGAAAGUAUCUAGGAC-5' (SEQ ID NO: 456)

C5-529 Target:
5'-AAACTGTCTTAACTTTCATAGATCCTG-3' (SEQ ID NO: 840)

5'-AACUGUCUUAACUUUCAUAGAUCCUGA-3' (SEQ ID NO: 1993)

3'-UUGACAGAAUUGAAAGUAUCUAGGACU-5' (SEQ ID NO: 457)

C5-530 Target:
5'-AACTGTCTTAACTTTCATAGATCCTGA-3' (SEQ ID NO: 841)

5'-CUGAAGGAUCAGAAGUUGACAUGGUAG-3' (SEQ ID NO: 1994)

3'-GACUUCCUAGUCUUCAACUGUACCAUC-5' (SEQ ID NO: 458)

C5-553 Target:
5'-CTGAAGGATCAGAAGTTGACATGGTAG-3' (SEQ ID NO: 842)

5'-UGAAGGAUCAGAAGUUGACAUGGUAGA-3' (SEQ ID NO: 1995)

3'-ACUUCCUAGUCUUCAACUGUACCAUCU-5' (SEQ ID NO: 459)

C5-554 Target:
5'-TGAAGGATCAGAAGTTGACATGGTAGA-3' (SEQ ID NO: 843)

5'-UUGACAUGGUAGAAGAAAUUGAUCAUA-3' (SEQ ID NO: 1996)

3'-AACUGUACCAUCUUCUUUAACUAGUAU-5' (SEQ ID NO: 460)

C5-568 Target:
5'-TTGACATGGTAGAAGAAATTGATCATA-3' (SEQ ID NO: 844)

5'-UGACAUGGUAGAAGAAAUUGAUCAUAU-3' (SEQ ID NO: 1997)

3'-ACUGUACCAUCUUCUUUAACUAGUAUA-5' (SEQ ID NO: 461)

C5-569 Target:
5'-TGACATGGTAGAAGAAATTGATCATAT-3' (SEQ ID NO: 845)

5'-AUGGUAGAAGAAAUUGAUCAUAUUGGA-3' (SEQ ID NO: 1998)

3'-UACCAUCUUCUUUAACUAGUAUAACCU-5' (SEQ ID NO: 462)

C5-573 Target:
5'-ATGGTAGAAGAAATTGATCATATTGGA-3' (SEQ ID NO: 846)

5'-UGGUAGAAGAAAUUGAUCAUAUUGGAA-3' (SEQ ID NO: 1999)

3'-ACCAUCUUCUUUAACUAGUAUAACCUU-5' (SEQ ID NO: 463)

Table 5-continued

Selected Human Anti-C5 "Blunt/Blunt" DsiRNAs

C5-574 Target:
5'-TGGTAGAAGAAATTGATCATATTGGAA-3' (SEQ ID NO: 847)

5'-AGAAGAAAUUGAUCAUAUUGGAAUUAU-3' (SEQ ID NO: 2000)

3'-UCUUCUUUAACUAGUAUAACCUUAAUA-5' (SEQ ID NO: 464)

C5-578 Target:
5'-AGAAGAAATTGATCATATTGGAATTAT-3' (SEQ ID NO: 848)

5'-GAAGAAAUUGAUCAUAUUGGAAUUAUC-3' (SEQ ID NO: 2001)

3'-CUUCUUUAACUAGUAUAACCUUAAUAG-5' (SEQ ID NO: 465)

C5-579 Target:
5'-GAAGAAATTGATCATATTGGAATTATC-3' (SEQ ID NO: 849)

5'-UUGGAAUUAUCUCUUUUCCUGACUUCA-3' (SEQ ID NO: 2002)

3'-AACCUUAAUAGAGAAAAGGACUGAAGU-5' (SEQ ID NO: 466)

C5-595 Target:
5'-TTGGAATTATCTCTTTTCCTGACTTCA-3' (SEQ ID NO: 850)

5'-UGGAAUUAUCUCUUUUCCUGACUUCAA-3' (SEQ ID NO: 2003)

3'-ACCUUAAUAGAGAAAAGGACUGAAGUU-5' (SEQ ID NO: 467)

C5-596 Target:
5'-TGGAATTATCTCTTTTCCTGACTTCAA-3' (SEQ ID NO: 851)

5'-GGAAUUAUCUCUUUUCCUGACUUCAAG-3' (SEQ ID NO: 2004)

3'-CCUUAAUAGAGAAAAGGACUGAAGUUC-5' (SEQ ID NO: 468)

C5-597 Target:
5'-GGAATTATCTCTTTTCCTGACTTCAAG-3' (SEQ ID NO: 852)

5'-GAAUUAUCUCUUUUCCUGACUUCAAGA-3' (SEQ ID NO: 2005)

3'-CUUAAUAGAGAAAAGGACUGAAGUUCU-5' (SEQ ID NO: 469)

C5-598 Target:
5'-GAATTATCTCTTTTCCTGACTTCAAGA-3' (SEQ ID NO: 853)

5'-AAUUAUCUCUUUUCCUGACUUCAAGAU-3' (SEQ ID NO: 2006)

3'-UUAAUAGAGAAAAGGACUGAAGUUCUA-5' (SEQ ID NO: 470)

C5-599 Target:
5'-AATTATCTCTTTTCCTGACTTCAAGAT-3' (SEQ ID NO: 854)

5'-AUUAUCUCUUUUCCUGACUUCAAGAUU-3' (SEQ ID NO: 2007)

3'-UAAUAGAGAAAAGGACUGAAGUUCUAA-5' (SEQ ID NO: 471)

C5-600 Target:
5'-ATTATCTCTTTTCCTGACTTCAAGATT-3' (SEQ ID NO: 855)

5'-UUAUCUCUUUUCCUGACUUCAAGAUUC-3' (SEQ ID NO: 2008)

3'-AAUAGAGAAAAGGACUGAAGUUCUAAG-5' (SEQ ID NO: 472)

C5-601 Target:
5'-TTATCTCTTTTCCTGACTTCAAGATTC-3' (SEQ ID NO: 856)

5'-UAUCUCUUUUCCUGACUUCAAGAUUCC-3' (SEQ ID NO: 2009)

3'-AUAGAGAAAAGGACUGAAGUUCUAAGG-5' (SEQ ID NO: 473)

C5-602 Target:
5'-TATCTCTTTTCCTGACTTCAAGATTCC-3' (SEQ ID NO: 857)

5'-AUCUCUUUUCCUGACUUCAAGAUUCCG-3' (SEQ ID NO: 2010)

3'-UAGAGAAAAGGACUGAAGUUCUAAGGC-5' (SEQ ID NO: 474)

C5-603 Target:
5'-ATCTCTTTTCCTGACTTCAAGATTCCG-3' (SEQ ID NO: 858)

5'-UCUCUUUUCCUGACUUCAAGAUUCCGU-3' (SEQ ID NO: 2011)

3'-AGAGAAAAGGACUGAAGUUCUAAGGCA-5' (SEQ ID NO: 475)

C5-604 Target:
5'-TCTCTTTTCCTGACTTCAAGATTCCGT-3' (SEQ ID NO: 859)

5'-CUCUUUUCCUGACUUCAAGAUUCCGUC-3' (SEQ ID NO: 2012)

3'-GAGAAAAGGACUGAAGUUCUAAGGCAG-5' (SEQ ID NO: 476)

C5-605 Target:
5'-CTCTTTTCCTGACTTCAAGATTCCGTC-3' (SEQ ID NO: 860)

5'-UCUUUUCCUGACUUCAAGAUUCCGUCU-3' (SEQ ID NO: 2013)

3'-AGAAAAGGACUGAAGUUCUAAGGCAGA-5' (SEQ ID NO: 477)

C5-606 Target:
5'-TCTTTTCCTGACTTCAAGATTCCGTCT-3' (SEQ ID NO: 861)

5'-CUUUUCCUGACUUCAAGAUUCCGUCUA-3' (SEQ ID NO: 2014)

3'-GAAAAGGACUGAAGUUCUAAGGCAGAU-5' (SEQ ID NO: 478)

C5-607 Target:
5'-CTTTTCCTGACTTCAAGATTCCGTCTA-3' (SEQ ID NO: 862)

5'-UUUUCCUGACUUCAAGAUUCCGUCUAA-3' (SEQ ID NO: 2015)

3'-AAAAGGACUGAAGUUCUAAGGCAGAUU-5' (SEQ ID NO: 479)

C5-608 Target:
5'-TTTTCCTGACTTCAAGATTCCGTCTAA-3' (SEQ ID NO: 863)

5'-AGUUAAAGAAUAUGUCUUGCCACAUUU-3' (SEQ ID NO: 2016)

3'-UCAAUUUCUUAUACAGAACGGUGUAAA-5' (SEQ ID NO: 480)

C5-710 Target:
5'-AGTTAAAGAATATGTCTTGCCACATTT-3' (SEQ ID NO: 864)

5'-GUUAAAGAAUAUGUCUUGCCACAUUUU-3' (SEQ ID NO: 2017)

3'-CAAUUUCUUAUACAGAACGGUGUAAAA-5' (SEQ ID NO: 481)

C5-711 Target:
5'-GTTAAAGAATATGTCTTGCCACATTTT-3' (SEQ ID NO: 865)

5'-UUAAAGAAUAUGUCUUGCCACAUUUUU-3' (SEQ ID NO: 2018)

3'-AAUUUCUUAUACAGAACGGUGUAAAAA-5' (SEQ ID NO: 482)

C5-712 Target:
5'-TTAAAGAATATGTCTTGCCACATTTTT-3' (SEQ ID NO: 866)

5'-ACAAGAACUUUAAGAAUUUUGAAAUUA-3' (SEQ ID NO: 2019)

3'-UGUUCUUGAAAUUCUUAAAACUUUAAU-5' (SEQ ID NO: 483)

C5-775 Target:
5'-ACAAGAACTTTAAGAATTTTGAAATTA-3' (SEQ ID NO: 867)

5'-CAAGAACUUUAAGAAUUUUGAAAUUAC-3' (SEQ ID NO: 2020)

3'-GUUCUUGAAAUUCUUAAAACUUUAAUG-5' (SEQ ID NO: 484)

C5-776 Target:
5'-CAAGAACTTTAAGAATTTTGAAATTAC-3' (SEQ ID NO: 868)

5'-AACUUUAAGAAUUUUGAAAUUACUAUA-3' (SEQ ID NO: 2021)

3'-UUGAAAUUCUUAAAACUUUAAUGAUAU-5' (SEQ ID NO: 485)

Table 5-continued

Selected Human Anti-C5 "Blunt/Blunt" DsiRNAs

C5-780 Target:
5'-AACTTTAAGAATTTTGAAATTACTATA-3' (SEQ ID NO: 869)

5'-AAGAAUUUUGAAAUUACUAUAAAAGCA-3' (SEQ ID NO: 2022)

3'-UUCUUAAAACUUUAAUGAUAUUUUCGU-5' (SEQ ID NO: 486)

C5-786 Target:
5'-AAGAATTTTGAAATTACTATAAAAGCA-3' (SEQ ID NO: 870)

5'-AGAAUUUUGAAAUUACUAUAAAAGCAA-3' (SEQ ID NO: 2023)

3'-UCUUAAAACUUUAAUGAUAUUUUCGUU-5' (SEQ ID NO: 487)

C5-787 Target:
5'-AGAATTTTGAAATTACTATAAAAGCAA-3' (SEQ ID NO: 871)

5'-GAAUUUUGAAAUUACUAUAAAAGCAAG-3' (SEQ ID NO: 2024)

3'-CUUAAAACUUUAAUGAUAUUUUCGUUC-5' (SEQ ID NO: 488)

C5-788 Target:
5'-GAATTTTGAAATTACTATAAAAGCAAG-3' (SEQ ID NO: 872)

5'-UUUUGAAAUUACUAUAAAAGCAAGAUA-3' (SEQ ID NO: 2025)

3'-AAAACUUUAAUGAUAUUUUCGUUCUAU-5' (SEQ ID NO: 489)

C5-791 Target:
5'-TTTTGAAATTACTATAAAAGCAAGATA-3' (SEQ ID NO: 873)

5'-UUUGAAAUUACUAUAAAAGCAAGAUAU-3' (SEQ ID NO: 2026)

3'-AAACUUUAAUGAUAUUUUCGUUCUAUA-5' (SEQ ID NO: 490)

C5-792 Target:
5'-TTTGAAATTACTATAAAAGCAAGATAT-3' (SEQ ID NO: 874)

5'-UUGAAAUUACUAUAAAAGCAAGAUAUU-3' (SEQ ID NO: 2027)

3'-AACUUUAAUGAUAUUUUCGUUCUAUAA-5' (SEQ ID NO: 491)

C5-793 Target:
5'-TTGAAATTACTATAAAAGCAAGATATT-3' (SEQ ID NO: 875)

5'-UAAAAGCAAGAUAUUUUUAUAAUAAAG-3' (SEQ ID NO: 2028)

3'-AUUUUCGUUCUAUAAAAAUAUUAUUUC-5' (SEQ ID NO: 492)

C5-805 Target:
5'-TAAAAGCAAGATATTTTTATAATAAAG-3' (SEQ ID NO: 876)

5'-AAAAGCAAGAUAUUUUUAUAAUAAAGU-3' (SEQ ID NO: 2029)

3'-UUUUCGUUCUAUAAAAAUAUUAUUUCA-5' (SEQ ID NO: 493)

C5-806 Target:
5'-AAAAGCAAGATATTTTTATAATAAGT-3' (SEQ ID NO: 877)

5'-AAAGCAAGAUAUUUUUAUAAUAAAGUA-3' (SEQ ID NO: 2030)

3'-UUUCGUUCUAUAAAAAUAUUAUUUCAU-5' (SEQ ID NO: 494)

C5-807 Target:
5'-AAAGCAAGATATTTTTATAATAAAGTA-3' (SEQ ID NO: 878)

5'-AAGCAAGAUAUUUUUAUAAUAAAGUAG-3' (SEQ ID NO: 2031)

3'-UUCGUUCUAUAAAAAUAUUAUUUCAUC-5' (SEQ ID NO: 495)

C5-808 Target:
5'-AAGCAAGATATTTTTATAATAAAGTAG-3' (SEQ ID NO: 879)

5'-AGCAAGAUAUUUUUAUAAUAAAGUAGU-3' (SEQ ID NO: 2032)

3'-UCGUUCUAUAAAAAUAUUAUUUCAUCA-5' (SEQ ID NO: 496)

C5-809 Target:
5'-AGCAAGATATTTTTATAATAAAGTAGT-3' (SEQ ID NO: 880)

5'-GCAAGAUAUUUUUAUAAUAAAGUAGUC-3' (SEQ ID NO: 2033)

3'-CGUUCUAUAAAAAUAUUAUUUCAUCAG-5' (SEQ ID NO: 497)

C5-810 Target:
5'-GCAAGATATTTTTATAATAAAGTAGTC-3' (SEQ ID NO: 881)

5'-CAAGAUAUUUUUAUAAUAAAGUAGUCA-3' (SEQ ID NO: 2034)

3'-GUUCUAUAAAAAUAUUAUUUCAUCAGU-5' (SEQ ID NO: 498)

C5-811 Target:
5'-CAAGATATTTTTATAATAAAGTAGTCA-3' (SEQ ID NO: 882)

5'-AAGAUAUUUUUAUAAUAAAGUAGUCAC-3' (SEQ ID NO: 2035)

3'-UUCUAUAAAAAUAUUAUUUCAUCAGUG-5' (SEQ ID NO: 499)

C5-812 Target:
5'-AAGATATTTTTATAATAAAGTAGTCAC-3' (SEQ ID NO: 883)

5'-CACAAUGUUGAUAAAUGGAAUUGCUCA-3' (SEQ ID NO: 2036)

3'-GUGUUACAACUAUUUACCUUAACGAGU-5' (SEQ ID NO: 500)

C5-923 Target:
5'-CACAATGTTGATAAATGGAATTGCTCA-3' (SEQ ID NO: 884)

5'-ACAAUGUUGAUAAAUGGAAUUGCUCAA-3' (SEQ ID NO: 2037)

3'-UGUUACAACUAUUUACCUUAACGAGUU-5' (SEQ ID NO: 501)

C5-924 Target:
5'-ACAATGTTGATAAATGGAATTGCTCAA-3' (SEQ ID NO: 885)

5'-AAUGUUGAUAAAUGGAAUUGCUCAAGU-3' (SEQ ID NO: 2038)

3'-UUACAACUAUUUACCUUAACGAGUUCA-5' (SEQ ID NO: 502)

C5-926 Target:
5'-AATGTTGATAAATGGAATTGCTCAAGT-3' (SEQ ID NO: 886)

5'-AUGUUGAUAAAUGGAAUUGCUCAAGUC-3' (SEQ ID NO: 2039)

3'-UACAACUAUUUACCUUAACGAGUUCAG-5' (SEQ ID NO: 503)

C5-927 Target:
5'-ATGTTGATAAATGGAATTGCTCAAGTC-3' (SEQ ID NO: 887)

5'-UGUUGAUAAAUGGAAUUGCUCAAGUCA-3' (SEQ ID NO: 2040)

3'-ACAACUAUUUACCUUAACGAGUUCAGU-5' (SEQ ID NO: 504)

C5-928 Target:
5'-TGTTGATAAATGGAATTGCTCAAGTCA-3' (SEQ ID NO: 888)

5'-UGAUAAAUGGAAUUGCUCAAGUCACAU-3' (SEQ ID NO: 2041)

3'-ACUAUUUACCUUAACGAGUUCAGUGUA-5' (SEQ ID NO: 505)

C5-931 Target:
5'-TGATAAATGGAATTGCTCAAGTCACAT-3' (SEQ ID NO: 889)

5'-AAAUGGAAUUGCUCAAGUCACAUUUGA-3' (SEQ ID NO: 2042)

3'-UUUACCUUAACGAGUUCAGUGUAAACU-5' (SEQ ID NO: 506)

C5-935 Target:
5'-AAATGGAATTGCTCAAGTCACATTTGA-3' (SEQ ID NO: 890)

5'-UGCUCAAGUCACAUUUGAUUCUGAAAC-3' (SEQ ID NO: 2043)

3'-ACGAGUUCAGUGUAAACUAAGACUUUG-5' (SEQ ID NO: 507)

Table 5-continued
Selected Human Anti-C5 "Blunt/Blunt" DsiRNAs

C5-944 Target:
5'-TGCTCAAGTCACATTTGATTCTGAAAC-3' (SEQ ID NO: 891)

5'-CUCAAGUCACAUUUGAUUCUGAAACAG-3' (SEQ ID NO: 2044)

3'-GAGUUCAGUGUAAACUAAGACUUUGUC-5' (SEQ ID NO: 508)

C5-946 Target:
5'-CTCAAGTCACATTTGATTCTGAAACAG-3' (SEQ ID NO: 892)

5'-UCAAGUCACAUUUGAUUCUGAAACAGC-3' (SEQ ID NO: 2045)

3'-AGUUCAGUGUAAACUAAGACUUUGUCG-5' (SEQ ID NO: 509)

C5-947 Target:
5'-TCAAGTCACATTTGATTCTGAAACAGC-3' (SEQ ID NO: 893)

5'-CAAGUCACAUUUGAUUCUGAAACAGCA-3' (SEQ ID NO: 2046)

3'-GUUCAGUGUAAACUAAGACUUUGUCGU-5' (SEQ ID NO: 510)

C5-948 Target:
5'-CAAGTCACATTTGATTCTGAAACAGCA-3' (SEQ ID NO: 894)

5'-CACAUUUGAUUCUGAAACAGCAGUCAA-3' (SEQ ID NO: 2047)

3'-GUGUAAACUAAGACUUUGUCGUCAGUU-5' (SEQ ID NO: 511)

C5-953 Target:
5'-CACATTTGATTCTGAAACAGCAGTCAA-3' (SEQ ID NO: 895)

5'-CAUUUGAUUCUGAAACAGCAGUCAAAG-3' (SEQ ID NO: 2048)

3'-GUAAACUAAGACUUUGUCGUCAGUUUC-5' (SEQ ID NO: 512)

C5-955 Target:
5'-CATTTGATTCTGAAACAGCAGTCAAAG-3' (SEQ ID NO: 896)

5'-AUUUGAUUCUGAAACAGCAGUCAAAGA-3' (SEQ ID NO: 2049)

3'-UAAACUAAGACUUUGUCGUCAGUUUCU-5' (SEQ ID NO: 513)

C5-956 Target:
5'-ATTTGATTCTGAAACAGCAGTCAAAGA-3' (SEQ ID NO: 897)

5'-AACAGCAGUCAAAGAACUGUCAUACUA-3' (SEQ ID NO: 2050)

3'-UUGUCGUCAGUUUCUUGACAGUAUGAU-5' (SEQ ID NO: 514)

C5-968 Target:
5'-AACAGCAGTCAAAGAACTGTCATACTA-3' (SEQ ID NO: 898)

5'-CAGCAGUCAAAGAACUGUCAUACUACA-3' (SEQ ID NO: 2051)

3'-GUCGUCAGUUUCUUGACAGUAUGAUGU-5' (SEQ ID NO: 515)

C5-970 Target:
5'-CAGCAGTCAAAGAACTGTCATACTACA-3' (SEQ ID NO: 899)

5'-CAGUCAAAGAACUGUCAUACUACAGUU-3' (SEQ ID NO: 2052)

3'-GUCAGUUUCUUGACAGUAUGAUGUCAA-5' (SEQ ID NO: 516)

C5-973 Target:
5'-CAGTCAAAGAACTGTCATACTACAGTT-3' (SEQ ID NO: 900)

5'-CAAAGAACUGUCAUACUACAGUUUAGA-3' (SEQ ID NO: 2053)

3'-GUUUCUUGACAGUAUGAUGUCAAAUCU-5' (SEQ ID NO: 517)

C5-977 Target:
5'-CAAAGAACTGTCATACTACAGTTTAGA-3' (SEQ ID NO: 901)

5'-AAAGAACUGUCAUACUACAGUUUAGAA-3' (SEQ ID NO: 2054)

3'-UUUCUUGACAGUAUGAUGUCAAAUCUU-5' (SEQ ID NO: 518)

C5-978 Target:
5'-AAAGAACTGTCATACTACAGTTTAGAA-3' (SEQ ID NO: 902)

5'-AGAACUGUCAUACUACAGUUUAGAAGA-3' (SEQ ID NO: 2055)

3'-UCUUGACAGUAUGAUGUCAAAUCUUCU-5' (SEQ ID NO: 519)

C5-980 Target:
5'-AGAACTGTCATACTACAGTTTAGAAGA-3' (SEQ ID NO: 903)

5'-AUUUAAACAACAAGUACCUUUAUAUUG-3' (SEQ ID NO: 2056)

3'-UAAAUUUGUUGUUCAUGGAAAUAUAAC-5' (SEQ ID NO: 520)

C5-1006 Target:
5'-ATTTAAACAACAAGTACCTTTATATTG-3' (SEQ ID NO: 904)

5'-UUUAAACAACAAGUACCUUUAUAUUGC-3' (SEQ ID NO: 2057)

3'-AAAUUUGUUGUUCAUGGAAAUAUAACG-5' (SEQ ID NO: 521)

C5-1007 Target:
5'-TTTAAACAACAAGTACCTTTATATTGC-3' (SEQ ID NO: 905)

5'-UUAAACAACAAGUACCUUUAUAUUGCU-3' (SEQ ID NO: 2058)

3'-AAUUUGUUGUUCAUGGAAAUAUAACGA-5' (SEQ ID NO: 522)

C5-1008 Target:
5'-TTAAACAACAAGTACCTTTATATTGCT-3' (SEQ ID NO: 906)

5'-UAAACAACAAGUACCUUUAUAUUGCUG-3' (SEQ ID NO: 2059)

3'-AUUUGUUGUUCAUGGAAAUAUAACGAC-5' (SEQ ID NO: 523)

C5-1009 Target:
5'-TAAACAACAAGTACCTTTATATTGCTG-3' (SEQ ID NO: 907)

5'-AAACAACAAGUACCUUUAUAUUGCUGU-3' (SEQ ID NO: 2060)

3'-UUUGUUGUUCAUGGAAAUAUAACGACA-5' (SEQ ID NO: 524)

C5-1010 Target:
5'-AAACAACAAGTACCTTTATATTGCTGT-3' (SEQ ID NO: 908)

5'-AACAACAAGUACCUUUAUAUUGCUGUA-3' (SEQ ID NO: 2061)

3'-UUGUUGUUCAUGGAAAUAUAACGACAU-5' (SEQ ID NO: 525)

C5-1011 Target:
5'-AACAACAAGTACCTTTATATTGCTGTA-3' (SEQ ID NO: 909)

5'-ACAACAAGUACCUUUAUAUUGCUGUAA-3' (SEQ ID NO: 2062)

3'-UGUUGUUCAUGGAAAUAUAACGACAUU-5' (SEQ ID NO: 526)

C5-1012 Target:
5'-ACAACAAGTACCTTTATATTGCTGTAA-3' (SEQ ID NO: 910)

5'-CAACAAGUACCUUUAUAUUGCUGUAAC-3' (SEQ ID NO: 2063)

3'-GUUGUUCAUGGAAAUAUAACGACAUUG-5' (SEQ ID NO: 527)

C5-1013 Target:
5'-CAACAAGTACCTTTATATTGCTGTAAC-3' (SEQ ID NO: 911)

5'-AACAAGUACCUUUAUAUUGCUGUAACA-3' (SEQ ID NO: 2064)

3'-UUGUUCAUGGAAAUAUAACGACAUUGU-5' (SEQ ID NO: 528)

C5-1014 Target:
5'-AACAAGTACCTTTATATTGCTGTAACA-3' (SEQ ID NO: 912)

5'-ACAAGUACCUUUAUAUUGCUGUAACAG-3' (SEQ ID NO: 2065)

3'-UGUUCAUGGAAAUAUAACGACAUUGUC-5' (SEQ ID NO: 529)

Table 5-continued

Selected Human Anti-C5 "Blunt/Blunt" DsiRNAs

C5-1015 Target:
5'-ACAAGTACCTTTATATTGCTGTAACAG-3' (SEQ ID NO: 913)

5'-CAAGUACCUUUAUAUUGCUGUAACAGU-3' (SEQ ID NO: 2066)

3'-GUUCAUGGAAAUAUAACGACAUUGUCA-5' (SEQ ID NO: 530)

C5-1016 Target:
5'-CAAGTACCTTTATATTGCTGTAACAGT-3' (SEQ ID NO: 914)

5'-AAGUACCUUUAUAUUGCUGUAACAGUC-3' (SEQ ID NO: 2067)

3'-UUCAUGGAAAUAUAACGACAUUGUCAG-5' (SEQ ID NO: 531)

C5-1017 Target:
5'-AAGTACCTTTATATTGCTGTAACAGTC-3' (SEQ ID NO: 915)

5'-GUACCUUUAUAUUGCUGUAACAGUCAU-3' (SEQ ID NO: 2068)

3'-CAUGGAAAUAUAACGACAUUGUCAGUA-5' (SEQ ID NO: 532)

C5-1019 Target:
5'-GTACCTTTATATTGCTGTAACAGTCAT-3' (SEQ ID NO: 916)

5'-CAUCAAAUAUGUCCUCUCUCCCUACAA-3' (SEQ ID NO: 2069)

3'-GUAGUUUAUACAGGAGAGAGGGAUGUU-5' (SEQ ID NO: 533)

C5-1088 Target:
5'-CATCAAATATGTCCTCTCTCCCTACAA-3' (SEQ ID NO: 917)

5'-CUCCCUACAAACUGAAUUUGGUUGCUA-3' (SEQ ID NO: 2070)

3'-GAGGGAUGUUUGACUUAAACCAACGAU-5' (SEQ ID NO: 534)

C5-1105 Target:
5'-CTCCCTACAAACTGAATTTGGTTGCTA-3' (SEQ ID NO: 918)

5'-CUACAAACUGAAUUUGGUUGCUACUCC-3' (SEQ ID NO: 2071)

3'-GAUGUUUGACUUAAACCAACGAUGAGG-5' (SEQ ID NO: 535)

C5-1109 Target:
5'-CTACAAACTGAATTTGGTTGCTACTCC-3' (SEQ ID NO: 919)

5'-UACAAACUGAAUUUGGUUGCUACUCCU-3' (SEQ ID NO: 2072)

3'-AUGUUUGACUUAAACCAACGAUGAGGA-5' (SEQ ID NO: 536)

C5-1110 Target:
5'-TACAAACTGAATTTGGTTGCTACTCCT-3' (SEQ ID NO: 920)

5'-CACUGAAUGCACAAACAAUUGAUGUAA-3' (SEQ ID NO: 2073)

3'-GUGACUUACGUGUUUGUUAACUACAUU-5' (SEQ ID NO: 537)

C5-1222 Target:
5'-CACTGAATGCACAAACAATTGATGTAA-3' (SEQ ID NO: 921)

5'-ACUGAAUGCACAAACAAUUGAUGUAAA-3' (SEQ ID NO: 2074)

3'-UGACUUACGUGUUUGUUAACUACAUUU-5' (SEQ ID NO: 538)

C5-1223 Target:
5'-ACTGAATGCACAAACAATTGATGTAAA-3' (SEQ ID NO: 922)

5'-ACCAAGAGACAUCUGACUUGGAUCCAA-3' (SEQ ID NO: 2075)

3'-UGGUUCUCUGUAGACUGAACCUAGGUU-5' (SEQ ID NO: 539)

C5-1249 Target:
5'-ACCAAGAGACATCTGACTTGGATCCAA-3' (SEQ ID NO: 923)

5'-CCAAGAGACAUCUGACUUGGAUCCAAG-3' (SEQ ID NO: 2076)

3'-GGUUCUCUGUAGACUGAACCUAGGUUC-5' (SEQ ID NO: 540)

Table 5-continued

Selected Human Anti-C5 "Blunt/Blunt" DsiRNAs

C5-1250 Target:
5'-CCAAGAGACATCTGACTTGGATCCAAG-3' (SEQ ID NO: 924)

5'-AAGGUUACCGAGCAAUAGCAUACUCAU-3' (SEQ ID NO: 2077)

3'-UUCCAAUGGCUCGUUAUCGUAUGAGUA-5' (SEQ ID NO: 541)

C5-1405 Target:
5'-AAGGTTACCGAGCAATAGCATACTCAT-3' (SEQ ID NO: 925)

5'-UCUCAGCCAAAGUUACCUUUAUAUUGA-3' (SEQ ID NO: 2078)

3'-AGAGUCGGUUUCAAUGGAAAUAUAACU-5' (SEQ ID NO: 542)

C5-1433 Target:
5'-TCTCAGCCAAAGTTACCTTTATATTGA-3' (SEQ ID NO: 926)

5'-CUCAGCCAAAGUUACCUUUAUAUUGAU-3' (SEQ ID NO: 2079)

3'-GAGUCGGUUUCAAUGGAAAUAUAACUA-5' (SEQ ID NO: 543)

C5-1434 Target:
5'-CTCAGCCAAAGTTACCTTTATATTGAT-3' (SEQ ID NO: 927)

5'-UCAGCCAAAGUUACCUUUAUAUUGAUU-3' (SEQ ID NO: 2080)

3'-AGUCGGUUUCAAUGGAAAUAUAACUAA-5' (SEQ ID NO: 544)

C5-1435 Target:
5'-TCAGCCAAAGTTACCTTTATATTGATT-3' (SEQ ID NO: 928)

5'-CAGCCAAAGUUACCUUUAUAUUGAUUG-3' (SEQ ID NO: 2081)

3'-GUCGGUUUCAAUGGAAAUAUAACUAAC-5' (SEQ ID NO: 545)

C5-1436 Target:
5'-CAGCCAAAGTTACCTTTATATTGATTG-3' (SEQ ID NO: 929)

5'-CCAAAAGCCCAUAUAUUGACAAAAUAA-3' (SEQ ID NO: 2082)

3'-GGUUUUCGGGUAUAUAACUGUUUUAUU-5' (SEQ ID NO: 546)

C5-1519 Target:
5'-CCAAAAGCCCATATATTGACAAAATAA-3' (SEQ ID NO: 930)

5'-AAGCCCAUAUAUUGACAAAAUAACUCA-3' (SEQ ID NO: 2083)

3'-UUCGGGUAUAUAACUGUUUUAUUGAGU-5' (SEQ ID NO: 547)

C5-1523 Target:
5'-AAGCCCATATATTGACAAAATAACTCA-3' (SEQ ID NO: 931)

5'-AGCCCAUAUAUUGACAAAAUAACUCAC-3' (SEQ ID NO: 2084)

3'-UCGGGUAUAUAACUGUUUUAUUGAGUG-5' (SEQ ID NO: 548)

C5-1524 Target:
5'-AGCCCATATATTGACAAAATAACTCAC-3' (SEQ ID NO: 932)

5'-CCCAUAUAUUGACAAAAUAACUCACUA-3' (SEQ ID NO: 2085)

3'-GGGUAUAUAACUGUUUUAUUGAGUGAU-5' (SEQ ID NO: 549)

C5-1526 Target:
5'-CCCATATATTGACAAAATAACTCACTA-3' (SEQ ID NO: 933)

5'-CCAUAUAUUGACAAAAUAACUCACUAU-3' (SEQ ID NO: 2086)

3'-GGUAUAUAACUGUUUUAUUGAGUGAUA-5' (SEQ ID NO: 550)

C5-1527 Target:
5'-CCATATATTGACAAAATAACTCACTAT-3' (SEQ ID NO: 934)

5'-CAUAUAUUGACAAAAUAACUCACUAUA-3' (SEQ ID NO: 2087)

3'-GUAUAUAACUGUUUUAUUGAGUGAUAU-5' (SEQ ID NO: 551)

| Selected Human Anti-C5 "Blunt/Blunt" DsiRNAs | Selected Human Anti-C5 "Blunt/Blunt" DsiRNAs |
|---|---|
| C5-1528 Target:<br>5'-CATATATTGACAAAATAACTCACTATA-3' (SEQ ID NO: 935)<br><br>5'-AUAUUGACAAAAUAACUCACUAUAAUU-3' (SEQ ID NO: 2088)<br><br>3'-UAUAACUGUUUUAUUGAGUGAUAUUAA-5' (SEQ ID NO: 552) | C5-1542 Target:<br>5'-ATAACTCACTATAATTACTTGATTTTA-3' (SEQ ID NO: 946)<br><br>5'-UAACUCACUAUAAUUACUUGAUUUUAU-3' (SEQ ID NO: 2099)<br><br>3'-AUUGAGUGAUAUUAAUGAACUAAAAUA-5' (SEQ ID NO: 563) |
| C5-1531 Target:<br>5'-ATATTGACAAAATAACTCACTATAATT-3' (SEQ ID NO: 936)<br><br>5'-AUUGACAAAAUAACUCACUAUAAUUAC-3' (SEQ ID NO: 2089)<br><br>3'-UAACUGUUUUAUUGAGUGAUAUUAAUG-5' (SEQ ID NO: 553) | C5-1543 Target:<br>5'-TAACTCACTATAATTACTTGATTTTAT-3' (SEQ ID NO: 947)<br><br>5'-AACUCACUAUAAUUACUUGAUUUUAUC-3' (SEQ ID NO: 2100)<br><br>3'-UUGAGUGAUAUUAAUGAACUAAAAUAG-5' (SEQ ID NO: 564) |
| C5-1533 Target:<br>5'-ATTGACAAAATAACTCACTATAATTAC-3' (SEQ ID NO: 937)<br><br>5'-UUGACAAAAUAACUCACUAUAAUUACU-3' (SEQ ID NO: 2090)<br><br>3'-AACUGUUUUAUUGAGUGAUAUUAAUGA-5' (SEQ ID NO: 554) | C5-1544 Target:<br>5'-AACTCACTATAATTACTTGATTTTATC-3' (SEQ ID NO: 948)<br><br>5'-ACUCACUAUAAUUACUUGAUUUUAUCC-3' (SEQ ID NO: 2101)<br><br>3'-UGAGUGAUAUUAAUGAACUAAAAUAGG-5' (SEQ ID NO: 565) |
| C5-1534 Target:<br>5'-TTGACAAAATAACTCACTATAATTACT-3' (SEQ ID NO: 938)<br><br>5'-UGACAAAAUAACUCACUAUAAUUACUU-3' (SEQ ID NO: 2091)<br><br>3'-ACUGUUUUAUUGAGUGAUAUUAAUGAA-5' (SEQ ID NO: 555) | C5-1545 Target:<br>5'-ACTCACTATAATTACTTGATTTTATCC-3' (SEQ ID NO: 949)<br><br>5'-CUCACUAUAAUUACUUGAUUUUAUCCA-3' (SEQ ID NO: 2102)<br><br>3'-GAGUGAUAUUAAUGAACUAAAAUAGGU-5' (SEQ ID NO: 566) |
| C5-1535 Target:<br>5'-TGACAAAATAACTCACTATAATTACTT-3' (SEQ ID NO: 939)<br><br>5'-GACAAAAUAACUCACUAUAAUUACUUG-3' (SEQ ID NO: 2092)<br><br>3'-CUGUUUUAUUGAGUGAUAUUAAUGAAC-5' (SEQ ID NO: 556) | C5-1546 Target:<br>5'-CTCACTATAATTACTTGATTTTATCCA-3' (SEQ ID NO: 950)<br><br>5'-UCACUAUAAUUACUUGAUUUUAUCCAA-3' (SEQ ID NO: 2103)<br><br>3'-AGUGAUAUUAAUGAACUAAAAUAGGUU-5' (SEQ ID NO: 567) |
| C5-1536 Target:<br>5'-GACAAAATAACTCACTATAATTACTTG-3' (SEQ ID NO: 940)<br><br>5'-ACAAAAUAACUCACUAUAAUUACUUGA-3' (SEQ ID NO: 2093)<br><br>3'-UGUUUUAUUGAGUGAUAUUAAUGAACU-5' (SEQ ID NO: 557) | C5-1547 Target:<br>5'-TCACTATAATTACTTGATTTTATCCAA-3' (SEQ ID NO: 951)<br><br>5'-CACUAUAAUUACUUGAUUUUAUCCAAG-3' (SEQ ID NO: 2104)<br><br>3'-GUGAUAUUAAUGAACUAAAAUAGGUUC-5' (SEQ ID NO: 568) |
| C5-1537 Target:<br>5'-ACAAAATAACTCACTATAATTACTTGA-3' (SEQ ID NO: 941)<br><br>5'-CAAAAUAACUCACUAUAAUUACUUGAU-3' (SEQ ID NO: 2094)<br><br>3'-GUUUUAUUGAGUGAUAUUAAUGAACUA-5' (SEQ ID NO: 558) | C5-1548 Target:<br>5'-CACTATAATTACTTGATTTTATCCAAG-3' (SEQ ID NO: 952)<br><br>5'-ACUAUAAUUACUUGAUUUUAUCCAAGG-3' (SEQ ID NO: 2105)<br><br>3'-UGAUAUUAAUGAACUAAAAUAGGUUCC-5' (SEQ ID NO: 569) |
| C5-1538 Target:<br>5'-CAAAATAACTCACTATAATTACTTGAT-3' (SEQ ID NO: 942)<br><br>5'-AAAAUAACUCACUAUAAUUACUUGAUU-3' (SEQ ID NO: 2095)<br><br>3'-UUUUAUUGAGUGAUAUUAAUGAACUAA-5' (SEQ ID NO: 559) | C5-1549 Target:<br>5'-ACTATAATTACTTGATTTTATCCAAGG-3' (SEQ ID NO: 953)<br><br>5'-CUAUAAUUACUUGAUUUUAUCCAAGGG-3' (SEQ ID NO: 2106)<br><br>3'-GAUAUUAAUGAACUAAAAUAGGUUCCC-5' (SEQ ID NO: 570) |
| C5-1539 Target:<br>5'-AAAATAACTCACTATAATTACTTGATT-3' (SEQ ID NO: 943)<br><br>5'-AAAUAACUCACUAUAAUUACUUGAUUU-3' (SEQ ID NO: 2096)<br><br>3'-UUUAUUGAGUGAUAUUAAUGAACUAAA-5' (SEQ ID NO: 560) | C5-1550 Target:<br>5'-CTATAATTACTTGATTTTATCCAAGGG-3' (SEQ ID NO: 954)<br><br>5'-UAUAAUUACUUGAUUUUAUCCAAGGGC-3' (SEQ ID NO: 2107)<br><br>3'-AUAUUAAUGAACUAAAAUAGGUUCCCG-5' (SEQ ID NO: 571) |
| C5-1540 Target:<br>5'-AAATAACTCACTATAATTACTTGATTT-3' (SEQ ID NO: 944)<br><br>5'-AAUAACUCACUAUAAUUACUUGAUUUU-3' (SEQ ID NO: 2097)<br><br>3'-UUAUUGAGUGAUAUUAAUGAACUAAAA-5' (SEQ ID NO: 561) | C5-1551 Target:<br>5'-TATAATTACTTGATTTTATCCAAGGGC-3' (SEQ ID NO: 955)<br><br>5'-AUAAUUACUUGAUUUUAUCCAAGGGCA-3' (SEQ ID NO: 2108)<br><br>3'-UAUUAAUGAACUAAAAUAGGUUCCCGU-5' (SEQ ID NO: 572) |
| C5-1541 Target:<br>5'-AATAACTCACTATAATTACTTGATTTT-3' (SEQ ID NO: 945)<br><br>5'-AUAACUCACUAUAAUUACUUGAUUUUA-3' (SEQ ID NO: 2098)<br><br>3'-UAUUGAGUGAUAUUAAUGAACUAAAAU-5' (SEQ ID NO: 562) | C5-1552 Target:<br>5'-ATAATTACTTGATTTTATCCAAGGGCA-3' (SEQ ID NO: 956)<br><br>5'-UAAUUACUUGAUUUUAUCCAAGGGCAA-3' (SEQ ID NO: 2109)<br><br>3'-AUUAAUGAACUAAAAUAGGUUCCCGUU-5' (SEQ ID NO: 573) |

Table 5-continued

Selected Human Anti-C5 "Blunt/Blunt" DsiRNAs

C5-1553 Target:
5'-TAATTACTTGATTTTATCCAAGGGCAA-3' (SEQ ID NO: 957)

5'-GUGUCUGAUUCAGUCUGGUUAAAUAUU-3' (SEQ ID NO: 2110)

3'-CACAGACUAAGUCAGACCAAUUUAUAA-5' (SEQ ID NO: 574)

C5-1719 Target:
5'-GTGTCTGATTCAGTCTGGTTAAATATT-3' (SEQ ID NO: 958)

5'-GUCUGAUUCAGUCUGGUUAAAUAUUGA-3' (SEQ ID NO: 2111)

3'-CAGACUAAGUCAGACCAAUUUAUAACU-5' (SEQ ID NO: 575)

C5-1721 Target:
5'-GTCTGATTCAGTCTGGTTAAATATTGA-3' (SEQ ID NO: 959)

5'-UCUGAUUCAGUCUGGUUAAAUAUUGAA-3' (SEQ ID NO: 2112)

3'-AGACUAAGUCAGACCAAUUUAUAACUU-5' (SEQ ID NO: 576)

C5-1722 Target:
5'-TCTGATTCAGTCTGGTTAAATATTGAA-3' (SEQ ID NO: 960)

5'-CUGAUUCAGUCUGGUUAAAUAUUGAAG-3' (SEQ ID NO: 2113)

3'-GACUAAGUCAGACCAAUUUAUAACUUC-5' (SEQ ID NO: 577)

C5-1723 Target:
5'-CTGATTCAGTCTGGTTAAATATTGAAG-3' (SEQ ID NO: 961)

5'-UGAUUCAGUCUGGUUAAAUAUUGAAGA-3' (SEQ ID NO: 2114)

3'-ACUAAGUCAGACCAAUUUAUAACUUCU-5' (SEQ ID NO: 578)

C5-1724 Target:
5'-TGATTCAGTCTGGTTAAATATTGAAGA-3' (SEQ ID NO: 962)

5'-AUUCAGUCUGGUUAAAUAUUGAAGAAA-3' (SEQ ID NO: 2115)

3'-UAAGUCAGACCAAUUUAUAACUUCUUU-5' (SEQ ID NO: 579)

C5-1726 Target:
5'-ATTCAGTCTGGTTAAATATTGAAGAAA-3' (SEQ ID NO: 963)

5'-UUCAGUCUGGUUAAAUAUUGAAGAAAA-3' (SEQ ID NO: 2116)

3'-AAGUCAGACCAAUUUAUAACUUCUUUU-5' (SEQ ID NO: 580)

C5-1727 Target:
5'-TTCAGTCTGGTTAAATATTGAAGAAAA-3' (SEQ ID NO: 964)

5'-UCAGUCUGGUUAAAUAUUGAAGAAAAA-3' (SEQ ID NO: 2117)

3'-AGUCAGACCAAUUUAUAACUUCUUUUU-5' (SEQ ID NO: 581)

C5-1728 Target:
5'-TCAGTCTGGTTAAATATTGAAGAAAAA-3' (SEQ ID NO: 965)

5'-CAGUCUGGUUAAAUAUUGAAGAAAAAU-3' (SEQ ID NO: 2118)

3'-GUCAGACCAAUUUAUAACUUCUUUUUA-5' (SEQ ID NO: 582)

C5-1729 Target:
5'-CAGTCTGGTTAAATATTGAAGAAAAAT-3' (SEQ ID NO: 966)

5'-AGUCUGGUUAAAUAUUGAAGAAAAAUG-3' (SEQ ID NO: 2119)

3'-UCAGACCAAUUUAUAACUUCUUUUUAC-5' (SEQ ID NO: 583)

C5-1730 Target:
5'-AGTCTGGTTAAATATTGAAGAAAAATG-3' (SEQ ID NO: 967)

5'-GUCUGGUUAAAUAUUGAAGAAAAAUGU-3' (SEQ ID NO: 2120)

3'-CAGACCAAUUUAUAACUUCUUUUUACA-5' (SEQ ID NO: 584)

C5-1731 Target:
5'-GTCTGGTTAAATATTGAAGAAAAATGT-3' (SEQ ID NO: 968)

5'-UCUGGUUAAAUAUUGAAGAAAAAUGUG-3' (SEQ ID NO: 2121)

3'-AGACCAAUUUAUAACUUCUUUUUACAC-5' (SEQ ID NO: 585)

C5-1732 Target:
5'-TCTGGTTAAATATTGAAGAAAAATGTG-3' (SEQ ID NO: 969)

5'-CUGGUUAAAUAUUGAAGAAAAAUGUGG-3' (SEQ ID NO: 2122)

3'-GACCAAUUUAUAACUUCUUUUUACACC-5' (SEQ ID NO: 586)

C5-1733 Target:
5'-CTGGTTAAATATTGAAGAAAAATGTGG-3' (SEQ ID NO: 970)

5'-AAUGUGGCAACCAGCUCCAGGUUCAUC-3' (SEQ ID NO: 2123)

3'-UUACACCGUUGGUCGAGGUCCAAGUAG-5' (SEQ ID NO: 587)

C5-1753 Target:
5'-AATGTGGCAACCAGCTCCAGGTTCATC-3' (SEQ ID NO: 971)

5'-AUGUGGCAACCAGCUCCAGGUUCAUCU-3' (SEQ ID NO: 2124)

3'-UACACCGUUGGUCGAGGUCCAAGUAGA-5' (SEQ ID NO: 588)

C5-1754 Target:
5'-ATGTGGCAACCAGCTCCAGGTTCATCT-3' (SEQ ID NO: 972)

5'-AUCUGGGCUGUGGGGCAGGUGGUGGCC-3' (SEQ ID NO: 2125)

3'-UAGACCCGACACCCCGUCCACCACCGG-5' (SEQ ID NO: 589)

C5-1948 Target:
5'-ATCTGGGCTGTGGGGCAGGTGGTGGCC-3' (SEQ ID NO: 973)

5'-UCUGGGCUGUGGGGCAGGUGGUGGCCU-3' (SEQ ID NO: 2126)

3'-AGACCCGACACCCCGUCCACCACCGGA-5' (SEQ ID NO: 590)

C5-1949 Target:
5'-TCTGGGCTGTGGGGCAGGTGGTGGCCT-3' (SEQ ID NO: 974)

5'-CUGGGCUGUGGGGCAGGUGGUGGCCUC-3' (SEQ ID NO: 2127)

3'-GACCCGACACCCCGUCCACCACCGGAG-5' (SEQ ID NO: 591)

C5-1950 Target:
5'-CTGGGCTGTGGGGCAGGTGGTGGCCTC-3' (SEQ ID NO: 975)

5'-UGGGCUGUGGGGCAGGUGGUGGCCUCA-3' (SEQ ID NO: 2128)

3'-ACCCGACACCCCGUCCACCACCGGAGU-5' (SEQ ID NO: 592)

C5-1951 Target:
5'-TGGGCTGTGGGGCAGGTGGTGGCCTCA-3' (SEQ ID NO: 976)

5'-GGGCUGUGGGGCAGGUGGUGGCCUCAA-3' (SEQ ID NO: 2129)

3'-CCCGACACCCCGUCCACCACCGGAGUU-5' (SEQ ID NO: 593)

C5-1952 Target:
5'-GGGCTGTGGGGCAGGTGGTGGCCTCAA-3' (SEQ ID NO: 977)

5'-GGCUGUGGGGCAGGUGGUGGCCUCAAC-3' (SEQ ID NO: 2130)

3'-CCGACACCCCGUCCACCACCGGAGUUG-5' (SEQ ID NO: 594)

C5-1953 Target:
5'-GGCTGTGGGGCAGGTGGTGGCCTCAAC-3' (SEQ ID NO: 978)

5'-GCUGUGGGGCAGGUGGUGGCCUCAACA-3' (SEQ ID NO: 2131)

3'-CGACACCCCGUCCACCACCGGAGUUGU-5' (SEQ ID NO: 595)

Table 5-continued

Selected Human Anti-C5 "Blunt/Blunt" DsiRNAs

C5-1954 Target:
5'-GCTGTGGGGCAGGTGGTGGCCTCAACA-3' (SEQ ID NO: 979)

5'-CAAGAAAAUGAUGAACCUUGUAAAGAA-3' (SEQ ID NO: 2132)

3'-GUUCUUUUACUACUUGGAACAUUUCUU-5' (SEQ ID NO: 596)

C5-2043 Target:
5'-CAAGAAAATGATGAACCTTGTAAAGAA-3' (SEQ ID NO: 980)

5'-AAAUGAUGAACCUUGUAAAGAAAUUCU-3' (SEQ ID NO: 2133)

3'-UUUACUACUUGGAACAUUUCUUUAAGA-5' (SEQ ID NO: 597)

C5-2048 Target:
5'-AAATGATGAACCTTGTAAAGAAATTCT-3' (SEQ ID NO: 981)

5'-AUGAUGAACCUUGUAAAGAAAUUCUCA-3' (SEQ ID NO: 2134)

3'-UACUACUUGGAACAUUUCUUUAAGAGU-5' (SEQ ID NO: 598)

C5-2050 Target:
5'-ATGATGAACCTTGTAAAGAAATTCTCA-3' (SEQ ID NO: 982)

5'-UGAUGAACCUUGUAAAGAAAUUCUCAG-3' (SEQ ID NO: 2135)

3'-ACUACUUGGAACAUUUCUUUAAGAGUC-5' (SEQ ID NO: 599)

C5-2051 Target:
5'-TGATGAACCTTGTAAAGAAATTCTCAG-3' (SEQ ID NO: 983)

5'-ACCUUGUAAAGAAAUUCUCAGGCCAAG-3' (SEQ ID NO: 2136)

3'-UGGAACAUUUCUUUAAGAGUCCGGUUC-5' (SEQ ID NO: 600)

C5-2057 Target:
5'-ACCTTGTAAAGAAATTCTCAGGCCAAG-3' (SEQ ID NO: 984)

5'-CCUUGUAAAGAAAUUCUCAGGCCAAGA-3' (SEQ ID NO: 2137)

3'-GGAACAUUUCUUUAAGAGUCCGGUUCU-5' (SEQ ID NO: 601)

C5-2058 Target:
5'-CCTTGTAAAGAAATTCTCAGGCCAAGA-3' (SEQ ID NO: 985)

5'-UCAGUAGUGAAGAAAUGUUGUUACGAU-3' (SEQ ID NO: 2138)

3'-AGUCAUCACUUCUUUACAACAAUGCUA-5' (SEQ ID NO: 602)

C5-2133 Target:
5'-TCAGTAGTGAAGAAATGTTGTTACGAT-3' (SEQ ID NO: 986)

5'-CAGUAGUGAAGAAAUGUUGUUACGAUG-3' (SEQ ID NO: 2139)

3'-GUCAUCACUUCUUUACAACAAUGCUAC-5' (SEQ ID NO: 603)

C5-2134 Target:
5'-CAGTAGTGAAGAAATGTTGTTACGATG-3' (SEQ ID NO: 987)

5'-AUGAAGACCCUGUUACCAGUAAGCAAG-3' (SEQ ID NO: 2140)

3'-UACUUCUGGGACAAUGGUCAUUCGUUC-5' (SEQ ID NO: 604)

C5-2316 Target:
5'-ATGAAGACCCTGTTACCAGTAAGCAAG-3' (SEQ ID NO: 988)

5'-AGCAAGCCAGAAAUUCGGAGUUAUUUU-3' (SEQ ID NO: 2141)

3'-UCGUUCGGUCUUUAAGCCUCAAUAAAA-5' (SEQ ID NO: 605)

C5-2337 Target:
5'-AGCAAGCCAGAAATTCGGAGTTATTTT-3' (SEQ ID NO: 989)

5'-UGUCAAGGCAAAGGUGUUCAAAGAUGU-3' (SEQ ID NO: 2142)

3'-ACAGUUCCGUUUCCACAAGUUUCUACA-5' (SEQ ID NO: 606)

C5-2498 Target:
5'-TGTCAAGGCAAAGGTGTTCAAAGATGT-3' (SEQ ID NO: 990)

5'-GUCAAGGCAAAGGUGUUCAAAGAUGUC-3' (SEQ ID NO: 2143)

3'-CAGUUCCGUUUCCACAAGUUUCUACAG-5' (SEQ ID NO: 607)

C5-2499 Target:
5'-GTCAAGGCAAAGGTGTTCAAAGATGTC-3' (SEQ ID NO: 991)

5'-UCAAGGCAAAGGUGUUCAAAGAUGUCU-3' (SEQ ID NO: 2144)

3'-AGUUCCGUUUCCACAAGUUUCUACAGA-5' (SEQ ID NO: 608)

C5-2500 Target:
5'-TCAAGGCAAAGGTGTTCAAAGATGTCT-3' (SEQ ID NO: 992)

5'-CAAGGCAAAGGUGUUCAAAGAUGUCUU-3' (SEQ ID NO: 2145)

3'-GUUCCGUUUCCACAAGUUUCUACAGAA-5' (SEQ ID NO: 609)

C5-2501 Target:
5'-CAAGGCAAAGGTGTTCAAAGATGTCTT-3' (SEQ ID NO: 993)

5'-AAGAUGUCUUCCUGGAAAUGAAUAUAC-3' (SEQ ID NO: 2146)

3'-UUCUACAGAAGGACCUUUACUUAUAUG-5' (SEQ ID NO: 610)

C5-2518 Target:
5'-AAGATGTCTTCCTGGAAATGAATATAC-3' (SEQ ID NO: 994)

5'-UCCUGGAAAUGAAUAUACCAUAUUCUG-3' (SEQ ID NO: 2147)

3'-AGGACCUUUACUUAUAUGGUAUAAGAC-5' (SEQ ID NO: 611)

C5-2527 Target:
5'-TCCTGGAAATGAATATACCATATTCTG-3' (SEQ ID NO: 995)

5'-CCUGGAAAUGAAUAUACCAUAUUCUGU-3' (SEQ ID NO: 2148)

3'-GGACCUUUACUUAUAUGGUAUAAGACA-5' (SEQ ID NO: 612)

C5-2528 Target:
5'-CCTGGAAATGAATATACCATATTCTGT-3' (SEQ ID NO: 996)

5'-CUGGAAAUGAAUAUACCAUAUUCUGUU-3' (SEQ ID NO: 2149)

3'-GACCUUUACUUAUAUGGUAUAAGACAA-5' (SEQ ID NO: 613)

C5-2529 Target:
5'-CTGGAAATGAATATACCATATTCTGTT-3' (SEQ ID NO: 997)

5'-UGGAAAUGAAUAUACCAUAUUCUGUUG-3' (SEQ ID NO: 2150)

3'-ACCUUUACUUAUAUGGUAUAAGACAAC-5' (SEQ ID NO: 614)

C5-2530 Target:
5'-TGGAAATGAATATACCATATTCTGTTG-3' (SEQ ID NO: 998)

5'-GGAAAUGAAUAUACCAUAUUCUGUUGU-3' (SEQ ID NO: 2151)

3'-CCUUUACUUAUAUGGUAUAAGACAACA-5' (SEQ ID NO: 615)

C5-2531 Target:
5'-GGAAATGAATATACCATATTCTGTTGT-3' (SEQ ID NO: 999)

5'-GAAAUGAAUAUACCAUAUUCUGUUGUA-3' (SEQ ID NO: 2152)

3'-CUUUACUUAUAUGGUAUAAGACAACAU-5' (SEQ ID NO: 616)

C5-2532 Target:
5'-GAAATGAATATACCATATTCTGTTGTA-3' (SEQ ID NO: 1000)

5'-AAAUGAAUAUACCAUAUUCUGUUGUAC-3' (SEQ ID NO: 2153)

3'-UUUACUUAUAUGGUAUAAGACAACAUG-5' (SEQ ID NO: 617)

Table 5-continued

Selected Human Anti-C5 "Blunt/Blunt" DsiRNAs

C5-2533 Target:
5'-AAATGAATATACCATATTCTGTTGTAC-3' (SEQ ID NO: 1001)

5'-AAUGAAUAUACCAUAUUCUGUUGUACG-3' (SEQ ID NO: 2154)

3'-UUACUUAUAUGGUAUAAGACAACAUGC-5' (SEQ ID NO: 618)

C5-2534 Target:
5'-AATGAATATACCATATTCTGTTGTACG-3' (SEQ ID NO: 1002)

5'-AUGAAUAUACCAUAUUCUGUUGUACGA-3' (SEQ ID NO: 2155)

3'-UACUUAUAUGGUAUAAGACAACAUGCU-5' (SEQ ID NO: 619)

C5-2535 Target:
5'-ATGAATATACCATATTCTGTTGTACGA-3' (SEQ ID NO: 1003)

5'-UGAAUAUACCAUAUUCUGUUGUACGAG-3' (SEQ ID NO: 2156)

3'-ACUUAUAUGGUAUAAGACAACAUGCUC-5' (SEQ ID NO: 620)

C5-2536 Target:
5'-TGAATATACCATATTCTGTTGTACGAG-3' (SEQ ID NO: 1004)

5'-GAAUAUACCAUAUUCUGUUGUACGAGG-3' (SEQ ID NO: 2157)

3'-CUUAUAUGGUAUAAGACAACAUGCUCC-5' (SEQ ID NO: 621)

C5-2537 Target:
5'-GAATATACCATATTCTGTTGTACGAGG-3' (SEQ ID NO: 1005)

5'-UACGAGGAGAACAGAUCCAAUUGAAAG-3' (SEQ ID NO: 2158)

3'-AUGCUCCUCUUGUCUAGGUUAACUUUC-5' (SEQ ID NO: 622)

C5-2557 Target:
5'-TACGAGGAGAACAGATCCAATTGAAAG-3' (SEQ ID NO: 1006)

5'-ACGAGGAGAACAGAUCCAAUUGAAAGG-3' (SEQ ID NO: 2159)

3'-UGCUCCUCUUGUCUAGGUUAACUUUCC-5' (SEQ ID NO: 623)

C5-2558 Target:
5'-ACGAGGAGAACAGATCCAATTGAAAGG-3' (SEQ ID NO: 1007)

5'-CGAGGAGAACAGAUCCAAUUGAAAGGA-3' (SEQ ID NO: 2160)

3'-GCUCCUCUUGUCUAGGUUAACUUUCCU-5' (SEQ ID NO: 624)

C5-2559 Target:
5'-CGAGGAGAACAGATCCAATTGAAAGGA-3' (SEQ ID NO: 1008)

5'-GAGGAGAACAGAUCCAAUUGAAAGGAA-3' (SEQ ID NO: 2161)

3'-CUCCUCUUGUCUAGGUUAACUUUCCUU-5' (SEQ ID NO: 625)

C5-2560 Target:
5'-GAGGAGAACAGATCCAATTGAAAGGAA-3' (SEQ ID NO: 1009)

5'-AGGAGAACAGAUCCAAUUGAAAGGAAC-3' (SEQ ID NO: 2162)

3'-UCCUCUUGUCUAGGUUAACUUUCCUUG-5' (SEQ ID NO: 626)

C5-2561 Target:
5'-AGGAGAACAGATCCAATTGAAAGGAAC-3' (SEQ ID NO: 1010)

5'-GGAGAACAGAUCCAAUUGAAAGGAACU-3' (SEQ ID NO: 2163)

3'-CCUCUUGUCUAGGUUAACUUUCCUUGA-5' (SEQ ID NO: 627)

C5-2562 Target:
5'-GGAGAACAGATCCAATTGAAAGGAACT-3' (SEQ ID NO: 1011)

5'-GAGAACAGAUCCAAUUGAAAGGAACUG-3' (SEQ ID NO: 2164)

3'-CUCUUGUCUAGGUUAACUUUCCUUGAC-5' (SEQ ID NO: 628)

C5-2563 Target:
5'-GAGAACAGATCCAATTGAAAGGAACTG-3' (SEQ ID NO: 1012)

5'-AGAACAGAUCCAAUUGAAAGGAACUGU-3' (SEQ ID NO: 2165)

3'-UCUUGUCUAGGUUAACUUUCCUUGACA-5' (SEQ ID NO: 629)

C5-2564 Target:
5'-AGAACAGATCCAATTGAAAGGAACTGT-3' (SEQ ID NO: 1013)

5'-GAACAGAUCCAAUUGAAAGGAACUGUU-3' (SEQ ID NO: 2166)

3'-CUUGUCUAGGUUAACUUUCCUUGACAA-5' (SEQ ID NO: 630)

C5-2565 Target:
5'-GAACAGATCCAATTGAAAGGAACTGTT-3' (SEQ ID NO: 1014)

5'-AACAGAUCCAAUUGAAAGGAACUGUUU-3' (SEQ ID NO: 2167)

3'-UUGUCUAGGUUAACUUUCCUUGACAAA-5' (SEQ ID NO: 631)

C5-2566 Target:
5'-AACAGATCCAATTGAAAGGAACTGTTT-3' (SEQ ID NO: 1015)

5'-ACAGAUCCAAUUGAAAGGAACUGUUUA-3' (SEQ ID NO: 2168)

3'-UGUCUAGGUUAACUUUCCUUGACAAAU-5' (SEQ ID NO: 632)

C5-2567 Target:
5'-ACAGATCCAATTGAAAGGAACTGTTTA-3' (SEQ ID NO: 1016)

5'-CAGAUCCAAUUGAAAGGAACUGUUUAC-3' (SEQ ID NO: 2169)

3'-GUCUAGGUUAACUUUCCUUGACAAAUG-5' (SEQ ID NO: 633)

C5-2568 Target:
5'-CAGATCCAATTGAAAGGAACTGTTTAC-3' (SEQ ID NO: 1017)

5'-AGAUCCAAUUGAAAGGAACUGUUUACA-3' (SEQ ID NO: 2170)

3'-UCUAGGUUAACUUUCCUUGACAAAUGU-5' (SEQ ID NO: 634)

C5-2569 Target:
5'-AGATCCAATTGAAAGGAACTGTTTACA-3' (SEQ ID NO: 1018)

5'-GAUCCAAUUGAAAGGAACUGUUUACAA-3' (SEQ ID NO: 2171)

3'-CUAGGUUAACUUUCCUUGACAAAUGUU-5' (SEQ ID NO: 635)

C5-2570 Target:
5'-GATCCAATTGAAAGGAACTGTTTACAA-3' (SEQ ID NO: 1019)

5'-AUCCAAUUGAAAGGAACUGUUUACAAC-3' (SEQ ID NO: 2172)

3'-UAGGUUAACUUUCCUUGACAAAUGUUG-5' (SEQ ID NO: 636)

C5-2571 Target:
5'-ATCCAATTGAAAGGAACTGTTTACAAC-3' (SEQ ID NO: 1020)

5'-UCCAAUUGAAAGGAACUGUUUACAACU-3' (SEQ ID NO: 2173)

3'-AGGUUAACUUUCCUUGACAAAUGUUGA-5' (SEQ ID NO: 637)

C5-2572 Target:
5'-TCCAATTGAAAGGAACTGTTTACAACT-3' (SEQ ID NO: 1021)

5'-CCAAUUGAAAGGAACUGUUUACAACUA-3' (SEQ ID NO: 2174)

3'-GGUUAACUUUCCUUGACAAAUGUUGAU-5' (SEQ ID NO: 638)

C5-2573 Target:
5'-CCAATTGAAAGGAACTGTTTACAACTA-3' (SEQ ID NO: 1022)

5'-CAAUUGAAAGGAACUGUUUACAACUAU-3' (SEQ ID NO: 2175)

3'-GUUAACUUUCCUUGACAAAUGUUGAUA-5' (SEQ ID NO: 639)

Table 5-continued

Selected Human Anti-C5 "Blunt/Blunt" DsiRNAs

C5-2574 Target:
5'-CAATTGAAAGGAACTGTTTACAACTAT-3' (SEQ ID NO: 1023)

5'-AAUUGAAAGGAACUGUUUACAACUAUA-3' (SEQ ID NO: 2176)

3'-UUAACUUUCCUUGACAAAUGUUGAUAU-5' (SEQ ID NO: 640)

C5-2575 Target:
5'-AATTGAAAGGAACTGTTTACAACTATA-3' (SEQ ID NO: 1024)

5'-AUUGAAAGGAACUGUUUACAACUAUAG-3' (SEQ ID NO: 2177)

3'-UAACUUUCCUUGACAAAUGUUGAUAUC-5' (SEQ ID NO: 641)

C5-2576 Target:
5'-ATTGAAAGGAACTGTTTACAACTATAG-3' (SEQ ID NO: 1025)

5'-UUGAAAGGAACUGUUUACAACUAUAGG-3' (SEQ ID NO: 2178)

3'-AACUUUCCUUGACAAAUGUUGAUAUCC-5' (SEQ ID NO: 642)

C5-2577 Target:
5'-TTGAAAGGAACTGTTTACAACTATAGG-3' (SEQ ID NO: 1026)

5'-UGAAAGGAACUGUUUACAACUAUAGGA-3' (SEQ ID NO: 2179)

3'-ACUUUCCUUGACAAAUGUUGAUAUCCU-5' (SEQ ID NO: 643)

C5-2578 Target:
5'-TGAAAGGAACTGTTTACAACTATAGGA-3' (SEQ ID NO: 1027)

5'-GAAAGGAACUGUUUACAACUAUAGGAC-3' (SEQ ID NO: 2180)

3'-CUUUCCUUGACAAAUGUUGAUAUCCUG-5' (SEQ ID NO: 644)

C5-2579 Target:
5'-GAAAGGAACTGTTTACAACTATAGGAC-3' (SEQ ID NO: 1028)

5'-AAAGGAACUGUUUACAACUAUAGGACU-3' (SEQ ID NO: 2181)

3'-UUUCCUUGACAAAUGUUGAUAUCCUGA-5' (SEQ ID NO: 645)

C5-2580 Target:
5'-AAAGGAACTGTTTACAACTATAGGACT-3' (SEQ ID NO: 1029)

5'-AAGGAACUGUUUACAACUAUAGGACUU-3' (SEQ ID NO: 2182)

3'-UUCCUUGACAAAUGUUGAUAUCCUGAA-5' (SEQ ID NO: 646)

C5-2581 Target:
5'-AAGGAACTGTTTACAACTATAGGACTT-3' (SEQ ID NO: 1030)

5'-GUGUUAAAAUGUCUGCUGUGGAGGGAA-3' (SEQ ID NO: 2183)

3'-CACAAUUUUACAGACGACACCUCCCUU-5' (SEQ ID NO: 647)

C5-2623 Target:
5'-GTGTTAAAATGTCTGCTGTGGAGGGAA-3' (SEQ ID NO: 1031)

5'-UGUUAAAAUGUCUGCUGUGGAGGGAAU-3' (SEQ ID NO: 2184)

3'-ACAAUUUUACAGACGACACCUCCCUUA-5' (SEQ ID NO: 648)

C5-2624 Target:
5'-TGTTAAAATGTCTGCTGTGGAGGGAAT-3' (SEQ ID NO: 1032)

5'-GUUAAAAUGUCUGCUGUGGAGGGAAUC-3' (SEQ ID NO: 2185)

3'-CAAUUUUACAGACGACACCUCCCUUAG-5' (SEQ ID NO: 649)

C5-2625 Target:
5'-GTTAAAATGTCTGCTGTGGAGGGAATC-3' (SEQ ID NO: 1033)

5'-UUAAAAUGUCUGCUGUGGAGGGAAUCU-3' (SEQ ID NO: 2186)

3'-AAUUUACAGACGACACCUCCCUUAGA-5' (SEQ ID NO: 650)

C5-2626 Target:
5'-TTAAAATGTCTGCTGTGGAGGGAATCT-3' (SEQ ID NO: 1034)

5'-UAAAAUGUCUGCUGUGGAGGGAAUCUG-3' (SEQ ID NO: 2187)

3'-AUUUUACAGACGACACCUCCCUUAGAC-5' (SEQ ID NO: 651)

C5-2627 Target:
5'-TAAAATGTCTGCTGTGGAGGGAATCTG-3' (SEQ ID NO: 1035)

5'-UGUGCUUCCUCUGGAAAUUGGCCUUCA-3' (SEQ ID NO: 2188)

3'-ACACGAAGGAGACCUUUAACCGGAAGU-5' (SEQ ID NO: 652)

C5-2753 Target:
5'-TGTGCTTCCTCTGGAAATTGGCCTTCA-3' (SEQ ID NO: 1036)

5'-GUGCUUCCUCUGGAAAUUGGCCUUCAC-3' (SEQ ID NO: 2189)

3'-CACGAAGGAGACCUUUAACCGGAAGUG-5' (SEQ ID NO: 653)

C5-2754 Target:
5'-GTGCTTCCTCTGGAAATTGGCCTTCAC-3' (SEQ ID NO: 1037)

5'-UGCUUCCUCUGGAAAUUGGCCUUCACA-3' (SEQ ID NO: 2190)

3'-ACGAAGGAGACCUUUAACCGGAAGUGU-5' (SEQ ID NO: 654)

C5-2755 Target:
5'-TGCTTCCTCTGGAAATTGGCCTTCACA-3' (SEQ ID NO: 1038)

5'-GCUUCCUCUGGAAAUUGGCCUUCACAA-3' (SEQ ID NO: 2191)

3'-CGAAGGAGACCUUUAACCGGAAGUGUU-5' (SEQ ID NO: 655)

C5-2756 Target:
5'-GCTTCCTCTGGAAATTGGCCTTCACAA-3' (SEQ ID NO: 1039)

5'-CUUCCUCUGGAAAUUGGCCUUCACAAC-3' (SEQ ID NO: 2192)

3'-GAAGGAGACCUUUAACCGGAAGUGUUG-5' (SEQ ID NO: 656)

C5-2757 Target:
5'-CTTCCTCTGGAAATTGGCCTTCACAAC-3' (SEQ ID NO: 1040)

5'-UUCCUCUGGAAAUUGGCCUUCACAACA-3' (SEQ ID NO: 2193)

3'-AAGGAGACCUUUAACCGGAAGUGUUGU-5' (SEQ ID NO: 657)

C5-2758 Target:
5'-TTCCTCTGGAAATTGGCCTTCACAACA-3' (SEQ ID NO: 1041)

5'-UCCUCUGGAAAUUGGCCUUCACAACAU-3' (SEQ ID NO: 2194)

3'-AGGAGACCUUUAACCGGAAGUGUUGUA-5' (SEQ ID NO: 658)

C5-2759 Target:
5'-TCCTCTGGAAATTGGCCTTCACAACAT-3' (SEQ ID NO: 1042)

5'-CCUCUGGAAAUUGGCCUUCACAACAUC-3' (SEQ ID NO: 2195)

3'-GGAGACCUUUAACCGGAAGUGUUGUAG-5' (SEQ ID NO: 659)

C5-2760 Target:
5'-CCTCTGGAAATTGGCCTTCACAACATC-3' (SEQ ID NO: 1043)

5'-ACAGAAAUCAAAGGAUUUUGAGUGUA-3' (SEQ ID NO: 2196)

3'-UGUCUUUAGUUUUCCUAAAACUCACAU-5' (SEQ ID NO: 660)

C5-2967 Target:
5'-ACAGAAATCAAAGGATTTTGAGTGTA-3' (SEQ ID NO: 1044)

5'-CAGAAAUCAAAGGAUUUUGAGUGUAA-3' (SEQ ID NO: 2197)

3'-GUCUUUAGUUUUCCUAAAACUCACAUU-5' (SEQ ID NO: 661)

Table 5-continued

Selected Human Anti-C5 "Blunt/Blunt" DsiRNAs

C5-2968 Target:
5'-CAGAAATCAAAAGGATTTTGAGTGTAA-3' (SEQ ID NO: 1045)

5'-AUCAAAAGGAUUUUGAGUGUAAAAGGA-3' (SEQ ID NO: 2198)

3'-UAGUUUUCCUAAAACUCACAUUUUCCU-5' (SEQ ID NO: 662)

C5-2973 Target:
5'-ATCAAAAGGATTTTGAGTGTAAAAGGA-3' (SEQ ID NO: 1046)

5'-AUAUCCUAACCCACCUCCCCAAAGGGA-3' (SEQ ID NO: 2199)

3'-UAUAGGAUUGGGUGGAGGGGUUUCCCU-5' (SEQ ID NO: 663)

C5-3049 Target:
5'-ATATCCTAACCCACCTCCCCAAAGGGA-3' (SEQ ID NO: 1047)

5'-UAUCCUAACCCACCUCCCCAAAGGGAG-3' (SEQ ID NO: 2200)

3'-AUAGGAUUGGGUGGAGGGGUUUCCCUC-5' (SEQ ID NO: 664)

C5-3050 Target:
5'-TATCCTAACCCACCTCCCCAAAGGGAG-3' (SEQ ID NO: 1048)

5'-UCCCAGUAUUCUAUGUUUUUCACUACC-3' (SEQ ID NO: 2201)

3'-AGGGUCAUAAGAUACAAAAAGUGAUGG-5' (SEQ ID NO: 665)

C5-3103 Target:
5'-TCCCAGTATTCTATGTTTTTCACTACC-3' (SEQ ID NO: 1049)

5'-ACAGGAAAUCAUUGGAACAUUUUUCAU-3' (SEQ ID NO: 2202)

3'-UGUCCUUUAGUAACCUUGUAAAAAGUA-5' (SEQ ID NO: 666)

C5-3135 Target:
5'-ACAGGAAATCATTGGAACATTTTTCAT-3' (SEQ ID NO: 1050)

5'-CAGGAAAUCAUUGGAACAUUUUUCAUU-3' (SEQ ID NO: 2203)

3'-GUCCUUUAGUAACCUUGUAAAAAGUAA-5' (SEQ ID NO: 667)

C5-3136 Target:
5'-CAGGAAATCATTGGAACATTTTTCATT-3' (SEQ ID NO: 1051)

5'-UUGAGCAUUAUGUCCUACAGAAAUGCU-3' (SEQ ID NO: 2204)

3'-AACUCGUAAUACAGGAUGUCUUUACGA-5' (SEQ ID NO: 668)

C5-3216 Target:
5'-TTGAGCATTATGTCCTACAGAAATGCT-3' (SEQ ID NO: 1052)

5'-CACUUGGUUAACAGCUUUUGCUUUAAG-3' (SEQ ID NO: 2205)

3'-GUGAACCAAUUGUCGAAAACGAAAUUC-5' (SEQ ID NO: 669)

C5-3281 Target:
5'-CACTTGGTTAACAGCTTTTGCTTTAAG-3' (SEQ ID NO: 1053)

5'-UUGGUUAACAGCUUUUGCUUUAAGAGU-3' (SEQ ID NO: 2206)

3'-AACCAAUUGUCGAAAACGAAAUUCUCA-5' (SEQ ID NO: 670)

C5-3284 Target:
5'-TTGGTTAACAGCTTTTGCTTTAAGAGT-3' (SEQ ID NO: 1054)

5'-UGGUUAACAGCUUUUGCUUUAAGAGUA-3' (SEQ ID NO: 2207)

3'-ACCAAUUGUCGAAAACGAAAUUCUCAU-5' (SEQ ID NO: 671)

C5-3285 Target:
5'-TGGTTAACAGCTTTTGCTTTAAGAGTA-3' (SEQ ID NO: 1055)

5'-UUGCUUUAAGAGUACUUGGACAAGUAA-3' (SEQ ID NO: 2208)

3'-AACGAAAUUCUCAUGAACCUGUUCAUU-5' (SEQ ID NO: 672)

C5-3298 Target:
5'-TTGCTTTAAGAGTACTTGGACAAGTAA-3' (SEQ ID NO: 1056)

5'-UGCUUUAAGAGUACUUGGACAAGUAAA-3' (SEQ ID NO: 2209)

3'-ACGAAAUUCUCAUGAACCUGUUCAUUU-5' (SEQ ID NO: 673)

C5-3299 Target:
5'-TGCTTTAAGAGTACTTGGACAAGTAAA-3' (SEQ ID NO: 1057)

5'-UUUAAGAGUACUUGGACAAGUAAAUAA-3' (SEQ ID NO: 2210)

3'-AAAUUCUCAUGAACCUGUUCAUUUAUU-5' (SEQ ID NO: 674)

C5-3302 Target:
5'-TTTAAGAGTACTTGGACAAGTAAATAA-3' (SEQ ID NO: 1058)

5'-UUAAGAGUACUUGGACAAGUAAAUAAA-3' (SEQ ID NO: 2211)

3'-AAUUCUCAUGAACCUGUUCAUUUAUUU-5' (SEQ ID NO: 675)

C5-3303 Target:
5'-TTAAGAGTACTTGGACAAGTAAATAAA-3' (SEQ ID NO: 1059)

5'-CGUAGAGCAGAACCAAAAUUCAAUUUG-3' (SEQ ID NO: 2212)

3'-GCAUCUCGUCUUGGUUUUAAGUUAAAC-5' (SEQ ID NO: 676)

C5-3332 Target:
5'-CGTAGAGCAGAACCAAAATTCAATTTG-3' (SEQ ID NO: 1060)

5'-GUAGAGCAGAACCAAAAUUCAAUUUGU-3' (SEQ ID NO: 2213)

3'-CAUCUCGUCUUGGUUUUAAGUUAAACA-5' (SEQ ID NO: 677)

C5-3333 Target:
5'-GTAGAGCAGAACCAAAATTCAATTTGT-3' (SEQ ID NO: 1061)

5'-UAGAGCAGAACCAAAAUUCAAUUUGUA-3' (SEQ ID NO: 2214)

3'-AUCUCGUCUUGGUUUUAAGUUAAACAU-5' (SEQ ID NO: 678)

C5-3334 Target:
5'-TAGAGCAGAACCAAAATTCAATTTGTA-3' (SEQ ID NO: 1062)

5'-AGAGCAGAACCAAAAUUCAAUUUGUAA-3' (SEQ ID NO: 2215)

3'-UCUCGUCUUGGUUUUAAGUUAAACAUU-5' (SEQ ID NO: 679)

C5-3335 Target:
5'-AGAGCAGAACCAAAATTCAATTTGTAA-3' (SEQ ID NO: 1063)

5'-UUCACAGUAUCAACCAAUAAAAUUACA-3' (SEQ ID NO: 2216)

3'-AAGUGUCAUAGUUGGUUAUUUUAAUGU-5' (SEQ ID NO: 680)

C5-3419 Target:
5'-TTCACAGTATCAACCAATAAAATTACA-3' (SEQ ID NO: 1064)

5'-CAACCAAUAAAAUUCAGGGUACCUUG-3' (SEQ ID NO: 2217)

3'-GUUGGUUAUUUUAAUGUCCCAUGGAAC-5' (SEQ ID NO: 681)

C5-3429 Target:
5'-CAACCAATAAAATTCAGGGTACCTTG-3' (SEQ ID NO: 1065)

5'-AACCAAUAAAAUUCAGGGUACCUUGC-3' (SEQ ID NO: 2218)

3'-UUGGUUAUUUUAAUGUCCCAUGGAACG-5' (SEQ ID NO: 682)

C5-3430 Target:
5'-AACCAATAAAATTCAGGGTACCTTGC-3' (SEQ ID NO: 1066)

5'-ACCAAUAAAAUUCAGGGUACCUUGCC-3' (SEQ ID NO: 2219)

3'-UGGUUAUUUUAAUGUCCCAUGGAACGG-5' (SEQ ID NO: 683)

Table 5-continued

Selected Human Anti-C5 "Blunt/Blunt" DsiRNAs

C5-3431 Target:
5'-ACCAATAAAATTACAGGGTACCTTGCC-3' (SEQ ID NO: 1067)

5'-UACUGUGAUUGGAAUUAGAAAGGCUUU-3' (SEQ ID NO: 2220)

3'-AUGACACUAACCUUAAUCUUUCCGAAA-5' (SEQ ID NO: 684)

C5-3497 Target:
5'-TACTGTGATTGGAATTAGAAAGGCTTT-3' (SEQ ID NO: 1068)

5'-ACUGUGAUUGGAAUUAGAAAGGCUUUC-3' (SEQ ID NO: 2221)

3'-UGACACUAACCUUAAUCUUUCCGAAAG-5' (SEQ ID NO: 685)

C5-3498 Target:
5'-ACTGTGATTGGAATTAGAAAGGCTTTC-3' (SEQ ID NO: 1069)

5'-CUGUGAUUGGAAUUAGAAAGGCUUUCG-3' (SEQ ID NO: 2222)

3'-GACACUAACCUUAAUCUUUCCGAAAGC-5' (SEQ ID NO: 686)

C5-3499 Target:
5'-CTGTGATTGGAATTAGAAAGGCTTTCG-3' (SEQ ID NO: 1070)

5'-UGUGAUUGGAAUUAGAAAGGCUUUCGA-3' (SEQ ID NO: 2223)

3'-ACACUAACCUUAAUCUUUCCGAAAGCU-5' (SEQ ID NO: 687)

C5-3500 Target:
5'-TGTGATTGGAATTAGAAAGGCTTTCGA-3' (SEQ ID NO: 1071)

5'-CGUUCAAUUGUUUCAGCUUUGAAGAGA-3' (SEQ ID NO: 2224)

3'-GCAAGUUAACAAAGUCGAAACUUCUCU-5' (SEQ ID NO: 688)

C5-3672 Target:
5'-CGTTCAATTGTTTCAGCTTTGAAGAGA-3' (SEQ ID NO: 1072)

5'-UUGAAGAGAGAAGCUUUGGUUAAAGGU-3' (SEQ ID NO: 2225)

3'-AACUUCUCUCUUCGAAACCAAUUUCCA-5' (SEQ ID NO: 689)

C5-3690 Target:
5'-TTGAAGAGAGAAGCTTTGGTTAAAGGT-3' (SEQ ID NO: 1073)

5'-UGAAGAGAGAAGCUUUGGUUAAAGGUA-3' (SEQ ID NO: 2226)

3'-ACUUCUCUCUUCGAAACCAAUUUCCAU-5' (SEQ ID NO: 690)

C5-3691 Target:
5'-TGAAGAGAGAAGCTTTGGTTAAAGGTA-3' (SEQ ID NO: 1074)

5'-GAAGAGAGAAGCUUUGGUUAAAGGUAA-3' (SEQ ID NO: 2227)

3'-CUUCUCUCUUCGAAACCAAUUUCCAUU-5' (SEQ ID NO: 691)

C5-3692 Target:
5'-GAAGAGAGAAGCTTTGGTTAAAGGTAA-3' (SEQ ID NO: 1075)

5'-AGAGAAGCUUUGGUUAAAGGUAAUCCA-3' (SEQ ID NO: 2228)

3'-UCUCUUCGAAACCAAUUUCCAUUAGGU-5' (SEQ ID NO: 692)

C5-3696 Target:
5'-AGAGAAGCTTTGGTTAAAGGTAATCCA-3' (SEQ ID NO: 1076)

5'-GAGAAGCUUUGGUUAAAGGUAAUCCAC-3' (SEQ ID NO: 2229)

3'-CUCUUCGAAACCAAUUUCCAUUAGGUG-5' (SEQ ID NO: 693)

C5-3697 Target:
5'-GAGAAGCTTTGGTTAAAGGTAATCCAC-3' (SEQ ID NO: 1077)

5'-ACCCAUUUAUCGUUUUUGGAAAGACAA-3' (SEQ ID NO: 2230)

3'-UGGGUAAAUAGCAAAAACCUUUCUGUU-5' (SEQ ID NO: 694)

C5-3722 Target:
5'-ACCCATTTATCGTTTTTGGAAAGACAA-3' (SEQ ID NO: 1078)

5'-AUGCUUUACUCACCAGUCUGAACUUGA-3' (SEQ ID NO: 2231)

3'-UACGAAAUGAGUGGUCAGACUUGAACU-5' (SEQ ID NO: 695)

C5-3814 Target:
5'-ATGCTTTACTCACCAGTCTGAACTTGA-3' (SEQ ID NO: 1079)

5'-UGCUUUACUCACCAGUCUGAACUUGAA-3' (SEQ ID NO: 2232)

3'-ACGAAAUGAGUGGUCAGACUUGAACUU-5' (SEQ ID NO: 696)

C5-3815 Target:
5'-TGCTTTACTCACCAGTCTGAACTTGAA-3' (SEQ ID NO: 1080)

5'-UACUCACCAGUCUGAACUUGAAAGAUA-3' (SEQ ID NO: 2233)

3'-AUGAGUGGUCAGACUUGAACUUUCUAU-5' (SEQ ID NO: 697)

C5-3820 Target:
5'-TACTCACCAGTCTGAACTTGAAAGATA-3' (SEQ ID NO: 1081)

5'-CACCAGUCUGAACUUGAAAGAUAUAAA-3' (SEQ ID NO: 2234)

3'-GUGGUCAGACUUGAACUUUCUAUAUUU-5' (SEQ ID NO: 698)

C5-3824 Target:
5'-CACCAGTCTGAACTTGAAAGATATAAA-3' (SEQ ID NO: 1082)

5'-CAGAAGAGCAGAGGUAUGGAGGUGGCU-3' (SEQ ID NO: 2235)

3'-GUCUUCUCGUCUCCAUACCUCCACCGA-5' (SEQ ID NO: 699)

C5-3880 Target:
5'-CAGAAGAGCAGAGGTATGGAGGTGGCT-3' (SEQ ID NO: 1083)

5'-AGAAGAGCAGAGGUAUGGAGGUGGCUU-3' (SEQ ID NO: 2236)

3'-UCUUCUCGUCUCCAUACCUCCACCGAA-5' (SEQ ID NO: 700)

C5-3881 Target:
5'-AGAAGAGCAGAGGTATGGAGGTGGCTT-3' (SEQ ID NO: 1084)

5'-CGGAAUAUUCACUCCUGGUUAAACAAC-3' (SEQ ID NO: 2237)

3'-GCCUUAUAAGUGAGGACCAAUUUGUUG-5' (SEQ ID NO: 701)

C5-3949 Target:
5'-CGGAATATTCACTCCTGGTTAAACAAC-3' (SEQ ID NO: 1085)

5'-UGCCUUACAUAAUUAUAAAAUGACAGA-3' (SEQ ID NO: 2238)

3'-ACGGAAUGUAUUAAUAUUUUACUGUCU-5' (SEQ ID NO: 702)

C5-4019 Target:
5'-TGCCTTACATAATTATAAAATGACAGA-3' (SEQ ID NO: 1086)

5'-UACAUGUAACAACUGUAGUUCACAAAA-3' (SEQ ID NO: 2239)

3'-AUGUACAUUGUUGACAUCAAGUGUUUU-5' (SEQ ID NO: 703)

C5-4132 Target:
5'-TACATGTAACAACTGTAGTTCACAAAA-3' (SEQ ID NO: 1087)

5'-CUGAGGAAGUUUGCAGCUUUUAUUGA-3' (SEQ ID NO: 2240)

3'-GACUCCUUCAAACGUCGAAAAUAAACU-5' (SEQ ID NO: 704)

C5-4168 Target:
5'-CTGAGGAAGTTTGCAGCTTTTATTTGA-3' (SEQ ID NO: 1088)

5'-UGAGGAAGUUUGCAGCUUUUAUUGAA-3' (SEQ ID NO: 2241)

3'-ACUCCUUCAAACGUCGAAAAUAAACUU-5' (SEQ ID NO: 705)

Table 5-continued
Selected Human Anti-C5 "Blunt/Blunt" DsiRNAs

C5-4169 Target:
5'-TGAGGAAGTTTGCAGCTTTTATTTGAA-3' (SEQ ID NO: 1089)

5'-GAGGAAGUUUGCAGCUUUUAUUUGAAA-3' (SEQ ID NO: 2242)

3'-CUCCUUCAAACGUCGAAAAUAAACUUU-5' (SEQ ID NO: 706)

C5-4170 Target:
5'-GAGGAAGTTTGCAGCTTTTATTTGAAA-3' (SEQ ID NO: 1090)

5'-AGGAAGUUUGCAGCUUUUAUUUGAAAA-3' (SEQ ID NO: 2243)

3'-UCCUUCAAACGUCGAAAAUAAACUUUU-5' (SEQ ID NO: 707)

C5-4171 Target:
5'-AGGAAGTTTGCAGCTTTTATTTGAAAA-3' (SEQ ID NO: 1091)

5'-GGAAGUUUGCAGCUUUUAUUUGAAAAU-3' (SEQ ID NO: 2244)

3'-CCUUCAAACGUCGAAAAUAAACUUUUA-5' (SEQ ID NO: 708)

C5-4172 Target:
5'-GGAAGTTTGCAGCTTTTATTTGAAAAT-3' (SEQ ID NO: 1092)

5'-GAAGUUUGCAGCUUUUAUUUGAAAAUC-3' (SEQ ID NO: 2245)

3'-CUUCAAACGUCGAAAAUAAACUUUUAG-5' (SEQ ID NO: 709)

C5-4173 Target:
5'-GAAGTTTGCAGCTTTTATTTGAAAATC-3' (SEQ ID NO: 1093)

5'-AAGUUUGCAGCUUUUAUUUGAAAAUCG-3' (SEQ ID NO: 2246)

3'-UUCAAACGUCGAAAAUAAACUUUUAGC-5' (SEQ ID NO: 710)

C5-4174 Target:
5'-AAGTTTGCAGCTTTTATTTGAAAATCG-3' (SEQ ID NO: 1094)

5'-AGUUUGCAGCUUUUAUUUGAAAAUCGA-3' (SEQ ID NO: 2247)

3'-UCAAACGUCGAAAAUAAACUUUUAGCU-5' (SEQ ID NO: 711)

C5-4175 Target:
5'-AGTTTGCAGCTTTTATTTGAAAATCGA-3' (SEQ ID NO: 1095)

5'-UUGCAGCUUUUAUUUGAAAAUCGAUAC-3' (SEQ ID NO: 2248)

3'-AACGUCGAAAAUAAACUUUUAGCUAUG-5' (SEQ ID NO: 712)

C5-4178 Target:
5'-TTGCAGCTTTTATTTGAAAATCGATAC-3' (SEQ ID NO: 1096)

5'-CGAUACUCAGGAUAUUGAAGCAUCCCA-3' (SEQ ID NO: 2249)

3'-GCUAUGAGUCCUAUAACUUCGUAGGGU-5' (SEQ ID NO: 713)

C5-4199 Target:
5'-CGATACTCAGGATATTGAAGCATCCCA-3' (SEQ ID NO: 1097)

5'-CUCAGGAUAUUGAAGCAUCCCACUACA-3' (SEQ ID NO: 2250)

3'-GAGUCCUAUAACUUCGUAGGGUGAUGU-5' (SEQ ID NO: 714)

C5-4204 Target:
5'-CTCAGGATATTGAAGCATCCCACTACA-3' (SEQ ID NO: 1098)

5'-AGUAGCAUGUGCCAGCUACAAGCCCAG-3' (SEQ ID NO: 2251)

3'-UCAUCGUACACGGUCGAUGUUCGGGUC-5' (SEQ ID NO: 715)

C5-4262 Target:
5'-AGTAGCATGTGCCAGCTACAAGCCCAG-3' (SEQ ID NO: 1099)

5'-GUAGCAUGUGCCAGCUACAAGCCCAGC-3' (SEQ ID NO: 2252)

3'-CAUCGUACACGGUCGAUGUUCGGGUCG-5' (SEQ ID NO: 716)

C5-4263 Target:
5'-GTAGCATGTGCCAGCTACAAGCCCAGC-3' (SEQ ID NO: 1100)

5'-UAGCAUGUGCCAGCUACAAGCCCAGCA-3' (SEQ ID NO: 2253)

3'-AUCGUACACGGUCGAUGUUCGGGUCGU-5' (SEQ ID NO: 717)

C5-4264 Target:
5'-TAGCATGTGCCAGCTACAAGCCCAGCA-3' (SEQ ID NO: 1101)

5'-AGCAUGUGCCAGCUACAAGCCCAGCAG-3' (SEQ ID NO: 2254)

3'-UCGUACACGGUCGAUGUUCGGGUCGUC-5' (SEQ ID NO: 718)

C5-4265 Target:
5'-AGCATGTGCCAGCTACAAGCCCAGCAG-3' (SEQ ID NO: 1102)

5'-GCAUGUGCCAGCUACAAGCCCAGCAGG-3' (SEQ ID NO: 2255)

3'-CGUACACGGUCGAUGUUCGGGUCGUCC-5' (SEQ ID NO: 719)

C5-4266 Target:
5'-GCATGTGCCAGCTACAAGCCCAGCAGG-3' (SEQ ID NO: 1103)

5'-CAUGUGCCAGCUACAAGCCCAGCAGGG-3' (SEQ ID NO: 2256)

3'-GUACACGGUCGAUGUUCGGGUCGUCCC-5' (SEQ ID NO: 720)

C5-4267 Target:
5'-CATGTGCCAGCTACAAGCCCAGCAGGG-3' (SEQ ID NO: 1104)

5'-AUGUGCCAGCUACAAGCCCAGCAGGGA-3' (SEQ ID NO: 2257)

3'-UACACGGUCGAUGUUCGGGUCGUCCCU-5' (SEQ ID NO: 721)

C5-4268 Target:
5'-ATGTGCCAGCTACAAGCCCAGCAGGGA-3' (SEQ ID NO: 1105)

5'-UGUGCCAGCUACAAGCCCAGCAGGGAA-3' (SEQ ID NO: 2258)

3'-ACACGGUCGAUGUUCGGGUCGUCCCUU-5' (SEQ ID NO: 722)

C5-4269 Target:
5'-TGTGCCAGCTACAAGCCCAGCAGGGAA-3' (SEQ ID NO: 1106)

5'-GUGCCAGCUACAAGCCCAGCAGGGAAG-3' (SEQ ID NO: 2259)

3'-CACGGUCGAUGUUCGGGUCGUCCCUUC-5' (SEQ ID NO: 723)

C5-4270 Target:
5'-GTGCCAGCTACAAGCCCAGCAGGGAAG-3' (SEQ ID NO: 1107)

5'-AAGAUGGACAUGUUAUUCUGCAACUGA-3' (SEQ ID NO: 2260)

3'-UUCUACCUGUACAAUAAGACGUUGACU-5' (SEQ ID NO: 724)

C5-4423 Target:
5'-AAGATGGACATGTTATTCTGCAACTGA-3' (SEQ ID NO: 1108)

5'-AGAUGGACAUGUUAUUCUGCAACUGAA-3' (SEQ ID NO: 2261)

3'-UCUACCUGUACAAUAAGACGUUGACUU-5' (SEQ ID NO: 725)

C5-4424 Target:
5'-AGATGGACATGTTATTCTGCAACTGAA-3' (SEQ ID NO: 1109)

5'-AUGGACAUGUUAUUCUGCAACUGAAUU-3' (SEQ ID NO: 2262)

3'-UACCUGUACAAUAAGACGUUGACUUAA-5' (SEQ ID NO: 726)

C5-4426 Target:
5'-ATGGACATGTTATTCTGCAACTGAATT-3' (SEQ ID NO: 1110)

5'-GGACAUGUUAUUCUGCAACUGAAUUCG-3' (SEQ ID NO: 2263)

3'-CCUGUACAAUAAGACGUUGACUUAAGC-5' (SEQ ID NO: 727)

TABLE 5-continued

Selected Human Anti-C5 "Blunt/Blunt" DsiRNAs

C5-4428 Target:
5'-GGACATGTTATTCTGCAACTGAATTCG-3' (SEQ ID NO: 1111)

5'-GACAUGUUAUUCUGCAACUGAAUUCGA-3' (SEQ ID NO: 2264)

3'-CUGUACAAUAAGACGUUGACUUAAGCU-5' (SEQ ID NO: 728)

C5-4429 Target:
5'-GACATGTTATTCTGCAACTGAATTCGA-3' (SEQ ID NO: 1112)

5'-ACAUGUUAUUCUGCAACUGAAUUCGAU-3' (SEQ ID NO: 2265)

3'-UGUACAAUAAGACGUUGACUUAAGCUA-5' (SEQ ID NO: 729)

C5-4430 Target:
5'-ACATGTTATTCTGCAACTGAATTCGAT-3' (SEQ ID NO: 1113)

5'-UUAUUCUGCAACUGAAUUCGAUUCCCU-3' (SEQ ID NO: 2266)

3'-AAUAAGACGUUGACUUAAGCUAAGGGA-5' (SEQ ID NO: 730)

C5-4435 Target:
5'-TTATTCTGCAACTGAATTCGATTCCCT-3' (SEQ ID NO: 1114)

5'-UAUUCUGCAACUGAAUUCGAUUCCCUC-3' (SEQ ID NO: 2267)

3'-AUAAGACGUUGACUUAAGCUAAGGGAG-5' (SEQ ID NO: 731)

C5-4436 Target:
5'-TATTCTGCAACTGAATTCGATTCCCTC-3' (SEQ ID NO: 1115)

5'-CAGAUAAACAGUGUACCAUGUUUUAUA-3' (SEQ ID NO: 2268)

3'-GUCUAUUUGUCACAUGGUACAAAAUAU-5' (SEQ ID NO: 732)

C5-4558 Target:
5'-CAGATAAACAGTGTACCATGTTTTATA-3' (SEQ ID NO: 1116)

5'-AGAUAAACAGUGUACCAUGUUUUAUAG-3' (SEQ ID NO: 2269)

3'-UCUAUUUGUCACAUGGUACAAAAUAUC-5' (SEQ ID NO: 733)

C5-4559 Target:
5'-AGATAAACAGTGTACCATGTTTTATAG-3' (SEQ ID NO: 1117)

5'-AUAAACAGUGUACCAUGUUUUAUAGCA-3' (SEQ ID NO: 2270)

3'-UAUUUGUCACAUGGUACAAAAUAUCGU-5' (SEQ ID NO: 734)

C5-4561 Target:
5'-ATAAACAGTGTACCATGTTTTATAGCA-3' (SEQ ID NO: 1118)

5'-AAACAGUGUACCAUGUUUUAUAGCACU-3' (SEQ ID NO: 2271)

3'-UUUGUCACAUGGUACAAAAUAUCGUGA-5' (SEQ ID NO: 735)

C5-4563 Target:
5'-AAACAGTGTACCATGTTTTATAGCACT-3' (SEQ ID NO: 1119)

5'-UUAUAGCACUUCCAAUAUCAAAAUUCA-3' (SEQ ID NO: 2272)

3'-AAUAUCGUGAAGGUUAUAGUUUUAAGU-5' (SEQ ID NO: 736)

C5-4580 Target:
5'-TTATAGCACTTCCAATATCAAAATTCA-3' (SEQ ID NO: 1120)

5'-AAUUCAGAAAGUCUGUGAAGGAGCCGC-3' (SEQ ID NO: 2273)

3'-UUAAGUCUUUCAGACACUUCCUCGGCG-5' (SEQ ID NO: 737)

C5-4601 Target:
5'-AATTCAGAAAGTCTGTGAAGGAGCCGC-3' (SEQ ID NO: 1121)

5'-AUUCAGAAAGUCUGUGAAGGAGCCGCG-3' (SEQ ID NO: 2274)

3'-UAAGUCUUUCAGACACUUCCUCGGCGC-5' (SEQ ID NO: 738)

C5-4602 Target:
5'-ATTCAGAAAGTCTGTGAAGGAGCCGCG-3' (SEQ ID NO: 1122)

5'-UUCAGAAAGUCUGUGAAGGAGCCGCGU-3' (SEQ ID NO: 2275)

3'-AAGUCUUUCAGACACUUCCUCGGCGCA-5' (SEQ ID NO: 739)

C5-4603 Target:
5'-TTCAGAAAGTCTGTGAAGGAGCCGCGT-3' (SEQ ID NO: 1123)

5'-UCAGAAAGUCUGUGAAGGAGCCGCGUG-3' (SEQ ID NO: 2276)

3'-AGUCUUUCAGACACUUCCUCGGCGCAC-5' (SEQ ID NO: 740)

C5-4604 Target:
5'-TCAGAAAGTCTGTGAAGGAGCCGCGTG-3' (SEQ ID NO: 1124)

5'-AACCAGAGAUUGCAUAUGCUUAUAAAG-3' (SEQ ID NO: 2277)

3'-UUGGUCUCUAACGUAUACGAAUAUUUC-5' (SEQ ID NO: 741)

C5-4717 Target:
5'-AACCAGAGATTGCATATGCTTATAAAG-3' (SEQ ID NO: 1125)

5'-ACCAGAGAUUGCAUAUGCUUAUAAAGU-3' (SEQ ID NO: 2278)

3'-UGGUCUCUAACGUAUACGAAUAUUUCA-5' (SEQ ID NO: 742)

C5-4718 Target:
5'-ACCAGAGATTGCATATGCTTATAAAGT-3' (SEQ ID NO: 1126)

5'-CCAGAGAUUGCAUAUGCUUAUAAAGUU-3' (SEQ ID NO: 2279)

3'-GGUCUCUAACGUAUACGAAUAUUUCAA-5' (SEQ ID NO: 743)

C5-4719 Target:
5'-CCAGAGATTGCATATGCTTATAAAGTT-3' (SEQ ID NO: 1127)

5'-CAGAGAUUGCAUAUGCUUAUAAAGUUA-3' (SEQ ID NO: 2280)

3'-GUCUCUAACGUAUACGAAUAUUUCAAU-5' (SEQ ID NO: 744)

C5-4720 Target:
5'-CAGAGATTGCATATGCTTATAAAGTTA-3' (SEQ ID NO: 1128)

5'-AGAGAUUGCAUAUGCUUAUAAAGUUAG-3' (SEQ ID NO: 2281)

3'-UCUCUAACGUAUACGAAUAUUUCAAUC-5' (SEQ ID NO: 745)

C5-4721 Target:
5'-AGAGATTGCATATGCTTATAAAGTTAG-3' (SEQ ID NO: 1129)

5'-GUAGAAAAUGUUUUUGUCAAGUACAAG-3' (SEQ ID NO: 2282)

3'-CAUCUUUUACAAAAACAGUUCAUGUUC-5' (SEQ ID NO: 746)

C5-4764 Target:
5'-GTAGAAAATGTTTTTGTCAAGTACAAG-3' (SEQ ID NO: 1130)

5'-UAGAAAAUGUUUUUGUCAAGUACAAGG-3' (SEQ ID NO: 2283)

3'-AUCUUUUACAAAAACAGUUCAUGUUCC-5' (SEQ ID NO: 747)

C5-4765 Target:
5'-TAGAAAATGTTTTTGTCAAGTACAAGG-3' (SEQ ID NO: 1131)

5'-AGAAAAUGUUUUUGUCAAGUACAAGGC-3' (SEQ ID NO: 2284)

3'-UCUUUUACAAAAACAGUUCAUGUUCCG-5' (SEQ ID NO: 748)

C5-4766 Target:
5'-AGAAAATGTTTTTGTCAAGTACAAGGC-3' (SEQ ID NO: 1132)

5'-GAAAAUGUUUUUGUCAAGUACAAGGCA-3' (SEQ ID NO: 2285)

3'-CUUUUACAAAAACAGUUCAUGUUCCGU-5' (SEQ ID NO: 749)

Table 5-continued

Selected Human Anti-C5 "Blunt/Blunt" DsiRNAs

C5-4767 Target:
5'-GAAAATGTTTTTGTCAAGTACAAGGCA-3' (SEQ ID NO: 1133)

5'-AAAAUGUUUUUGUCAAGUACAAGGCAA-3' (SEQ ID NO: 2286)

3'-UUUUACAAAAACAGUUCAUGUUCCGUU-5' (SEQ ID NO: 750)

C5-4768 Target:
5'-AAAATGTTTTTGTCAAGTACAAGGCAA-3' (SEQ ID NO: 1134)

5'-CUCCAGAUAAAAUACAAUUUCAGUUUC-3' (SEQ ID NO: 2287)

3'-GAGGUCUAUUUUAUGUUAAAGUCAAAG-5' (SEQ ID NO: 751)

C5-4929 Target:
5'-CTCCAGATAAAATACAATTTCAGTTTC-3' (SEQ ID NO: 1135)

5'-ACAUGUUCAUCGUGUCAAGCAUUUUUA-3' (SEQ ID NO: 2288)

3'-UGUACAAGUAGCACAGUUCGUAAAAAU-5' (SEQ ID NO: 752)

C5-5013 Target:
5'-ACATGTTCATCGTGTCAAGCATTTTTA-3' (SEQ ID NO: 1136)

5'-UUCAUCGUGUCAAGCAUUUUUAGCUAA-3' (SEQ ID NO: 2289)

3'-AAGUAGCACAGUUCGUAAAAAUCGAUU-5' (SEQ ID NO: 753)

C5-5018 Target:
5'-TTCATCGTGTCAAGCATTTTTAGCTAA-3' (SEQ ID NO: 1137)

5'-UCGUGUCAAGCAUUUUUAGCUAAUUUA-3' (SEQ ID NO: 2290)

3'-AGCACAGUUCGUAAAAAUCGAUUAAAU-5' (SEQ ID NO: 754)

C5-5022 Target:
5'-TCGTGTCAAGCATTTTTAGCTAATTTA-3' (SEQ ID NO: 1138)

5'-UCAAGCAUUUUUAGCUAAUUUAGAUGA-3' (SEQ ID NO: 2291)

3'-AGUUCGUAAAAAUCGAUUAAAUCUACU-5' (SEQ ID NO: 755)

C5-5027 Target:
5'-TCAAGCATTTTTAGCTAATTTAGATGA-3' (SEQ ID NO: 1139)

5'-AAUGGAUGCUAAAAUUCCUGAAGUUCA-3' (SEQ ID NO: 2292)

3'-UUACCUACGAUUUUAAGGACUUCAAGU-5' (SEQ ID NO: 756)

C5-5076 Target:
5'-AATGGATGCTAAAATTCCTGAAGTTCA-3' (SEQ ID NO: 1140)

5'-UUAUGGACUCCUGUUGUUGAAGUUCGU-3' (SEQ ID NO: 2293)

3'-AAUACCUGAGGACAACAACUUCAAGCA-5' (SEQ ID NO: 757)

C5-5121 Target:
5'-TTATGGACTCCTGTTGTTGAAGTTCGT-3' (SEQ ID NO: 1141)

5'-AUGGACUCCUGUUGUUGAAGUUCGUUU-3' (SEQ ID NO: 2294)

3'-UACCUGAGGACAACAACUUCAAGCAAA-5' (SEQ ID NO: 758)

C5-5123 Target:
5'-ATGGACTCCTGTTGTTGAAGTTCGTTT-3' (SEQ ID NO: 1142)

5'-UGGACUCCUGUUGUUGAAGUUCGUUUU-3' (SEQ ID NO: 2295)

3'-ACCUGAGGACAACAACUUCAAGCAAAA-5' (SEQ ID NO: 759)

C5-5124 Target:
5'-TGGACTCCTGTTGTTGAAGTTCGTTTT-3' (SEQ ID NO: 1143)

5'-ACUUGCUUUUAUUAGAGAAUGAUUUCA-3' (SEQ ID NO: 2296)

3'-UGAACGAAAAUAAUCUCUUACUAAAGU-5' (SEQ ID NO: 760)

Table 5-continued

Selected Human Anti-C5 "Blunt/Blunt" DsiRNAs

C5-5224 Target:
5'-ACTTGCTTTTATTAGAGAATGATTTCA-3' (SEQ ID NO: 1144)

5'-CUUGCUUUUAUUAGAGAAUGAUUUCAA-3' (SEQ ID NO: 2297)

3'-GAACGAAAAUAAUCUCUUACUAAAGUU-5' (SEQ ID NO: 761)

C5-5225 Target:
5'-CTTGCTTTTATTAGAGAATGATTTCAA-3' (SEQ ID NO: 1145)

5'-UUGCUUUUAUUAGAGAAUGAUUUCAAA-3' (SEQ ID NO: 2298)

3'-AACGAAAAUAAUCUCUUACUAAAGUUU-5' (SEQ ID NO: 762)

C5-5226 Target:
5'-TTGCTTTTATTAGAGAATGATTTCAAA-3' (SEQ ID NO: 1146)

5'-UGCUUUUAUUAGAGAAUGAUUUCAAAU-3' (SEQ ID NO: 2299)

3'-ACGAAAAUAAUCUCUUACUAAAGUUUA-5' (SEQ ID NO: 763)

C5-5227 Target:
5'-TGCTTTTATTAGAGAATGATTTCAAAT-3' (SEQ ID NO: 1147)

5'-GACAGAUACUCCUCCAAGGUUAUUGGA-3' (SEQ ID NO: 2300)

3'-CUGUCUAUGAGGAGGUUCCAAUAACCU-5' (SEQ ID NO: 764)

C5-5295 Target:
5'-GACAGATACTCCTCCAAGGTTATTGGA-3' (SEQ ID NO: 1148)

5'-AUCAUUAAAGCCUGAGUUUGCUUUCAA-3' (SEQ ID NO: 2301)

3'-UAGUAAUUUCGGACUCAAACGAAAGUU-5' (SEQ ID NO: 765)

C5-5464 Target:
5'-ATCATTAAAGCCTGAGTTTGCTTTCAA-3' (SEQ ID NO: 1149)

5'-UCAUUAAAGCCUGAGUUUGCUUUCAAA-3' (SEQ ID NO: 2302)

3'-AGUAAUUUCGGACUCAAACGAAAGUUU-5' (SEQ ID NO: 766)

C5-5465 Target:
5'-TCATTAAAGCCTGAGTTTGCTTTCAAA-3' (SEQ ID NO: 1150)

5'-UUAAAGCCUGAGUUUGCUUUCAAAAAA-3' (SEQ ID NO: 2303)

3'-AAUUUCGGACUCAAACGAAAGUUUUUU-5' (SEQ ID NO: 767)

C5-5468 Target:
5'-TTAAAGCCTGAGTTTGCTTTCAAAAAA-3' (SEQ ID NO: 1151)

5'-UAAAGCCUGAGUUUGCUUUCAAAAAAA-3' (SEQ ID NO: 2304)

3'-AUUUCGGACUCAAACGAAAGUUUUUUU-5' (SEQ ID NO: 768)

C5-5469 Target:
5'-TAAAGCCTGAGTTTGCTTTCAAAAAAA-3' (SEQ ID NO: 1152)

TABLE 6

DsiRNA Component 19 Nucleotide Target Sequences in C5 mRNA

C5-120 19 nt Target #1:
5'-AUAUGUCAUUUCAGCACCA-3' (SEQ ID NO: 2305)

C5-120 19 nt Target #2:
5'-CAUAUGUCAUUUCAGCACC-3' (SEQ ID NO: 2689)

C5-120 19 nt Target #3:
5'-ACAUAUGUCAUUUCAGCAC-3' (SEQ ID NO: 3073)

TABLE 6-continued

DsiRNA Component 19 Nucleotide Target Sequences in C5 mRNA

C5-169 19 nt Target #1:
5'-AUUGUGAUUCAAGUUUAUG-3' (SEQ ID NO: 2306)

C5-169 19 nt Target #2:
5'-UAUUGUGAUUCAAGUUUAU-3' (SEQ ID NO: 2690)

C5-169 19 nt Target #3:
5'-AUAUUGUGAUUCAAGUUUA-3' (SEQ ID NO: 3074)

C5-170 19 nt Target #1:
5'-UUGUGAUUCAAGUUUAUGG-3' (SEQ ID NO: 2307)

C5-170 19 nt Target #2:
5'-AUUGUGAUUCAAGUUUAUG-3' (SEQ ID NO: 2691)

C5-170 19 nt Target #3:
5'-UAUUGUGAUUCAAGUUUAU-3' (SEQ ID NO: 3075)

C5-171 19 nt Target #1:
5'-UGUGAUUCAAGUUUAUGGA-3' (SEQ ID NO: 2308)

C5-171 19 nt Target #2:
5'-UUGUGAUUCAAGUUUAUGG-3' (SEQ ID NO: 2692)

C5-171 19 nt Target #3:
5'-AUUGUGAUUCAAGUUUAUG-3' (SEQ ID NO: 3076)

C5-172 19 nt Target #1:
5'-GUGAUUCAAGUUUAUGGAU-3' (SEQ ID NO: 2309)

C5-172 19 nt Target #2:
5'-UGUGAUUCAAGUUUAUGGA-3' (SEQ ID NO: 2693)

C5-172 19 nt Target #3:
5'-UUGUGAUUCAAGUUUAUGG-3' (SEQ ID NO: 3077)

C5-173 19 nt Target #1:
5'-UGAUUCAAGUUUAUGGAUA-3' (SEQ ID NO: 2310)

C5-173 19 nt Target #2:
5'-GUGAUUCAAGUUUAUGGAU-3' (SEQ ID NO: 2694)

C5-173 19 nt Target #3:
5'-UGUGAUUCAAGUUUAUGGA-3' (SEQ ID NO: 3078)

C5-174 19 nt Target #1:
5'-GAUUCAAGUUUAUGGAUAC-3' (SEQ ID NO: 2311)

C5-174 19 nt Target #2:
5'-UGAUUCAAGUUUAUGGAUA-3' (SEQ ID NO: 2695)

C5-174 19 nt Target #3:
5'-GUGAUUCAAGUUUAUGGAU-3' (SEQ ID NO: 3079)

C5-175 19 nt Target #1:
5'-AUUCAAGUUUAUGGAUACA-3' (SEQ ID NO: 2312)

C5-175 19 nt Target #2:
5'-GAUUCAAGUUUAUGGAUAC-3' (SEQ ID NO: 2696)

C5-175 19 nt Target #3:
5'-UGAUUCAAGUUUAUGGAUA-3' (SEQ ID NO: 3080)

C5-176 19 nt Target #1:
5'-UUCAAGUUUAUGGAUACAC-3' (SEQ ID NO: 2313)

C5-176 19 nt Target #2:
5'-AUUCAAGUUUAUGGAUACA-3' (SEQ ID NO: 2697)

C5-176 19 nt Target #3:
5'-GAUUCAAGUUUAUGGAUAC-3' (SEQ ID NO: 3081)

C5-177 19 nt Target #1:
5'-UCAAGUUUAUGGAUACACU-3' (SEQ ID NO: 2314)

C5-177 19 nt Target #2:
5'-UUCAAGUUUAUGGAUACAC-3' (SEQ ID NO: 2698)

C5-177 19 nt Target #3:
5'-AUUCAAGUUUAUGGAUACA-3' (SEQ ID NO: 3082)

C5-178 19 nt Target #1:
5'-CAAGUUUAUGGAUACACUG-3' (SEQ ID NO: 2315)

C5-178 19 nt Target #2:
5'-UCAAGUUUAUGGAUACACU-3' (SEQ ID NO: 2699)

C5-178 19 nt Target #3:
5'-UUCAAGUUUAUGGAUACAC-3' (SEQ ID NO: 3083)

C5-179 19 nt Target #1:
5'-AAGUUUAUGGAUACACUGA-3' (SEQ ID NO: 2316)

C5-179 19 nt Target #2:
5'-CAAGUUUAUGGAUACACUG-3' (SEQ ID NO: 2700)

C5-179 19 nt Target #3:
5'-UCAAGUUUAUGGAUACACU-3' (SEQ ID NO: 3084)

C5-180 19 nt Target #1:
5'-AGUUUAUGGAUACACUGAA-3' (SEQ ID NO: 2317)

C5-180 19 nt Target #2:
5'-AAGUUUAUGGAUACACUGA-3' (SEQ ID NO: 2701)

C5-180 19 nt Target #3:
5'-CAAGUUUAUGGAUACACUG-3' (SEQ ID NO: 3085)

C5-182 19 nt Target #1:
5'-UUUAUGGAUACACUGAAGC-3' (SEQ ID NO: 2318)

C5-182 19 nt Target #2:
5'-GUUUAUGGAUACACUGAAG-3' (SEQ ID NO: 2702)

C5-182 19 nt Target #3:
5'-AGUUUAUGGAUACACUGAA-3' (SEQ ID NO: 3086)

C5-183 19 nt Target #1:
5'-UUAUGGAUACACUGAAGCA-3' (SEQ ID NO: 2319)

C5-183 19 nt Target #2:
5'-UUUAUGGAUACACUGAAGC-3' (SEQ ID NO: 2703)

C5-183 19 nt Target #3:
5'-GUUUAUGGAUACACUGAAG-3' (SEQ ID NO: 3087)

C5-185 19 nt Target #1:
5'-AUGGAUACACUGAAGCAUU-3' (SEQ ID NO: 2320)

C5-185 19 nt Target #2:
5'-UAUGGAUACACUGAAGCAU-3' (SEQ ID NO: 2704)

C5-185 19 nt Target #3:
5'-UUAUGGAUACACUGAAGCA-3' (SEQ ID NO: 3088)

C5-187 19 nt Target #1:
5'-GGAUACACUGAAGCAUUUG-3' (SEQ ID NO: 2321)

C5-187 19 nt Target #2:
5'-UGGAUACACUGAAGCAUUU-3' (SEQ ID NO: 2705)

C5-187 19 nt Target #3:
5'-AUGGAUACACUGAAGCAUU-3' (SEQ ID NO: 3089)

C5-188 19 nt Target #1:
5'-GAUACACUGAAGCAUUUGA-3' (SEQ ID NO: 2322)

C5-188 19 nt Target #2:
5'-GGAUACACUGAAGCAUUUG-3' (SEQ ID NO: 2706)

C5-188 19 nt Target #3:
5'-UGGAUACACUGAAGCAUUU-3' (SEQ ID NO: 3090)

TABLE 6-continued

DsiRNA Component 19 Nucleotide Target Sequences in C5 mRNA

C5-189 19 nt Target #1:
5'-AUACACUGAAGCAUUUGAU-3' (SEQ ID NO: 2323)

C5-189 19 nt Target #2:
5'-GAUACACUGAAGCAUUUGA-3' (SEQ ID NO: 2707)

C5-189 19 nt Target #3:
5'-GGAUACACUGAAGCAUUUG-3' (SEQ ID NO: 3091)

C5-190 19 nt Target #1:
5'-UACACUGAAGCAUUUGAUG-3' (SEQ ID NO: 2324)

C5-190 19 nt Target #2:
5'-AUACACUGAAGCAUUUGAU-3' (SEQ ID NO: 2708)

C5-190 19 nt Target #3:
5'-GAUACACUGAAGCAUUUGA-3' (SEQ ID NO: 3092)

C5-191 19 nt Target #1:
5'-ACACUGAAGCAUUUGAUGC-3' (SEQ ID NO: 2325)

C5-191 19 nt Target #2:
5'-UACACUGAAGCAUUUGAUG-3' (SEQ ID NO: 2709)

C5-191 19 nt Target #3:
5'-AUACACUGAAGCAUUUGAU-3' (SEQ ID NO: 3093)

C5-192 19 nt Target #1:
5'-CACUGAAGCAUUUGAUGCA-3' (SEQ ID NO: 2326)

C5-192 19 nt Target #2:
5'-ACACUGAAGCAUUUGAUGC-3' (SEQ ID NO: 2710)

C5-192 19 nt Target #3:
5'-UACACUGAAGCAUUUGAUG-3' (SEQ ID NO: 3094)

C5-193 19 nt Target #1:
5'-ACUGAAGCAUUUGAUGCAA-3' (SEQ ID NO: 2327)

C5-193 19 nt Target #2:
5'-CACUGAAGCAUUUGAUGCA-3' (SEQ ID NO: 2711)

C5-193 19 nt Target #3:
5'-ACACUGAAGCAUUUGAUGC-3' (SEQ ID NO: 3095)

C5-194 19 nt Target #1:
5'-CUGAAGCAUUUGAUGCAAC-3' (SEQ ID NO: 2328)

C5-194 19 nt Target #2:
5'-ACUGAAGCAUUUGAUGCAA-3' (SEQ ID NO: 2712)

C5-194 19 nt Target #3:
5'-CACUGAAGCAUUUGAUGCA-3' (SEQ ID NO: 3096)

C5-196 19 nt Target #1:
5'-GAAGCAUUUGAUGCAACAA-3' (SEQ ID NO: 2329)

C5-196 19 nt Target #2:
5'-UGAAGCAUUUGAUGCAACA-3' (SEQ ID NO: 2713)

C5-196 19 nt Target #3:
5'-CUGAAGCAUUUGAUGCAAC-3' (SEQ ID NO: 3097)

C5-198 19 nt Target #1:
5'-AGCAUUUGAUGCAACAAUC-3' (SEQ ID NO: 2330)

C5-198 19 nt Target #2:
5'-AAGCAUUUGAUGCAACAAU-3' (SEQ ID NO: 2714)

C5-198 19 nt Target #3:
5'-GAAGCAUUUGAUGCAACAA-3' (SEQ ID NO: 3098)

C5-200 19 nt Target #1:
5'-CAUUUGAUGCAACAAUCUC-3' (SEQ ID NO: 2331)

C5-200 19 nt Target #2:
5'-GCAUUUGAUGCAACAAUCU-3' (SEQ ID NO: 2715)

C5-200 19 nt Target #3:
5'-AGCAUUUGAUGCAACAAUC-3' (SEQ ID NO: 3099)

C5-204 19 nt Target #1:
5'-UGAUGCAACAAUCUCUAUU-3' (SEQ ID NO: 2332)

C5-204 19 nt Target #2:
5'-UUGAUGCAACAAUCUCUAU-3' (SEQ ID NO: 2716)

C5-204 19 nt Target #3:
5'-UUUGAUGCAACAAUCUCUA-3' (SEQ ID NO: 3100)

C5-205 19 nt Target #1:
5'-GAUGCAACAAUCUCUAUUA-3' (SEQ ID NO: 2333)

C5-205 19 nt Target #2:
5'-UGAUGCAACAAUCUCUAUU-3' (SEQ ID NO: 2717)

C5-205 19 nt Target #3:
5'-UUGAUGCAACAAUCUCUAU-3' (SEQ ID NO: 3101)

C5-206 19 nt Target #1:
5'-AUGCAACAAUCUCUAUUAA-3' (SEQ ID NO: 2334)

C5-206 19 nt Target #2:
5'-GAUGCAACAAUCUCUAUUA-3' (SEQ ID NO: 2718)

C5-206 19 nt Target #3:
5'-UGAUGCAACAAUCUCUAUU-3' (SEQ ID NO: 3102)

C5-207 19 nt Target #1:
5'-UGCAACAAUCUCUAUUAAA-3' (SEQ ID NO: 2335)

C5-207 19 nt Target #2:
5'-AUGCAACAAUCUCUAUUAA-3' (SEQ ID NO: 2719)

C5-207 19 nt Target #3:
5'-GAUGCAACAAUCUCUAUUA-3' (SEQ ID NO: 3103)

C5-211 19 nt Target #1:
5'-ACAAUCUCUAUUAAAGUU-3' (SEQ ID NO: 2336)

C5-211 19 nt Target #2:
5'-AACAAUCUCUAUUAAAGU-3' (SEQ ID NO: 2720)

C5-211 19 nt Target #3:
5'-CAACAAUCUCUAUUAAAG-3' (SEQ ID NO: 3104)

C5-212 19 nt Target #1:
5'-CAAUCUCUAUUAAAGUUA-3' (SEQ ID NO: 2337)

C5-212 19 nt Target #2:
5'-ACAAUCUCUAUUAAAGUU-3' (SEQ ID NO: 2721)

C5-212 19 nt Target #3:
5'-AACAAUCUCUAUUAAAGU-3' (SEQ ID NO: 3105)

C5-218 19 nt Target #1:
5'-CUAUUAAAGUUAUCCUGA-3' (SEQ ID NO: 2338)

C5-218 19 nt Target #2:
5'-UCUAUUAAAGUUAUCCUG-3' (SEQ ID NO: 2722)

C5-218 19 nt Target #3:
5'-CUCUAUUAAAGUUAUCCU-3' (SEQ ID NO: 3106)

C5-220 19 nt Target #1:
5'-AUUAAAAGUUAUCCUGAUA-3' (SEQ ID NO: 2339)

C5-220 19 nt Target #2:
5'-UAUUAAAGUUAUCCUGAU-3' (SEQ ID NO: 2723)

C5-220 19 nt Target #3:
5'-CUAUUAAAAGUUAUCCUGA-3' (SEQ ID NO: 3107)

TABLE 6-continued

DsiRNA Component 19 Nucleotide
Target Sequences in C5 mRNA

C5-223 19 nt Target #1:
5'-AAAAGUUAUCCUGAUAAAA-3' (SEQ ID NO: 2340)

C5-223 19 nt Target #2:
5'-UAAAAGUUAUCCUGAUAAA-3' (SEQ ID NO: 2724)

C5-223 19 nt Target #3:
5'-UUAAAAGUUAUCCUGAUAA-3' (SEQ ID NO: 3108)

C5-224 19 nt Target #1:
5'-AAAGUUAUCCUGAUAAAAA-3' (SEQ ID NO: 2341)

C5-224 19 nt Target #2:
5'-AAAAGUUAUCCUGAUAAAA-3' (SEQ ID NO: 2725)

C5-224 19 nt Target #3:
5'-UAAAAGUUAUCCUGAUAAA-3' (SEQ ID NO: 3109)

C5-227 19 nt Target #1:
5'-GUUAUCCUGAUAAAAAUU-3' (SEQ ID NO: 2342)

C5-227 19 nt Target #2:
5'-AGUUAUCCUGAUAAAAAU-3' (SEQ ID NO: 2726)

C5-227 19 nt Target #3:
5'-AAGUUAUCCUGAUAAAAAA-3' (SEQ ID NO: 3110)

C5-228 19 nt Target #1:
5'-UUAUCCUGAUAAAAAUUU-3' (SEQ ID NO: 2343)

C5-228 19 nt Target #2:
5'-GUUAUCCUGAUAAAAAUU-3' (SEQ ID NO: 2727)

C5-228 19 nt Target #3:
5'-AGUUAUCCUGAUAAAAAU-3' (SEQ ID NO: 3111)

C5-265 19 nt Target #1:
5'-GUUCAUUUAUCCUCAGAGA-3' (SEQ ID NO: 2344)

C5-265 19 nt Target #2:
5'-UGUUCAUUUAUCCUCAGAG-3' (SEQ ID NO: 2728)

C5-265 19 nt Target #3:
5'-AUGUUCAUUUAUCCUCAGA-3' (SEQ ID NO: 3112)

C5-266 19 nt Target #1:
5'-UUCAUUUAUCCUCAGAGAA-3' (SEQ ID NO: 2345)

C5-266 19 nt Target #2:
5'-GUUCAUUUAUCCUCAGAGA-3' (SEQ ID NO: 2729)

C5-266 19 nt Target #3:
5'-UGUUCAUUUAUCCUCAGAG-3' (SEQ ID NO: 3113)

C5-360 19 nt Target #1:
5'-GUAUUUGGAAGUUGUAUCA-3' (SEQ ID NO: 2346)

C5-360 19 nt Target #2:
5'-UGUAUUUGGAAGUUGUAUC-3' (SEQ ID NO: 2730)

C5-360 19 nt Target #3:
5'-GUGUAUUUGGAAGUUGUAU-3' (SEQ ID NO: 3114)

C5-361 19 nt Target #1:
5'-UAUUUGGAAGUUGUAUCAA-3' (SEQ ID NO: 2347)

C5-361 19 nt Target #2:
5'-GUAUUUGGAAGUUGUAUCA-3' (SEQ ID NO: 2731)

C5-361 19 nt Target #3:
5'-UGUAUUUGGAAGUUGUAUC-3' (SEQ ID NO: 3115)

C5-364 19 nt Target #1:
5'-UUGGAAGUUGUAUCAAAGC-3' (SEQ ID NO: 2348)

C5-364 19 nt Target #2:
5'-UUUGGAAGUUGUAUCAAAG-3' (SEQ ID NO: 2732)

TABLE 6-continued

DsiRNA Component 19 Nucleotide
Target Sequences in C5 mRNA

C5-364 19 nt Target #3:
5'-AUUUGGAAGUUGUAUCAA-3' (SEQ ID NO: 3116)

C5-365 19 nt Target #1:
5'-UGGAAGUUGUAUCAAAGCA-3' (SEQ ID NO: 2349)

C5-365 19 nt Target #2:
5'-UUGGAAGUUGUAUCAAAGC-3' (SEQ ID NO: 2733)

C5-365 19 nt Target #3:
5'-UUUGGAAGUUGUAUCAAAG-3' (SEQ ID NO: 3117)

C5-366 19 nt Target #1:
5'-GGAAGUUGUAUCAAAGCAU-3' (SEQ ID NO: 2350)

C5-366 19 nt Target #2:
5'-UGGAAGUUGUAUCAAAGCA-3' (SEQ ID NO: 2734)

C5-366 19 nt Target #3:
5'-UUGGAAGUUGUAUCAAAGC-3' (SEQ ID NO: 3118)

C5-367 19 nt Target #1:
5'-GAAGUUGUAUCAAAGCAUU-3' (SEQ ID NO: 2351)

C5-367 19 nt Target #2:
5'-GGAAGUUGUAUCAAAGCAU-3' (SEQ ID NO: 2735)

C5-367 19 nt Target #3:
5'-UGGAAGUUGUAUCAAAGCA-3' (SEQ ID NO: 3119)

C5-368 19 nt Target #1:
5'-AAGUUGUAUCAAAGCAUUU-3' (SEQ ID NO: 2352)

C5-368 19 nt Target #2:
5'-GAAGUUGUAUCAAAGCAUU-3' (SEQ ID NO: 2736)

C5-368 19 nt Target #3:
5'-GGAAGUUGUAUCAAAGCAU-3' (SEQ ID NO: 3120)

C5-369 19 nt Target #1:
5'-AGUUGUAUCAAAGCAUUUU-3' (SEQ ID NO: 2353)

C5-369 19 nt Target #2:
5'-AAGUUGUAUCAAAGCAUUU-3' (SEQ ID NO: 2737)

C5-369 19 nt Target #3:
5'-GAAGUUGUAUCAAAGCAUU-3' (SEQ ID NO: 3121)

C5-370 19 nt Target #1:
5'-GUUGUAUCAAAGCAUUUUU-3' (SEQ ID NO: 2354)

C5-370 19 nt Target #2:
5'-AGUUGUAUCAAAGCAUUUU-3' (SEQ ID NO: 2738)

C5-370 19 nt Target #3:
5'-AAGUUGUAUCAAAGCAUUU-3' (SEQ ID NO: 3122)

C5-371 19 nt Target #1:
5'-UUGUAUCAAAGCAUUUUUC-3' (SEQ ID NO: 2355)

C5-371 19 nt Target #2:
5'-GUUGUAUCAAAGCAUUUUU-3' (SEQ ID NO: 2739)

C5-371 19 nt Target #3:
5'-AGUUGUAUCAAAGCAUUUU-3' (SEQ ID NO: 3123)

C5-372 19 nt Target #1:
5'-UGUAUCAAAGCAUUUUUCA-3' (SEQ ID NO: 2356)

C5-372 19 nt Target #2:
5'-UUGUAUCAAAGCAUUUUUC-3' (SEQ ID NO: 2740)

C5-372 19 nt Target #3:
5'-GUUGUAUCAAAGCAUUUUU-3' (SEQ ID NO: 3124)

TABLE 6-continued

DsiRNA Component 19 Nucleotide
Target Sequences in C5 mRNA

C5-373 19 nt Target #1:
5'-GUAUCAAAGCAUUUUCAA-3' (SEQ ID NO: 2357)

C5-373 19 nt Target #2:
5'-UGUAUCAAAGCAUUUUUCA-3' (SEQ ID NO: 2741)

C5-373 19 nt Target #3:
5'-UUGUAUCAAAGCAUUUUUC-3' (SEQ ID NO: 3125)

C5-408 19 nt Target #1:
5'-AAUAACCUAUGACAAUGGA-3' (SEQ ID NO: 2358)

C5-408 19 nt Target #2:
5'-CAAUAACCUAUGACAAUGG-3' (SEQ ID NO: 2742)

C5-408 19 nt Target #3:
5'-CCAAUAACCUAUGACAAUG-3' (SEQ ID NO: 3126)

C5-414 19 nt Target #1:
5'-CUAUGACAAUGGAUUUCUC-3' (SEQ ID NO: 2359)

C5-414 19 nt Target #2:
5'-CCUAUGACAAUGGAUUUCU-3' (SEQ ID NO: 2743)

C5-414 19 nt Target #3:
5'-ACCUAUGACAAUGGAUUUC-3' (SEQ ID NO: 3127)

C5-418 19 nt Target #1:
5'-GACAAUGGAUUUCUCUUCA-3' (SEQ ID NO: 2360)

C5-418 19 nt Target #2:
5'-UGACAAUGGAUUUCUCUUC-3' (SEQ ID NO: 2744)

C5-418 19 nt Target #3:
5'-AUGACAAUGGAUUUCUCUU-3' (SEQ ID NO: 3128)

C5-419 19 nt Target #1:
5'-ACAAUGGAUUUCUCUUCAU-3' (SEQ ID NO: 2361)

C5-419 19 nt Target #2:
5'-GACAAUGGAUUUCUCUUCA-3' (SEQ ID NO: 2745)

C5-419 19 nt Target #3:
5'-UGACAAUGGAUUUCUCUUC-3' (SEQ ID NO: 3129)

C5-420 19 nt Target #1:
5'-CAAUGGAUUUCUCUUCAUU-3' (SEQ ID NO: 2362)

C5-420 19 nt Target #2:
5'-ACAAUGGAUUUCUCUUCAU-3' (SEQ ID NO: 2746)

C5-420 19 nt Target #3:
5'-GACAAUGGAUUUCUCUUCA-3' (SEQ ID NO: 3130)

C5-422 19 nt Target #1:
5'-AUGGAUUUCUCUUCAUUCA-3' (SEQ ID NO: 2363)

C5-422 19 nt Target #2:
5'-AAUGGAUUUCUCUUCAUUC-3' (SEQ ID NO: 2747)

C5-422 19 nt Target #3:
5'-CAAUGGAUUUCUCUUCAUU-3' (SEQ ID NO: 3131)

C5-423 19 nt Target #1:
5'-UGGAUUUCUCUUCAUUCAU-3' (SEQ ID NO: 2364)

C5-423 19 nt Target #2:
5'-AUGGAUUUCUCUUCAUUCA-3' (SEQ ID NO: 2748)

C5-423 19 nt Target #3:
5'-AAUGGAUUUCUCUUCAUUC-3' (SEQ ID NO: 3132)

C5-425 19 nt Target #1:
5'-GAUUUCUCUUCAUUCAUAC-3' (SEQ ID NO: 2365)

C5-425 19 nt Target #2:
5'-GGAUUUCUCUUCAUUCAUA-3' (SEQ ID NO: 2749)

C5-425 19 nt Target #3:
5'-UGGAUUUCUCUUCAUUCAU-3' (SEQ ID NO: 3133)

C5-436 19 nt Target #1:
5'-AUUCAUACAGACAAACCUG-3' (SEQ ID NO: 2366)

C5-436 19 nt Target #2:
5'-CAUUCAUACAGACAAACCU-3' (SEQ ID NO: 2750)

C5-436 19 nt Target #3:
5'-UCAUUCAUACAGACAAACC-3' (SEQ ID NO: 3134)

C5-438 19 nt Target #1:
5'-UCAUACAGACAAACCUGUU-3' (SEQ ID NO: 2367)

C5-438 19 nt Target #2:
5'-UUCAUACAGACAAACCUGU-3' (SEQ ID NO: 2751)

C5-438 19 nt Target #3:
5'-AUUCAUACAGACAAACCUG-3' (SEQ ID NO: 3135)

C5-439 19 nt Target #1:
5'-CAUACAGACAAACCUGUUU-3' (SEQ ID NO: 2368)

C5-439 19 nt Target #2:
5'-UCAUACAGACAAACCUGUU-3' (SEQ ID NO: 2752)

C5-439 19 nt Target #3:
5'-UUCAUACAGACAAACCUGU-3' (SEQ ID NO: 3136)

C5-440 19 nt Target #1:
5'-AUACAGACAAACCUGUUUA-3' (SEQ ID NO: 2369)

C5-440 19 nt Target #2:
5'-CAUACAGACAAACCUGUUU-3' (SEQ ID NO: 2753)

C5-440 19 nt Target #3:
5'-UCAUACAGACAAACCUGUU-3' (SEQ ID NO: 3137)

C5-481 19 nt Target #1:
5'-GUUAGAGUUUAUUCGUUGA-3' (SEQ ID NO: 2370)

C5-481 19 nt Target #2:
5'-AGUUAGAGUUUAUUCGUUG-3' (SEQ ID NO: 2754)

C5-481 19 nt Target #3:
5'-AAGUUAGAGUUUAUUCGUU-3' (SEQ ID NO: 3138)

C5-501 19 nt Target #1:
5'-UGACGACUUGAAGCCAGCC-3' (SEQ ID NO: 2371)

C5-501 19 nt Target #2:
5'-AUGACGACUUGAAGCCAGC-3' (SEQ ID NO: 2755)

C5-501 19 nt Target #3:
5'-AAUGACGACUUGAAGCCAG-3' (SEQ ID NO: 3139)

C5-502 19 nt Target #1:
5'-GACGACUUGAAGCCAGCCA-3' (SEQ ID NO: 2372)

C5-502 19 nt Target #2:
5'-UGACGACUUGAAGCCAGCC-3' (SEQ ID NO: 2756)

C5-502 19 nt Target #3:
5'-AUGACGACUUGAAGCCAGC-3' (SEQ ID NO: 3140)

C5-503 19 nt Target #1:
5'-ACGACUUGAAGCCAGCCAA-3' (SEQ ID NO: 2373)

C5-503 19 nt Target #2:
5'-GACGACUUGAAGCCAGCCA-3' (SEQ ID NO: 2757)

TABLE 6-continued

DsiRNA Component 19 Nucleotide Target Sequences in C5 mRNA

C5-503 19 nt Target #3:
5'-UGACGACUUGAAGCCAGCC-3' (SEQ ID NO: 3141)

C5-504 19 nt Target #1:
5'-CGACUUGAAGCCAGCCAAA-3' (SEQ ID NO: 2374)

C5-504 19 nt Target #2:
5'-ACGACUUGAAGCCAGCCAA-3' (SEQ ID NO: 2758)

C5-504 19 nt Target #3:
5'-GACGACUUGAAGCCAGCCA-3' (SEQ ID NO: 3142)

C5-525 19 nt Target #1:
5'-AGAAACUGUCUUAACUUUC-3' (SEQ ID NO: 2375)

C5-525 19 nt Target #2:
5'-GAGAAACUGUCUUAACUUU-3' (SEQ ID NO: 2759)

C5-525 19 nt Target #3:
5'-AGAGAAACUGUCUUAACUU-3' (SEQ ID NO: 3143)

C5-529 19 nt Target #1:
5'-ACUGUCUUAACUUUCAUAG-3' (SEQ ID NO: 2376)

C5-529 19 nt Target #2:
5'-AACUGUCUUAACUUUCAUA-3' (SEQ ID NO: 2760)

C5-529 19 nt Target #3:
5'-AAACUGUCUUAACUUUCAU-3' (SEQ ID NO: 3144)

C5-530 19 nt Target #1:
5'-CUGUCUUAACUUUCAUAGA-3' (SEQ ID NO: 2377)

C5-530 19 nt Target #2:
5'-ACUGUCUUAACUUUCAUAG-3' (SEQ ID NO: 2761)

C5-530 19 nt Target #3:
5'-AACUGUCUUAACUUUCAUA-3' (SEQ ID NO: 3145)

C5-553 19 nt Target #1:
5'-GAAGGAUCAGAAGUUGACA-3' (SEQ ID NO: 2378)

C5-553 19 nt Target #2:
5'-UGAAGGAUCAGAAGUUGAC-3' (SEQ ID NO: 2762)

C5-553 19 nt Target #3:
5'-CUGAAGGAUCAGAAGUUGA-3' (SEQ ID NO: 3146)

C5-554 19 nt Target #1:
5'-AAGGAUCAGAAGUUGACAU-3' (SEQ ID NO: 2379)

C5-554 19 nt Target #2:
5'-GAAGGAUCAGAAGUUGACA-3' (SEQ ID NO: 2763)

C5-554 19 nt Target #3:
5'-UGAAGGAUCAGAAGUUGAC-3' (SEQ ID NO: 3147)

C5-568 19 nt Target #1:
5'-GACAUGGUAGAAGAAAUUG-3' (SEQ ID NO: 2380)

C5-568 19 nt Target #2:
5'-UGACAUGGUAGAAGAAAUU-3' (SEQ ID NO: 2764)

C5-568 19 nt Target #3:
5'-UUGACAUGGUAGAAGAAAU-3' (SEQ ID NO: 3148)

C5-569 19 nt Target #1:
5'-ACAUGGUAGAAGAAAUUGA-3' (SEQ ID NO: 2381)

C5-569 19 nt Target #2:
5'-GACAUGGUAGAAGAAAUUG-3' (SEQ ID NO: 2765)

C5-569 19 nt Target #3:
5'-UGACAUGGUAGAAGAAAUU-3' (SEQ ID NO: 3149)

C5-573 19 nt Target #1:
5'-GGUAGAAGAAAUUGAUCAU-3' (SEQ ID NO: 2382)

C5-573 19 nt Target #2:
5'-UGGUAGAAGAAAUUGAUCA-3' (SEQ ID NO: 2766)

C5-573 19 nt Target #3:
5'-AUGGUAGAAGAAAUUGAUC-3' (SEQ ID NO: 3150)

C5-574 19 nt Target #1:
5'-GUAGAAGAAAUUGAUCAUA-3' (SEQ ID NO: 2383)

C5-574 19 nt Target #2:
5'-GGUAGAAGAAAUUGAUCAU-3' (SEQ ID NO: 2767)

C5-574 19 nt Target #3:
5'-UGGUAGAAGAAAUUGAUCA-3' (SEQ ID NO: 3151)

C5-578 19 nt Target #1:
5'-AAGAAAUUGAUCAUAUUGG-3' (SEQ ID NO: 2384)

C5-578 19 nt Target #2:
5'-GAAGAAAUUGAUCAUAUUG-3' (SEQ ID NO: 2768)

C5-578 19 nt Target #3:
5'-AGAAGAAAUUGAUCAUAUU-3' (SEQ ID NO: 3152)

C5-579 19 nt Target #1:
5'-AGAAAUUGAUCAUAUUGGA-3' (SEQ ID NO: 2385)

C5-579 19 nt Target #2:
5'-AAGAAAUUGAUCAUAUUGG-3' (SEQ ID NO: 2769)

C5-579 19 nt Target #3:
5'-GAAGAAAUUGAUCAUAUUG-3' (SEQ ID NO: 3153)

C5-595 19 nt Target #1:
5'-GGAAUUAUCUCUUUUCCUG-3' (SEQ ID NO: 2386)

C5-595 19 nt Target #2:
5'-UGGAAUUAUCUCUUUUCCU-3' (SEQ ID NO: 2770)

C5-595 19 nt Target #3:
5'-UUGGAAUUAUCUCUUUUCC-3' (SEQ ID NO: 3154)

C5-596 19 nt Target #1:
5'-GAAUUAUCUCUUUUCCUGA-3' (SEQ ID NO: 2387)

C5-596 19 nt Target #2:
5'-GGAAUUAUCUCUUUUCCUG-3' (SEQ ID NO: 2771)

C5-596 19 nt Target #3:
5'-UGGAAUUAUCUCUUUUCCU-3' (SEQ ID NO: 3155)

C5-597 19 nt Target #1:
5'-AAUUAUCUCUUUUCCUGAC-3' (SEQ ID NO: 2388)

C5-597 19 nt Target #2:
5'-GAAUUAUCUCUUUUCCUGA-3' (SEQ ID NO: 2772)

C5-597 19 nt Target #3:
5'-GGAAUUAUCUCUUUUCCUG-3' (SEQ ID NO: 3156)

C5-598 19 nt Target #1:
5'-AUUAUCUCUUUUCCUGACU-3' (SEQ ID NO: 2389)

C5-598 19 nt Target #2:
5'-AAUUAUCUCUUUUCCUGAC-3' (SEQ ID NO: 2773)

C5-598 19 nt Target #3:
5'-GAAUUAUCUCUUUUCCUGA-3' (SEQ ID NO: 3157)

C5-599 19 nt Target #1:
5'-UUAUCUCUUUUCCUGACUU-3' (SEQ ID NO: 2390)

TABLE 6-continued

DsiRNA Component 19 Nucleotide Target Sequences in C5 mRNA

C5-599 19 nt Target #2:
5'-AUUAUCUCUUUUCCUGACU-3' (SEQ ID NO: 2774)

C5-599 19 nt Target #3:
5'-AAUUAUCUCUUUUCCUGAC-3' (SEQ ID NO: 3158)

C5-600 19 nt Target #1:
5'-UAUCUCUUUUCCUGACUUC-3' (SEQ ID NO: 2391)

C5-600 19 nt Target #2:
5'-UUAUCUCUUUUCCUGACUU-3' (SEQ ID NO: 2775)

C5-600 19 nt Target #3:
5'-AUUAUCUCUUUUCCUGACU-3' (SEQ ID NO: 3159)

C5-601 19 nt Target #1:
5'-AUCUCUUUUCCUGACUUCA-3' (SEQ ID NO: 2392)

C5-601 19 nt Target #2:
5'-UAUCUCUUUUCCUGACUUC-3' (SEQ ID NO: 2776)

C5-601 19 nt Target #3:
5'-UUAUCUCUUUUCCUGACUU-3' (SEQ ID NO: 3160)

C5-602 19 nt Target #1:
5'-UCUCUUUUCCUGACUUCAA-3' (SEQ ID NO: 2393)

C5-602 19 nt Target #2:
5'-AUCUCUUUUCCUGACUUCA-3' (SEQ ID NO: 2777)

C5-602 19 nt Target #3:
5'-UAUCUCUUUUCCUGACUUC-3' (SEQ ID NO: 3161)

C5-603 19 nt Target #1:
5'-CUCUUUUCCUGACUUCAAG-3' (SEQ ID NO: 2394)

C5-603 19 nt Target #2:
5'-UCUCUUUUCCUGACUUCAA-3' (SEQ ID NO: 2778)

C5-603 19 nt Target #3:
5'-AUCUCUUUUCCUGACUUCA-3' (SEQ ID NO: 3162)

C5-604 19 nt Target #1:
5'-UCUUUUCCUGACUUCAAGA-3' (SEQ ID NO: 2395)

C5-604 19 nt Target #2:
5'-CUCUUUUCCUGACUUCAAG-3' (SEQ ID NO: 2779)

C5-604 19 nt Target #3:
5'-UCUCUUUUCCUGACUUCAA-3' (SEQ ID NO: 3163)

C5-605 19 nt Target #1:
5'-CUUUUCCUGACUUCAAGAU-3' (SEQ ID NO: 2396)

C5-605 19 nt Target #2:
5'-UCUUUUCCUGACUUCAAGA-3' (SEQ ID NO: 2780)

C5-605 19 nt Target #3:
5'-CUCUUUUCCUGACUUCAAG-3' (SEQ ID NO: 3164)

C5-606 19 nt Target #1:
5'-UUUUCCUGACUUCAAGAUU-3' (SEQ ID NO: 2397)

C5-606 19 nt Target #2:
5'-CUUUUCCUGACUUCAAGAU-3' (SEQ ID NO: 2781)

C5-606 19 nt Target #3:
5'-UCUUUUCCUGACUUCAAGA-3' (SEQ ID NO: 3165)

C5-607 19 nt Target #1:
5'-UUUCCUGACUUCAAGAUUC-3' (SEQ ID NO: 2398)

C5-607 19 nt Target #2:
5'-UUUUCCUGACUUCAAGAUU-3' (SEQ ID NO: 2782)

C5-607 19 nt Target #3:
5'-CUUUUCCUGACUUCAAGAU-3' (SEQ ID NO: 3166)

C5-608 19 nt Target #1:
5'-UUCCUGACUUCAAGAUUCC-3' (SEQ ID NO: 2399)

C5-608 19 nt Target #2:
5'-UUUCCUGACUUCAAGAUUC-3' (SEQ ID NO: 2783)

C5-608 19 nt Target #3:
5'-UUUUCCUGACUUCAAGAUU-3' (SEQ ID NO: 3167)

C5-710 19 nt Target #1:
5'-UUAAAGAAUAUGUCUUGCC-3' (SEQ ID NO: 2400)

C5-710 19 nt Target #2:
5'-GUUAAAGAAUAUGUCUUGC-3' (SEQ ID NO: 2784)

C5-710 19 nt Target #3:
5'-AGUUAAAGAAUAUGUCUUG-3' (SEQ ID NO: 3168)

C5-711 19 nt Target #1:
5'-UAAAGAAUAUGUCUUGCCA-3' (SEQ ID NO: 2401)

C5-711 19 nt Target #2:
5'-UUAAAGAAUAUGUCUUGCC-3' (SEQ ID NO: 2785)

C5-711 19 nt Target #3:
5'-GUUAAAGAAUAUGUCUUGC-3' (SEQ ID NO: 3169)

C5-712 19 nt Target #1:
5'-AAAGAAUAUGUCUUGCCAC-3' (SEQ ID NO: 2402)

C5-712 19 nt Target #2:
5'-UAAAGAAUAUGUCUUGCCA-3' (SEQ ID NO: 2786)

C5-712 19 nt Target #3:
5'-UUAAAGAAUAUGUCUUGCC-3' (SEQ ID NO: 3170)

C5-775 19 nt Target #1:
5'-AAGAACUUUAAGAAUUUUG-3' (SEQ ID NO: 2403)

C5-775 19 nt Target #2:
5'-CAAGAACUUUAAGAAUUUU-3' (SEQ ID NO: 2787)

C5-775 19 nt Target #3:
5'-ACAAGAACUUUAAGAAUUU-3' (SEQ ID NO: 3171)

C5-776 19 nt Target #1:
5'-AGAACUUUAAGAAUUUUGA-3' (SEQ ID NO: 2404)

C5-776 19 nt Target #2:
5'-AAGAACUUUAAGAAUUUUG-3' (SEQ ID NO: 2788)

C5-776 19 nt Target #3:
5'-CAAGAACUUUAAGAAUUUU-3' (SEQ ID NO: 3172)

C5-780 19 nt Target #1:
5'-CUUUAAGAAUUUUGAAAUU-3' (SEQ ID NO: 2405)

C5-780 19 nt Target #2:
5'-ACUUUAAGAAUUUUGAAAU-3' (SEQ ID NO: 2789)

C5-780 19 nt Target #3:
5'-AACUUUAAGAAUUUUGAAA-3' (SEQ ID NO: 3173)

C5-786 19 nt Target #1:
5'-GAAUUUUGAAAUUACUAUA-3' (SEQ ID NO: 2406)

C5-786 19 nt Target #2:
5'-AGAAUUUUGAAAUUACUAU-3' (SEQ ID NO: 2790)

C5-786 19 nt Target #3:
5'-AAGAAUUUUGAAAUUACUA-3' (SEQ ID NO: 3174)

TABLE 6-continued

DsiRNA Component 19 Nucleotide
Target Sequences in C5 mRNA

C5-787 19 nt Target #1:
5'-AAUUUUGAAAUUACUAUAA-3' (SEQ ID NO: 2407)

C5-787 19 nt Target #2:
5'-GAAUUUUGAAAUUACUAUA-3' (SEQ ID NO: 2791)

C5-787 19 nt Target #3:
5'-AGAAUUUUGAAAUUACUAU-3' (SEQ ID NO: 3175)

C5-788 19 nt Target #1:
5'-AUUUUGAAAUUACUAUAAA-3' (SEQ ID NO: 2408)

C5-788 19 nt Target #2:
5'-AAUUUUGAAAUUACUAUAA-3' (SEQ ID NO: 2792)

C5-788 19 nt Target #3:
5'-GAAUUUUGAAAUUACUAUA-3' (SEQ ID NO: 3176)

C5-791 19 nt Target #1:
5'-UUGAAAUUACUAUAAAGC-3' (SEQ ID NO: 2409)

C5-791 19 nt Target #2:
5'-UUUGAAAUUACUAUAAAG-3' (SEQ ID NO: 2793)

C5-791 19 nt Target #3:
5'-UUUUGAAAUUACUAUAAAA-3' (SEQ ID NO: 3177)

C5-792 19 nt Target #1:
5'-UGAAAUUACUAUAAAGCA-3' (SEQ ID NO: 2410)

C5-792 19 nt Target #2:
5'-UUGAAAUUACUAUAAAGC-3' (SEQ ID NO: 2794)

C5-792 19 nt Target #3:
5'-UUUGAAAUUACUAUAAAG-3' (SEQ ID NO: 3178)

C5-793 19 nt Target #1:
5'-GAAAUUACUAUAAAGCAA-3' (SEQ ID NO: 2411)

C5-793 19 nt Target #2:
5'-UGAAAUUACUAUAAAGCA-3' (SEQ ID NO: 2795)

C5-793 19 nt Target #3:
5'-UUGAAAUUACUAUAAAGC-3' (SEQ ID NO: 3179)

C5-805 19 nt Target #1:
5'-AAAGCAAGAUAUUUUUAUA-3' (SEQ ID NO: 2412)

C5-805 19 nt Target #2:
5'-AAAAGCAAGAUAUUUUUAU-3' (SEQ ID NO: 2796)

C5-805 19 nt Target #3:
5'-UAAAAGCAAGAUAUUUUUA-3' (SEQ ID NO: 3180)

C5-806 19 nt Target #1:
5'-AAGCAAGAUAUUUUUAUAA-3' (SEQ ID NO: 2413)

C5-806 19 nt Target #2:
5'-AAAGCAAGAUAUUUUUAUA-3' (SEQ ID NO: 2797)

C5-806 19 nt Target #3:
5'-AAAAGCAAGAUAUUUUUAU-3' (SEQ ID NO: 3181)

C5-807 19 nt Target #1:
5'-AGCAAGAUAUUUUUAUAAU-3' (SEQ ID NO: 2414)

C5-807 19 nt Target #2:
5'-AAGCAAGAUAUUUUUAUAA-3' (SEQ ID NO: 2798)

C5-807 19 nt Target #3:
5'-AAAGCAAGAUAUUUUUAUA-3' (SEQ ID NO: 3182)

C5-808 19 nt Target #1:
5'-GCAAGAUAUUUUUAUAAUA-3' (SEQ ID NO: 2415)

TABLE 6-continued

DsiRNA Component 19 Nucleotide
Target Sequences in C5 mRNA

C5-808 19 nt Target #2:
5'-AGCAAGAUAUUUUUAUAAU-3' (SEQ ID NO: 2799)

C5-808 19 nt Target #3:
5'-AAGCAAGAUAUUUUUAUAA-3' (SEQ ID NO: 3183)

C5-809 19 nt Target #1:
5'-CAAGAUAUUUUUAUAAUAA-3' (SEQ ID NO: 2416)

C5-809 19 nt Target #2:
5'-GCAAGAUAUUUUUAUAAUA-3' (SEQ ID NO: 2800)

C5-809 19 nt Target #3:
5'-AGCAAGAUAUUUUUAUAAU-3' (SEQ ID NO: 3184)

C5-810 19 nt Target #1:
5'-AAGAUAUUUUUAUAAUAAA-3' (SEQ ID NO: 2417)

C5-810 19 nt Target #2:
5'-CAAGAUAUUUUUAUAAUAA-3' (SEQ ID NO: 2801)

C5-810 19 nt Target #3:
5'-GCAAGAUAUUUUUAUAAUA-3' (SEQ ID NO: 3185)

C5-811 19 nt Target #1:
5'-AGAUAUUUUUAUAAUAAAG-3' (SEQ ID NO: 2418)

C5-811 19 nt Target #2:
5'-AAGAUAUUUUUAUAAUAAA-3' (SEQ ID NO: 2802)

C5-811 19 nt Target #3:
5'-CAAGAUAUUUUUAUAAUAA-3' (SEQ ID NO: 3186)

C5-812 19 nt Target #1:
5'-GAUAUUUUUAUAAUAAAGU-3' (SEQ ID NO: 2419)

C5-812 19 nt Target #2:
5'-AGAUAUUUUUAUAAUAAAG-3' (SEQ ID NO: 2803)

C5-812 19 nt Target #3:
5'-AAGAUAUUUUUAUAAUAAA-3' (SEQ ID NO: 3187)

C5-923 19 nt Target #1:
5'-CAAUGUUGAUAAAUGGAAU-3' (SEQ ID NO: 2420)

C5-923 19 nt Target #2:
5'-ACAAUGUUGAUAAAUGGAA-3' (SEQ ID NO: 2804)

C5-923 19 nt Target #3:
5'-CACAAUGUUGAUAAAUGGA-3' (SEQ ID NO: 3188)

C5-924 19 nt Target #1:
5'-AAUGUUGAUAAAUGGAAUU-3' (SEQ ID NO: 2421)

C5-924 19 nt Target #2:
5'-CAAUGUUGAUAAAUGGAAU-3' (SEQ ID NO: 2805)

C5-924 19 nt Target #3:
5'-ACAAUGUUGAUAAAUGGAA-3' (SEQ ID NO: 3189)

C5-926 19 nt Target #1:
5'-UGUUGAUAAAUGGAAUUGC-3' (SEQ ID NO: 2422)

C5-926 19 nt Target #2:
5'-AUGUUGAUAAAUGGAAUUG-3' (SEQ ID NO: 2806)

C5-926 19 nt Target #3:
5'-AAUGUUGAUAAAUGGAAUU-3' (SEQ ID NO: 3190)

C5-927 19 nt Target #1:
5'-GUUGAUAAAUGGAAUUGCU-3' (SEQ ID NO: 2423)

C5-927 19 nt Target #2:
5'-UGUUGAUAAAUGGAAUUGC-3' (SEQ ID NO: 2807)

TABLE 6-continued

DsiRNA Component 19 Nucleotide Target Sequences in C5 mRNA

C5-927 19 nt Target #3:
5'-AUGUUGAUAAAUGGAAUUG-3' (SEQ ID NO: 3191)

C5-928 19 nt Target #1:
5'-UUGAUAAAUGGAAUUGCUC-3' (SEQ ID NO: 2424)

C5-928 19 nt Target #2:
5'-GUUGAUAAAUGGAAUUGCU-3' (SEQ ID NO: 2808)

C5-928 19 nt Target #3:
5'-UGUUGAUAAAUGGAAUUGC-3' (SEQ ID NO: 3192)

C5-931 19 nt Target #1:
5'-AUAAAUGGAAUUGCUCAAG-3' (SEQ ID NO: 2425)

C5-931 19 nt Target #2:
5'-GAUAAAUGGAAUUGCUCAA-3' (SEQ ID NO: 2809)

C5-931 19 nt Target #3:
5'-UGAUAAAUGGAAUUGCUCA-3' (SEQ ID NO: 3193)

C5-935 19 nt Target #1:
5'-AUGGAAUUGCUCAAGUCAC-3' (SEQ ID NO: 2426)

C5-935 19 nt Target #2:
5'-AAUGGAAUUGCUCAAGUCA-3' (SEQ ID NO: 2810)

C5-935 19 nt Target #3:
5'-AAAUGGAAUUGCUCAAGUC-3' (SEQ ID NO: 3194)

C5-944 19 nt Target #1:
5'-CUCAAGUCACAUUUGAUUC-3' (SEQ ID NO: 2427)

C5-944 19 nt Target #2:
5'-GCUCAAGUCACAUUUGAUU-3' (SEQ ID NO: 2811)

C5-944 19 nt Target #3:
5'-UGCUCAAGUCACAUUUGAU-3' (SEQ ID NO: 3195)

C5-946 19 nt Target #1:
5'-CAAGUCACAUUUGAUUCUG-3' (SEQ ID NO: 2428)

C5-946 19 nt Target #2:
5'-UCAAGUCACAUUUGAUUCU-3' (SEQ ID NO: 2812)

C5-946 19 nt Target #3:
5'-CUCAAGUCACAUUUGAUUC-3' (SEQ ID NO: 3196)

C5-947 19 nt Target #1:
5'-AAGUCACAUUUGAUUCUGA-3' (SEQ ID NO: 2429)

C5-947 19 nt Target #2:
5'-CAAGUCACAUUUGAUUCUG-3' (SEQ ID NO: 2813)

C5-947 19 nt Target #3:
5'-UCAAGUCACAUUUGAUUCU-3' (SEQ ID NO: 3197)

C5-948 19 nt Target #1:
5'-AGUCACAUUUGAUUCUGAA-3' (SEQ ID NO: 2430)

C5-948 19 nt Target #2:
5'-AAGUCACAUUUGAUUCUGA-3' (SEQ ID NO: 2814)

C5-948 19 nt Target #3:
5'-CAAGUCACAUUUGAUUCUG-3' (SEQ ID NO: 3198)

C5-953 19 nt Target #1:
5'-CAUUUGAUUCUGAAACAGC-3' (SEQ ID NO: 2431)

C5-953 19 nt Target #2:
5'-ACAUUUGAUUCUGAAACAG-3' (SEQ ID NO: 2815)

C5-953 19 nt Target #3:
5'-CACAUUUGAUUCUGAAACA-3' (SEQ ID NO: 3199)

C5-955 19 nt Target #1:
5'-UUUGAUUCUGAAACAGCAG-3' (SEQ ID NO: 2432)

C5-955 19 nt Target #2:
5'-AUUUGAUUCUGAAACAGCA-3' (SEQ ID NO: 2816)

C5-955 19 nt Target #3:
5'-CAUUUGAUUCUGAAACAGC-3' (SEQ ID NO: 3200)

C5-956 19 nt Target #1:
5'-UUGAUUCUGAAACAGCAGU-3' (SEQ ID NO: 2433)

C5-956 19 nt Target #2:
5'-UUUGAUUCUGAAACAGCAG-3' (SEQ ID NO: 2817)

C5-956 19 nt Target #3:
5'-AUUUGAUUCUGAAACAGCA-3' (SEQ ID NO: 3201)

C5-968 19 nt Target #1:
5'-CAGCAGUCAAAGAACUGUC-3' (SEQ ID NO: 2434)

C5-968 19 nt Target #2:
5'-ACAGCAGUCAAAGAACUGU-3' (SEQ ID NO: 2818)

C5-968 19 nt Target #3:
5'-AACAGCAGUCAAAGAACUG-3' (SEQ ID NO: 3202)

C5-970 19 nt Target #1:
5'-GCAGUCAAAGAACUGUCAU-3' (SEQ ID NO: 2435)

C5-970 19 nt Target #2:
5'-AGCAGUCAAAGAACUGUCA-3' (SEQ ID NO: 2819)

C5-970 19 nt Target #3:
5'-CAGCAGUCAAAGAACUGUC-3' (SEQ ID NO: 3203)

C5-973 19 nt Target #1:
5'-GUCAAAGAACUGUCAUACU-3' (SEQ ID NO: 2436)

C5-973 19 nt Target #2:
5'-AGUCAAAGAACUGUCAUAC-3' (SEQ ID NO: 2820)

C5-973 19 nt Target #3:
5'-CAGUCAAAGAACUGUCAUA-3' (SEQ ID NO: 3204)

C5-977 19 nt Target #1:
5'-AAGAACUGUCAUACUACAG-3' (SEQ ID NO: 2437)

C5-977 19 nt Target #2:
5'-AAAGAACUGUCAUACUACA-3' (SEQ ID NO: 2821)

C5-977 19 nt Target #3:
5'-CAAAGAACUGUCAUACUAC-3' (SEQ ID NO: 3205)

C5-978 19 nt Target #1:
5'-AGAACUGUCAUACUACAGU-3' (SEQ ID NO: 2438)

C5-978 19 nt Target #2:
5'-AAGAACUGUCAUACUACAG-3' (SEQ ID NO: 2822)

C5-978 19 nt Target #3:
5'-AAAGAACUGUCAUACUACA-3' (SEQ ID NO: 3206)

C5-980 19 nt Target #1:
5'-AACUGUCAUACUACAGUUU-3' (SEQ ID NO: 2439)

C5-980 19 nt Target #2:
5'-GAACUGUCAUACUACAGUU-3' (SEQ ID NO: 2823)

C5-980 19 nt Target #3:
5'-AGAACUGUCAUACUACAGU-3' (SEQ ID NO: 3207)

C5-1006 19 nt Target #1:
5'-UUAAACAACAAGUACCUUU-3' (SEQ ID NO: 2440)

TABLE 6-continued

DsiRNA Component 19 Nucleotide Target Sequences in C5 mRNA

C5-1006 19 nt Target #2:
5'-UUUAAACAACAAGUACCUU-3' (SEQ ID NO: 2824)

C5-1006 19 nt Target #3:
5'-AUUUAAACAACAAGUACCU-3' (SEQ ID NO: 3208)

C5-1007 19 nt Target #1:
5'-UAAACAACAAGUACCUUUA-3' (SEQ ID NO: 2441)

C5-1007 19 nt Target #2:
5'-UUAAACAACAAGUACCUUU-3' (SEQ ID NO: 2825)

C5-1007 19 nt Target #3:
5'-UUUAAACAACAAGUACCUU-3' (SEQ ID NO: 3209)

C5-1008 19 nt Target #1:
5'-AAACAACAAGUACCUUUAU-3' (SEQ ID NO: 2442)

C5-1008 19 nt Target #2:
5'-UAAACAACAAGUACCUUUA-3' (SEQ ID NO: 2826)

C5-1008 19 nt Target #3:
5'-UUAAACAACAAGUACCUUU-3' (SEQ ID NO: 3210)

C5-1009 19 nt Target #1:
5'-AACAACAAGUACCUUUAUA-3' (SEQ ID NO: 2443)

C5-1009 19 nt Target #2:
5'-AAACAACAAGUACCUUUAU-3' (SEQ ID NO: 2827)

C5-1009 19 nt Target #3:
5'-UAAACAACAAGUACCUUUA-3' (SEQ ID NO: 3211)

C5-1010 19 nt Target #1:
5'-ACAACAAGUACCUUUAUAU-3' (SEQ ID NO: 2444)

C5-1010 19 nt Target #2:
5'-AACAACAAGUACCUUUAUA-3' (SEQ ID NO: 2828)

C5-1010 19 nt Target #3:
5'-AAACAACAAGUACCUUUAU-3' (SEQ ID NO: 3212)

C5-1011 19 nt Target #1:
5'-CAACAAGUACCUUUAUAUU-3' (SEQ ID NO: 2445)

C5-1011 19 nt Target #2:
5'-ACAACAAGUACCUUUAUAU-3' (SEQ ID NO: 2829)

C5-1011 19 nt Target #3:
5'-AACAACAAGUACCUUUAUA-3' (SEQ ID NO: 3213)

C5-1012 19 nt Target #1:
5'-AACAAGUACCUUUAUAUUG-3' (SEQ ID NO: 2446)

C5-1012 19 nt Target #2:
5'-CAACAAGUACCUUUAUAUU-3' (SEQ ID NO: 2830)

C5-1012 19 nt Target #3:
5'-ACAACAAGUACCUUUAUAU-3' (SEQ ID NO: 3214)

C5-1013 19 nt Target #1:
5'-ACAAGUACCUUUAUAUUGC-3' (SEQ ID NO: 2447)

C5-1013 19 nt Target #2:
5'-AACAAGUACCUUUAUAUUG-3' (SEQ ID NO: 2831)

C5-1013 19 nt Target #3:
5'-CAACAAGUACCUUUAUAUU-3' (SEQ ID NO: 3215)

C5-1014 19 nt Target #1:
5'-CAAGUACCUUUAUAUUGCU-3' (SEQ ID NO: 2448)

C5-1014 19 nt Target #2:
5'-ACAAGUACCUUUAUAUUGC-3' (SEQ ID NO: 2832)

C5-1014 19 nt Target #3:
5'-AACAAGUACCUUUAUAUUG-3' (SEQ ID NO: 3216)

C5-1015 19 nt Target #1:
5'-AAGUACCUUUAUAUUGCUG-3' (SEQ ID NO: 2449)

C5-1015 19 nt Target #2:
5'-CAAGUACCUUUAUAUUGCU-3' (SEQ ID NO: 2833)

C5-1015 19 nt Target #3:
5'-ACAAGUACCUUUAUAUUGC-3' (SEQ ID NO: 3217)

C5-1016 19 nt Target #1:
5'-AGUACCUUUAUAUUGCUGU-3' (SEQ ID NO: 2450)

C5-1016 19 nt Target #2:
5'-AAGUACCUUUAUAUUGCUG-3' (SEQ ID NO: 2834)

C5-1016 19 nt Target #3:
5'-CAAGUACCUUUAUAUUGCU-3' (SEQ ID NO: 3218)

C5-1017 19 nt Target #1:
5'-GUACCUUUAUAUUGCUGUA-3' (SEQ ID NO: 2451)

C5-1017 19 nt Target #2:
5'-AGUACCUUUAUAUUGCUGU-3' (SEQ ID NO: 2835)

C5-1017 19 nt Target #3:
5'-AAGUACCUUUAUAUUGCUG-3' (SEQ ID NO: 3219)

C5-1019 19 nt Target #1:
5'-ACCUUUAUAUUGCUGUAAC-3' (SEQ ID NO: 2452)

C5-1019 19 nt Target #2:
5'-UACCUUUAUAUUGCUGUAA-3' (SEQ ID NO: 2836)

C5-1019 19 nt Target #3:
5'-GUACCUUUAUAUUGCUGUA-3' (SEQ ID NO: 3220)

C5-1088 19 nt Target #1:
5'-UCAAAUAUGUCCUCUCUCC-3' (SEQ ID NO: 2453)

C5-1088 19 nt Target #2:
5'-AUCAAAUAUGUCCUCUCUC-3' (SEQ ID NO: 2837)

C5-1088 19 nt Target #3:
5'-CAUCAAAUAUGUCCUCUCU-3' (SEQ ID NO: 3221)

C5-1105 19 nt Target #1:
5'-CCCUACAAACUGAAUUUGG-3' (SEQ ID NO: 2454)

C5-1105 19 nt Target #2:
5'-UCCCUACAAACUGAAUUUG-3' (SEQ ID NO: 2838)

C5-1105 19 nt Target #3:
5'-CUCCCUACAAACUGAAUUU-3' (SEQ ID NO: 3222)

C5-1109 19 nt Target #1:
5'-ACAAACUGAAUUUGGUUGC-3' (SEQ ID NO: 2455)

C5-1109 19 nt Target #2:
5'-UACAAACUGAAUUUGGUUG-3' (SEQ ID NO: 2839)

C5-1109 19 nt Target #3:
5'-CUACAAACUGAAUUUGGUU-3' (SEQ ID NO: 3223)

C5-1110 19 nt Target #1:
5'-CAAACUGAAUUUGGUUGCU-3' (SEQ ID NO: 2456)

C5-1110 19 nt Target #2:
5'-ACAAACUGAAUUUGGUUGC-3' (SEQ ID NO: 2840)

C5-1110 19 nt Target #3:
5'-UACAAACUGAAUUUGGUUG-3' (SEQ ID NO: 3224)

TABLE 6-continued

DsiRNA Component 19 Nucleotide
Target Sequences in C5 mRNA

C5-1222 19 nt Target #1:
5'-CUGAAUGCACAAACAAUUG-3' (SEQ ID NO: 2457)

C5-1222 19 nt Target #2:
5'-ACUGAAUGCACAAACAAUU-3' (SEQ ID NO: 2841)

C5-1222 19 nt Target #3:
5'-CACUGAAUGCACAAACAAU-3' (SEQ ID NO: 3225)

C5-1223 19 nt Target #1:
5'-UGAAUGCACAAACAAUUGA-3' (SEQ ID NO: 2458)

C5-1223 19 nt Target #2:
5'-CUGAAUGCACAAACAAUUG-3' (SEQ ID NO: 2842)

C5-1223 19 nt Target #3:
5'-ACUGAAUGCACAAACAAUU-3' (SEQ ID NO: 3226)

C5-1249 19 nt Target #1:
5'-CAAGAGACAUCUGACUUGG-3' (SEQ ID NO: 2459)

C5-1249 19 nt Target #2:
5'-CCAAGAGACAUCUGACUUG-3' (SEQ ID NO: 2843)

C5-1249 19 nt Target #3:
5'-ACCAAGAGACAUCUGACUU-3' (SEQ ID NO: 3227)

C5-1250 19 nt Target #1:
5'-AAGAGACAUCUGACUUGGA-3' (SEQ ID NO: 2460)

C5-1250 19 nt Target #2:
5'-CAAGAGACAUCUGACUUGG-3' (SEQ ID NO: 2844)

C5-1250 19 nt Target #3:
5'-CCAAGAGACAUCUGACUUG-3' (SEQ ID NO: 3228)

C5-1405 19 nt Target #1:
5'-GGUUACCGAGCAAUAGCAU-3' (SEQ ID NO: 2461)

C5-1405 19 nt Target #2:
5'-AGGUUACCGAGCAAUAGCA-3' (SEQ ID NO: 2845)

C5-1405 19 nt Target #3:
5'-AAGGUUACCGAGCAAUAGC-3' (SEQ ID NO: 3229)

C5-1433 19 nt Target #1:
5'-UCAGCCAAAGUUACCUUUA-3' (SEQ ID NO: 2462)

C5-1433 19 nt Target #2:
5'-CUCAGCCAAAGUUACCUUU-3' (SEQ ID NO: 2846)

C5-1433 19 nt Target #3:
5'-UCUCAGCCAAAGUUACCUU-3' (SEQ ID NO: 3230)

C5-1434 19 nt Target #1:
5'-CAGCCAAAGUUACCUUUAU-3' (SEQ ID NO: 2463)

C5-1434 19 nt Target #2:
5'-UCAGCCAAAGUUACCUUUA-3' (SEQ ID NO: 2847)

C5-1434 19 nt Target #3:
5'-CUCAGCCAAAGUUACCUUU-3' (SEQ ID NO: 3231)

C5-1435 19 nt Target #1:
5'-AGCCAAAGUUACCUUUAUA-3' (SEQ ID NO: 2464)

C5-1435 19 nt Target #2:
5'-CAGCCAAAGUUACCUUUAU-3' (SEQ ID NO: 2848)

C5-1435 19 nt Target #3:
5'-UCAGCCAAAGUUACCUUUA-3' (SEQ ID NO: 3232)

C5-1436 19 nt Target #1:
5'-GCCAAAGUUACCUUUAUAU-3' (SEQ ID NO: 2465)

TABLE 6-continued

DsiRNA Component 19 Nucleotide
Target Sequences in C5 mRNA

C5-1436 19 nt Target #2:
5'-AGCCAAAGUUACCUUUAUA-3' (SEQ ID NO: 2849)

C5-1436 19 nt Target #3:
5'-CAGCCAAAGUUACCUUUAU-3' (SEQ ID NO: 3233)

C5-1519 19 nt Target #1:
5'-AAAAGCCCAUAUAUUGACA-3' (SEQ ID NO: 2466)

C5-1519 19 nt Target #2:
5'-CAAAAGCCCAUAUAUUGAC-3' (SEQ ID NO: 2850)

C5-1519 19 nt Target #3:
5'-CCAAAAGCCCAUAUAUUGA-3' (SEQ ID NO: 3234)

C5-1523 19 nt Target #1:
5'-GCCCAUAUAUUGACAAAAU-3' (SEQ ID NO: 2467)

C5-1523 19 nt Target #2:
5'-AGCCCAUAUAUUGACAAAA-3' (SEQ ID NO: 2851)

C5-1523 19 nt Target #3:
5'-AAGCCCAUAUAUUGACAAA-3' (SEQ ID NO: 3235)

C5-1524 19 nt Target #1:
5'-CCCAUAUAUUGACAAAAUA-3' (SEQ ID NO: 2468)

C5-1524 19 nt Target #2:
5'-GCCCAUAUAUUGACAAAAU-3' (SEQ ID NO: 2852)

C5-1524 19 nt Target #3:
5'-AGCCCAUAUAUUGACAAAA-3' (SEQ ID NO: 3236)

C5-1526 19 nt Target #1:
5'-CAUAUAUUGACAAAAUAAC-3' (SEQ ID NO: 2469)

C5-1526 19 nt Target #2:
5'-CCAUAUAUUGACAAAAUAA-3' (SEQ ID NO: 2853)

C5-1526 19 nt Target #3:
5'-CCCAUAUAUUGACAAAAUA-3' (SEQ ID NO: 3237)

C5-1527 19 nt Target #1:
5'-AUAUAUUGACAAAAUAACU-3' (SEQ ID NO: 2470)

C5-1527 19 nt Target #2:
5'-CAUAUAUUGACAAAAUAAC-3' (SEQ ID NO: 2854)

C5-1527 19 nt Target #3:
5'-CCAUAUAUUGACAAAAUAA-3' (SEQ ID NO: 3238)

C5-1528 19 nt Target #1:
5'-UAUAUUGACAAAAUAACUC-3' (SEQ ID NO: 2471)

C5-1528 19 nt Target #2:
5'-AUAUAUUGACAAAAUAACU-3' (SEQ ID NO: 2855)

C5-1528 19 nt Target #3:
5'-CAUAUAUUGACAAAAUAAC-3' (SEQ ID NO: 3239)

C5-1531 19 nt Target #1:
5'-AUUGACAAAAUAACUCACU-3' (SEQ ID NO: 2472)

C5-1531 19 nt Target #2:
5'-UAUUGACAAAAUAACUCAC-3' (SEQ ID NO: 2856)

C5-1531 19 nt Target #3:
5'-AUAUUGACAAAAUAACUCA-3' (SEQ ID NO: 3240)

C5-1533 19 nt Target #1:
5'-UGACAAAAUAACUCACUAU-3' (SEQ ID NO: 2473)

C5-1533 19 nt Target #2:
5'-UUGACAAAAUAACUCACUA-3' (SEQ ID NO: 2857)

TABLE 6-continued

DsiRNA Component 19 Nucleotide
Target Sequences in C5 mRNA

C5-1533 19 nt Target #3:
5'-AUUGACAAAAUAACUCACU-3' (SEQ ID NO: 3241)

C5-1534 19 nt Target #1:
5'-GACAAAAUAACUCACUAUA-3' (SEQ ID NO: 2474)

C5-1534 19 nt Target #2:
5'-UGACAAAAUAACUCACUAU-3' (SEQ ID NO: 2858)

C5-1534 19 nt Target #3:
5'-UUGACAAAAUAACUCACUA-3' (SEQ ID NO: 3242)

C5-1535 19 nt Target #1:
5'-ACAAAAUAACUCACUAUAA-3' (SEQ ID NO: 2475)

C5-1535 19 nt Target #2:
5'-GACAAAAUAACUCACUAUA-3' (SEQ ID NO: 2859)

C5-1535 19 nt Target #3:
5'-UGACAAAAUAACUCACUAU-3' (SEQ ID NO: 3243)

C5-1536 19 nt Target #1:
5'-CAAAAUAACUCACUAUAAU-3' (SEQ ID NO: 2476)

C5-1536 19 nt Target #2:
5'-ACAAAAUAACUCACUAUAA-3' (SEQ ID NO: 2860)

C5-1536 19 nt Target #3:
5'-GACAAAAUAACUCACUAUA-3' (SEQ ID NO: 3244)

C5-1537 19 nt Target #1:
5'-AAAAUAACUCACUAUAAUU-3' (SEQ ID NO: 2477)

C5-1537 19 nt Target #2:
5'-CAAAAUAACUCACUAUAAU-3' (SEQ ID NO: 2861)

C5-1537 19 nt Target #3:
5'-ACAAAAUAACUCACUAUAA-3' (SEQ ID NO: 3245)

C5-1538 19 nt Target #1:
5'-AAAUAACUCACUAUAAUUA-3' (SEQ ID NO: 2478)

C5-1538 19 nt Target #2:
5'-AAAAUAACUCACUAUAAUU-3' (SEQ ID NO: 2862)

C5-1538 19 nt Target #3:
5'-CAAAAUAACUCACUAUAAU-3' (SEQ ID NO: 3246)

C5-1539 19 nt Target #1:
5'-AAUAACUCACUAUAAUUAC-3' (SEQ ID NO: 2479)

C5-1539 19 nt Target #2:
5'-AAAUAACUCACUAUAAUUA-3' (SEQ ID NO: 2863)

C5-1539 19 nt Target #3:
5'-AAAAUAACUCACUAUAAUU-3' (SEQ ID NO: 3247)

C5-1540 19 nt Target #1:
5'-AUAACUCACUAUAAUUACU-3' (SEQ ID NO: 2480)

C5-1540 19 nt Target #2:
5'-AAUAACUCACUAUAAUUAC-3' (SEQ ID NO: 2864)

C5-1540 19 nt Target #3:
5'-AAAUAACUCACUAUAAUUA-3' (SEQ ID NO: 3248)

C5-1541 19 nt Target #1:
5'-UAACUCACUAUAAUUACUU-3' (SEQ ID NO: 2481)

C5-1541 19 nt Target #2:
5'-AUAACUCACUAUAAUUACU-3' (SEQ ID NO: 2865)

C5-1541 19 nt Target #3:
5'-AAUAACUCACUAUAAUUAC-3' (SEQ ID NO: 3249)

C5-1542 19 nt Target #1:
5'-AACUCACUAUAAUUACUUG-3' (SEQ ID NO: 2482)

C5-1542 19 nt Target #2:
5'-UAACUCACUAUAAUUACUU-3' (SEQ ID NO: 2866)

C5-1542 19 nt Target #3:
5'-AUAACUCACUAUAAUUACU-3' (SEQ ID NO: 3250)

C5-1543 19 nt Target #1:
5'-ACUCACUAUAAUUACUUGA-3' (SEQ ID NO: 2483)

C5-1543 19 nt Target #2:
5'-AACUCACUAUAAUUACUUG-3' (SEQ ID NO: 2867)

C5-1543 19 nt Target #3:
5'-UAACUCACUAUAAUUACUU-3' (SEQ ID NO: 3251)

C5-1544 19 nt Target #1:
5'-CUCACUAUAAUUACUUGAU-3' (SEQ ID NO: 2484)

C5-1544 19 nt Target #2:
5'-ACUCACUAUAAUUACUUGA-3' (SEQ ID NO: 2868)

C5-1544 19 nt Target #3:
5'-AACUCACUAUAAUUACUUG-3' (SEQ ID NO: 3252)

C5-1545 19 nt Target #1:
5'-UCACUAUAAUUACUUGAUU-3' (SEQ ID NO: 2485)

C5-1545 19 nt Target #2:
5'-CUCACUAUAAUUACUUGAU-3' (SEQ ID NO: 2869)

C5-1545 19 nt Target #3:
5'-ACUCACUAUAAUUACUUGA-3' (SEQ ID NO: 3253)

C5-1546 19 nt Target #1:
5'-CACUAUAAUUACUUGAUUU-3' (SEQ ID NO: 2486)

C5-1546 19 nt Target #2:
5'-UCACUAUAAUUACUUGAUU-3' (SEQ ID NO: 2870)

C5-1546 19 nt Target #3:
5'-CUCACUAUAAUUACUUGAU-3' (SEQ ID NO: 3254)

C5-1547 19 nt Target #1:
5'-ACUAUAAUUACUUGAUUUU-3' (SEQ ID NO: 2487)

C5-1547 19 nt Target #2:
5'-CACUAUAAUUACUUGAUUU-3' (SEQ ID NO: 2871)

C5-1547 19 nt Target #3:
5'-UCACUAUAAUUACUUGAUU-3' (SEQ ID NO: 3255)

C5-1548 19 nt Target #1:
5'-CUAUAAUUACUUGAUUUUA-3' (SEQ ID NO: 2488)

C5-1548 19 nt Target #2:
5'-ACUAUAAUUACUUGAUUUU-3' (SEQ ID NO: 2872)

C5-1548 19 nt Target #3:
5'-CACUAUAAUUACUUGAUUU-3' (SEQ ID NO: 3256)

C5-1549 19 nt Target #1:
5'-UAUAAUUACUUGAUUUUAU-3' (SEQ ID NO: 2489)

C5-1549 19 nt Target #2:
5'-CUAUAAUUACUUGAUUUUA-3' (SEQ ID NO: 2873)

C5-1549 19 nt Target #3:
5'-ACUAUAAUUACUUGAUUUU-3' (SEQ ID NO: 3257)

C5-1550 19 nt Target #1:
5'-AUAAUUACUUGAUUUUAUC-3' (SEQ ID NO: 2490)

TABLE 6-continued

DsiRNA Component 19 Nucleotide Target Sequences in C5 mRNA

C5-1550 19 nt Target #2:
5'-UAUAAUUACUUGAUUUUAU-3' (SEQ ID NO: 2874)

C5-1550 19 nt Target #3:
5'-CUAUAAUUACUUGAUUUUA-3' (SEQ ID NO: 3258)

C5-1551 19 nt Target #1:
5'-UAAUUACUUGAUUUUAUCC-3' (SEQ ID NO: 2491)

C5-1551 19 nt Target #2:
5'-AUAAUUACUUGAUUUUAUC-3' (SEQ ID NO: 2875)

C5-1551 19 nt Target #3:
5'-UAUAAUUACUUGAUUUUAU-3' (SEQ ID NO: 3259)

C5-1552 19 nt Target #1:
5'-AAUUACUUGAUUUUAUCCA-3' (SEQ ID NO: 2492)

C5-1552 19 nt Target #2:
5'-UAAUUACUUGAUUUUAUCC-3' (SEQ ID NO: 2876)

C5-1552 19 nt Target #3:
5'-AUAAUUACUUGAUUUUAUC-3' (SEQ ID NO: 3260)

C5-1553 19 nt Target #1:
5'-AUUACUUGAUUUUAUCCAA-3' (SEQ ID NO: 2493)

C5-1553 19 nt Target #2:
5'-AAUUACUUGAUUUUAUCCA-3' (SEQ ID NO: 2877)

C5-1553 19 nt Target #3:
5'-UAAUUACUUGAUUUUAUCC-3' (SEQ ID NO: 3261)

C5-1719 19 nt Target #1:
5'-GUCUGAUUCAGUCUGGUUA-3' (SEQ ID NO: 2494)

C5-1719 19 nt Target #2:
5'-UGUCUGAUUCAGUCUGGUU-3' (SEQ ID NO: 2878)

C5-1719 19 nt Target #3:
5'-GUGUCUGAUUCAGUCUGGU-3' (SEQ ID NO: 3262)

C5-1721 19 nt Target #1:
5'-CUGAUUCAGUCUGGUUAAA-3' (SEQ ID NO: 2495)

C5-1721 19 nt Target #2:
5'-UCUGAUUCAGUCUGGUUAA-3' (SEQ ID NO: 2879)

C5-1721 19 nt Target #3:
5'-GUCUGAUUCAGUCUGGUUA-3' (SEQ ID NO: 3263)

C5-1722 19 nt Target #1:
5'-UGAUUCAGUCUGGUUAAAU-3' (SEQ ID NO: 2496)

C5-1722 19 nt Target #2:
5'-CUGAUUCAGUCUGGUUAAA-3' (SEQ ID NO: 2880)

C5-1722 19 nt Target #3:
5'-UCUGAUUCAGUCUGGUUAA-3' (SEQ ID NO: 3264)

C5-1723 19 nt Target #1:
5'-GAUUCAGUCUGGUUAAAUA-3' (SEQ ID NO: 2497)

C5-1723 19 nt Target #2:
5'-UGAUUCAGUCUGGUUAAAU-3' (SEQ ID NO: 2881)

C5-1723 19 nt Target #3:
5'-CUGAUUCAGUCUGGUUAAA-3' (SEQ ID NO: 3265)

C5-1724 19 nt Target #1:
5'-AUUCAGUCUGGUUAAAUAU-3' (SEQ ID NO: 2498)

C5-1724 19 nt Target #2:
5'-GAUUCAGUCUGGUUAAAUA-3' (SEQ ID NO: 2882)

C5-1724 19 nt Target #3:
5'-UGAUUCAGUCUGGUUAAAU-3' (SEQ ID NO: 3266)

C5-1726 19 nt Target #1:
5'-UCAGUCUGGUUAAAUAUUG-3' (SEQ ID NO: 2499)

C5-1726 19 nt Target #2:
5'-UUCAGUCUGGUUAAAUAUU-3' (SEQ ID NO: 2883)

C5-1726 19 nt Target #3:
5'-AUUCAGUCUGGUUAAAUAU-3' (SEQ ID NO: 3267)

C5-1727 19 nt Target #1:
5'-CAGUCUGGUUAAAUAUUGA-3' (SEQ ID NO: 2500)

C5-1727 19 nt Target #2:
5'-UCAGUCUGGUUAAAUAUUG-3' (SEQ ID NO: 2884)

C5-1727 19 nt Target #3:
5'-UUCAGUCUGGUUAAAUAUU-3' (SEQ ID NO: 3268)

C5-1728 19 nt Target #1:
5'-AGUCUGGUUAAAUAUUGAA-3' (SEQ ID NO: 2501)

C5-1728 19 nt Target #2:
5'-CAGUCUGGUUAAAUAUUGA-3' (SEQ ID NO: 2885)

C5-1728 19 nt Target #3:
5'-UCAGUCUGGUUAAAUAUUG-3' (SEQ ID NO: 3269)

C5-1729 19 nt Target #1:
5'-GUCUGGUUAAAUAUUGAAG-3' (SEQ ID NO: 2502)

C5-1729 19 nt Target #2:
5'-AGUCUGGUUAAAUAUUGAA-3' (SEQ ID NO: 2886)

C5-1729 19 nt Target #3:
5'-CAGUCUGGUUAAAUAUUGA-3' (SEQ ID NO: 3270)

C5-1730 19 nt Target #1:
5'-UCUGGUUAAAUAUUGAAGA-3' (SEQ ID NO: 2503)

C5-1730 19 nt Target #2:
5'-GUCUGGUUAAAUAUUGAAG-3' (SEQ ID NO: 2887)

C5-1730 19 nt Target #3:
5'-AGUCUGGUUAAAUAUUGAA-3' (SEQ ID NO: 3271)

C5-1731 19 nt Target #1:
5'-CUGGUUAAAUAUUGAAGAA-3' (SEQ ID NO: 2504)

C5-1731 19 nt Target #2:
5'-UCUGGUUAAAUAUUGAAGA-3' (SEQ ID NO: 2888)

C5-1731 19 nt Target #3:
5'-GUCUGGUUAAAUAUUGAAG-3' (SEQ ID NO: 3272)

C5-1732 19 nt Target #1:
5'-UGGUUAAAUAUUGAAGAAA-3' (SEQ ID NO: 2505)

C5-1732 19 nt Target #2:
5'-CUGGUUAAAUAUUGAAGAA-3' (SEQ ID NO: 2889)

C5-1732 19 nt Target #3:
5'-UCUGGUUAAAUAUUGAAGA-3' (SEQ ID NO: 3273)

C5-1733 19 nt Target #1:
5'-GGUUAAAUAUUGAAGAAAA-3' (SEQ ID NO: 2506)

C5-1733 19 nt Target #2:
5'-UGGUUAAAUAUUGAAGAAA-3' (SEQ ID NO: 2890)

C5-1733 19 nt Target #3:
5'-CUGGUUAAAUAUUGAAGAA-3' (SEQ ID NO: 3274)

C5-1753 19 nt Target #1:
5'-UGUGGCAACCAGCUCCAGG-3' (SEQ ID NO: 2507)

TABLE 6-continued

DsiRNA Component 19 Nucleotide
Target Sequences in C5 mRNA

C5-1753 19 nt Target #2:
5'-AUGUGGCAACCAGCUCCAG-3' (SEQ ID NO: 2891)

C5-1753 19 nt Target #3:
5'-AAUGUGGCAACCAGCUCCA-3' (SEQ ID NO: 3275)

C5-1754 19 nt Target #1:
5'-GUGGCAACCAGCUCCAGGU-3' (SEQ ID NO: 2508)

C5-1754 19 nt Target #2:
5'-UGUGGCAACCAGCUCCAGG-3' (SEQ ID NO: 2892)

C5-1754 19 nt Target #3:
5'-AUGUGGCAACCAGCUCCAG-3' (SEQ ID NO: 3276)

C5-1948 19 nt Target #1:
5'-CUGGGCUGUGGGGCAGGUG-3' (SEQ ID NO: 2509)

C5-1948 19 nt Target #2:
5'-UCUGGGCUGUGGGGCAGGU-3' (SEQ ID NO: 2893)

C5-1948 19 nt Target #3:
5'-AUCUGGGCUGUGGGGCAGG-3' (SEQ ID NO: 3277)

C5-1949 19 nt Target #1:
5'-UGGGCUGUGGGGCAGGUGG-3' (SEQ ID NO: 2510)

C5-1949 19 nt Target #2:
5'-CUGGGCUGUGGGGCAGGUG-3' (SEQ ID NO: 2894)

C5-1949 19 nt Target #3:
5'-UCUGGGCUGUGGGGCAGGU-3' (SEQ ID NO: 3278)

C5-1950 19 nt Target #1:
5'-GGGCUGUGGGGCAGGUGGU-3' (SEQ ID NO: 2511)

C5-1950 19 nt Target #2:
5'-UGGGCUGUGGGGCAGGUGG-3' (SEQ ID NO: 2895)

C5-1950 19 nt Target #3:
5'-CUGGGCUGUGGGGCAGGUG-3' (SEQ ID NO: 3279)

C5-1951 19 nt Target #1:
5'-GGCUGUGGGGCAGGUGGUG-3' (SEQ ID NO: 2512)

C5-1951 19 nt Target #2:
5'-GGGCUGUGGGGCAGGUGGU-3' (SEQ ID NO: 2896)

C5-1951 19 nt Target #3:
5'-UGGGCUGUGGGGCAGGUGG-3' (SEQ ID NO: 3280)

C5-1952 19 nt Target #1:
5'-GCUGUGGGGCAGGUGGUGG-3' (SEQ ID NO: 2513)

C5-1952 19 nt Target #2:
5'-GGCUGUGGGGCAGGUGGUG-3' (SEQ ID NO: 2897)

C5-1952 19 nt Target #3:
5'-GGGCUGUGGGGCAGGUGGU-3' (SEQ ID NO: 3281)

C5-1953 19 nt Target #1:
5'-CUGUGGGGCAGGUGGUGGC-3' (SEQ ID NO: 2514)

C5-1953 19 nt Target #2:
5'-GCUGUGGGGCAGGUGGUGG-3' (SEQ ID NO: 2898)

C5-1953 19 nt Target #3:
5'-GGCUGUGGGGCAGGUGGUG-3' (SEQ ID NO: 3282)

C5-1954 19 nt Target #1:
5'-UGUGGGGCAGGUGGUGGCC-3' (SEQ ID NO: 2515)

C5-1954 19 nt Target #2:
5'-CUGUGGGGCAGGUGGUGGC-3' (SEQ ID NO: 2899)

TABLE 6-continued

DsiRNA Component 19 Nucleotide
Target Sequences in C5 mRNA

C5-1954 19 nt Target #3:
5'-GCUGUGGGGCAGGUGGUGG-3' (SEQ ID NO: 3283)

C5-2043 19 nt Target #1:
5'-AGAAAAUGAUGAACCUUGU-3' (SEQ ID NO: 2516)

C5-2043 19 nt Target #2:
5'-AAGAAAAUGAUGAACCUUG-3' (SEQ ID NO: 2900)

C5-2043 19 nt Target #3:
5'-CAAGAAAAUGAUGAACCUU-3' (SEQ ID NO: 3284)

C5-2048 19 nt Target #1:
5'-AUGAUGAACCUUGUAAAGA-3' (SEQ ID NO: 2517)

C5-2048 19 nt Target #2:
5'-AAUGAUGAACCUUGUAAAG-3' (SEQ ID NO: 2901)

C5-2048 19 nt Target #3:
5'-AAAUGAUGAACCUUGUAAA-3' (SEQ ID NO: 3285)

C5-2050 19 nt Target #1:
5'-GAUGAACCUUGUAAAGAAA-3' (SEQ ID NO: 2518)

C5-2050 19 nt Target #2:
5'-UGAUGAACCUUGUAAAGAA-3' (SEQ ID NO: 2902)

C5-2050 19 nt Target #3:
5'-AUGAUGAACCUUGUAAAGA-3' (SEQ ID NO: 3286)

C5-2051 19 nt Target #1:
5'-AUGAACCUUGUAAAGAAAU-3' (SEQ ID NO: 2519)

C5-2051 19 nt Target #2:
5'-GAUGAACCUUGUAAAGAAA-3' (SEQ ID NO: 2903)

C5-2051 19 nt Target #3:
5'-UGAUGAACCUUGUAAAGAA-3' (SEQ ID NO: 3287)

C5-2057 19 nt Target #1:
5'-CUUGUAAAGAAAUUCUCAG-3' (SEQ ID NO: 2520)

C5-2057 19 nt Target #2:
5'-CCUUGUAAAGAAAUUCUCA-3' (SEQ ID NO: 2904)

C5-2057 19 nt Target #3:
5'-ACCUUGUAAAGAAAUUCUC-3' (SEQ ID NO: 3288)

C5-2058 19 nt Target #1:
5'-UUGUAAAGAAAUUCUCAGG-3' (SEQ ID NO: 2521)

C5-2058 19 nt Target #2:
5'-CUUGUAAAGAAAUUCUCAG-3' (SEQ ID NO: 2905)

C5-2058 19 nt Target #3:
5'-CCUUGUAAAGAAAUUCUCA-3' (SEQ ID NO: 3289)

C5-2133 19 nt Target #1:
5'-AGUAGUGAAGAAAUGUUGU-3' (SEQ ID NO: 2522)

C5-2133 19 nt Target #2:
5'-CAGUAGUGAAGAAAUGUUG-3' (SEQ ID NO: 2906)

C5-2133 19 nt Target #3:
5'-UCAGUAGUGAAGAAAUGUU-3' (SEQ ID NO: 3290)

C5-2134 19 nt Target #1:
5'-GUAGUGAAGAAAUGUUGUG-3' (SEQ ID NO: 2523)

C5-2134 19 nt Target #2:
5'-AGUAGUGAAGAAAUGUUGU-3' (SEQ ID NO: 2907)

C5-2134 19 nt Target #3:
5'-CAGUAGUGAAGAAAUGUUG-3' (SEQ ID NO: 3291)

TABLE 6-continued

DsiRNA Component 19 Nucleotide
Target Sequences in C5 mRNA

C5-2316 19 nt Target #1:
5'-GAAGACCCUGUUACCAGUA-3' (SEQ ID NO: 2524)

C5-2316 19 nt Target #2:
5'-UGAAGACCCUGUUACCAGU-3' (SEQ ID NO: 2908)

C5-2316 19 nt Target #3:
5'-AUGAAGACCCUGUUACCAG-3' (SEQ ID NO: 3292)

C5-2337 19 nt Target #1:
5'-CAAGCCAGAAAUUCGGAGU-3' (SEQ ID NO: 2525)

C5-2337 19 nt Target #2:
5'-GCAAGCCAGAAAUUCGGAG-3' (SEQ ID NO: 2909)

C5-2337 19 nt Target #3:
5'-AGCAAGCCAGAAAUUCGGA-3' (SEQ ID NO: 3293)

C5-2498 19 nt Target #1:
5'-UCAAGGCAAAGGUGUUCAA-3' (SEQ ID NO: 2526)

C5-2498 19 nt Target #2:
5'-GUCAAGGCAAAGGUGUUCA-3' (SEQ ID NO: 2910)

C5-2498 19 nt Target #3:
5'-UGUCAAGGCAAAGGUGUUC-3' (SEQ ID NO: 3294)

C5-2499 19 nt Target #1:
5'-CAAGGCAAAGGUGUUCAAA-3' (SEQ ID NO: 2527)

C5-2499 19 nt Target #2:
5'-UCAAGGCAAAGGUGUUCAA-3' (SEQ ID NO: 2911)

C5-2499 19 nt Target #3:
5'-GUCAAGGCAAAGGUGUUCA-3' (SEQ ID NO: 3295)

C5-2500 19 nt Target #1:
5'-AAGGCAAAGGUGUUCAAAG-3' (SEQ ID NO: 2528)

C5-2500 19 nt Target #2:
5'-CAAGGCAAAGGUGUUCAAA-3' (SEQ ID NO: 2912)

C5-2500 19 nt Target #3:
5'-UCAAGGCAAAGGUGUUCAA-3' (SEQ ID NO: 3296)

C5-2501 19 nt Target #1:
5'-AGGCAAAGGUGUUCAAAGA-3' (SEQ ID NO: 2529)

C5-2501 19 nt Target #2:
5'-AAGGCAAAGGUGUUCAAAG-3' (SEQ ID NO: 2913)

C5-2501 19 nt Target #3:
5'-CAAGGCAAAGGUGUUCAAA-3' (SEQ ID NO: 3297)

C5-2518 19 nt Target #1:
5'-GAUGUCUUCCUGGAAAUGA-3' (SEQ ID NO: 2530)

C5-2518 19 nt Target #2:
5'-AGAUGUCUUCCUGGAAAUG-3' (SEQ ID NO: 2914)

C5-2518 19 nt Target #3:
5'-AAGAUGUCUUCCUGGAAAU-3' (SEQ ID NO: 3298)

C5-2527 19 nt Target #1:
5'-CUGGAAAUGAAUAUACCAU-3' (SEQ ID NO: 2531)

C5-2527 19 nt Target #2:
5'-CCUGGAAAUGAAUAUACCA-3' (SEQ ID NO: 2915)

C5-2527 19 nt Target #3:
5'-UCCUGGAAAUGAAUAUACC-3' (SEQ ID NO: 3299)

C5-2528 19 nt Target #1:
5'-UGGAAAUGAAUAUACCAUA-3' (SEQ ID NO: 2532)

C5-2528 19 nt Target #2:
5'-CUGGAAAUGAAUAUACCAU-3' (SEQ ID NO: 2916)

C5-2528 19 nt Target #3:
5'-CCUGGAAAUGAAUAUACCA-3' (SEQ ID NO: 3300)

C5-2529 19 nt Target #1:
5'-GGAAAUGAAUAUACCAUAU-3' (SEQ ID NO: 2533)

C5-2529 19 nt Target #2:
5'-UGGAAAUGAAUAUACCAUA-3' (SEQ ID NO: 2917)

C5-2529 19 nt Target #3:
5'-CUGGAAAUGAAUAUACCAU-3' (SEQ ID NO: 3301)

C5-2530 19 nt Target #1:
5'-GAAAUGAAUAUACCAUAUU-3' (SEQ ID NO: 2534)

C5-2530 19 nt Target #2:
5'-GGAAAUGAAUAUACCAUAU-3' (SEQ ID NO: 2918)

C5-2530 19 nt Target #3:
5'-UGGAAAUGAAUAUACCAUA-3' (SEQ ID NO: 3302)

C5-2531 19 nt Target #1:
5'-AAAUGAAUAUACCAUAUUC-3' (SEQ ID NO: 2535)

C5-2531 19 nt Target #2:
5'-GAAAUGAAUAUACCAUAUU-3' (SEQ ID NO: 2919)

C5-2531 19 nt Target #3:
5'-GGAAAUGAAUAUACCAUAU-3' (SEQ ID NO: 3303)

C5-2532 19 nt Target #1:
5'-AAUGAAUAUACCAUAUUCU-3' (SEQ ID NO: 2536)

C5-2532 19 nt Target #2:
5'-AAAUGAAUAUACCAUAUUC-3' (SEQ ID NO: 2920)

C5-2532 19 nt Target #3:
5'-GAAAUGAAUAUACCAUAUU-3' (SEQ ID NO: 3304)

C5-2533 19 nt Target #1:
5'-AUGAAUAUACCAUAUUCUG-3' (SEQ ID NO: 2537)

C5-2533 19 nt Target #2:
5'-AAUGAAUAUACCAUAUUCU-3' (SEQ ID NO: 2921)

C5-2533 19 nt Target #3:
5'-AAAUGAAUAUACCAUAUUC-3' (SEQ ID NO: 3305)

C5-2534 19 nt Target #1:
5'-UGAAUAUACCAUAUUCUG-3' (SEQ ID NO: 2538)

C5-2534 19 nt Target #2:
5'-AUGAAUAUACCAUAUUCUG-3' (SEQ ID NO: 2922)

C5-2534 19 nt Target #3:
5'-AAUGAAUAUACCAUAUUCU-3' (SEQ ID NO: 3306)

C5-2535 19 nt Target #1:
5'-GAAUAUACCAUAUUCUGUU-3' (SEQ ID NO: 2539)

C5-2535 19 nt Target #2:
5'-UGAAUAUACCAUAUUCUGU-3' (SEQ ID NO: 2923)

C5-2535 19 nt Target #3:
5'-AUGAAUAUACCAUAUUCUG-3' (SEQ ID NO: 3307)

C5-2536 19 nt Target #1:
5'-AAUAUACCAUAUUCUGUUG-3' (SEQ ID NO: 2540)

C5-2536 19 nt Target #2:
5'-GAAUAUACCAUAUUCUGUU-3' (SEQ ID NO: 2924)

TABLE 6-continued

DsiRNA Component 19 Nucleotide Target Sequences in C5 mRNA

C5-2536 19 nt Target #3:
5'-UGAAUAUACCAUAUUCUGU-3' (SEQ ID NO: 3308)

C5-2537 19 nt Target #1:
5'-AUAUACCAUAUUCUGUUGU-3' (SEQ ID NO: 2541)

C5-2537 19 nt Target #2:
5'-AAUAUACCAUAUUCUGUUG-3' (SEQ ID NO: 2925)

C5-2537 19 nt Target #3:
5'-GAAUAUACCAUAUUCUGUU-3' (SEQ ID NO: 3309)

C5-2557 19 nt Target #1:
5'-CGAGGAGAACAGAUCCAAU-3' (SEQ ID NO: 2542)

C5-2557 19 nt Target #2:
5'-ACGAGGAGAACAGAUCCAA-3' (SEQ ID NO: 2926)

C5-2557 19 nt Target #3:
5'-UACGAGGAGAACAGAUCCA-3' (SEQ ID NO: 3310)

C5-2558 19 nt Target #1:
5'-GAGGAGAACAGAUCCAAUU-3' (SEQ ID NO: 2543)

C5-2558 19 nt Target #2:
5'-CGAGGAGAACAGAUCCAAU-3' (SEQ ID NO: 2927)

C5-2558 19 nt Target #3:
5'-ACGAGGAGAACAGAUCCAA-3' (SEQ ID NO: 3311)

C5-2559 19 nt Target #1:
5'-AGGAGAACAGAUCCAAUUG-3' (SEQ ID NO: 2544)

C5-2559 19 nt Target #2:
5'-GAGGAGAACAGAUCCAAUU-3' (SEQ ID NO: 2928)

C5-2559 19 nt Target #3:
5'-CGAGGAGAACAGAUCCAAU-3' (SEQ ID NO: 3312)

C5-2560 19 nt Target #1:
5'-GGAGAACAGAUCCAAUUGA-3' (SEQ ID NO: 2545)

C5-2560 19 nt Target #2:
5'-AGGAGAACAGAUCCAAUUG-3' (SEQ ID NO: 2929)

C5-2560 19 nt Target #3:
5'-GAGGAGAACAGAUCCAAUU-3' (SEQ ID NO: 3313)

C5-2561 19 nt Target #1:
5'-GAGAACAGAUCCAAUUGAA-3' (SEQ ID NO: 2546)

C5-2561 19 nt Target #2:
5'-GGAGAACAGAUCCAAUUGA-3' (SEQ ID NO: 2930)

C5-2561 19 nt Target #3:
5'-AGGAGAACAGAUCCAAUUG-3' (SEQ ID NO: 3314)

C5-2562 19 nt Target #1:
5'-AGAACAGAUCCAAUUGAAA-3' (SEQ ID NO: 2547)

C5-2562 19 nt Target #2:
5'-GAGAACAGAUCCAAUUGAA-3' (SEQ ID NO: 2931)

C5-2562 19 nt Target #3:
5'-GGAGAACAGAUCCAAUUGA-3' (SEQ ID NO: 3315)

C5-2563 19 nt Target #1:
5'-GAACAGAUCCAAUUGAAAG-3' (SEQ ID NO: 2548)

C5-2563 19 nt Target #2:
5'-AGAACAGAUCCAAUUGAAA-3' (SEQ ID NO: 2932)

C5-2563 19 nt Target #3:
5'-GAGAACAGAUCCAAUUGAA-3' (SEQ ID NO: 3316)

C5-2564 19 nt Target #1:
5'-AACAGAUCCAAUUGAAAGG-3' (SEQ ID NO: 2549)

C5-2564 19 nt Target #2:
5'-GAACAGAUCCAAUUGAAAG-3' (SEQ ID NO: 2933)

C5-2564 19 nt Target #3:
5'-AGAACAGAUCCAAUUGAAA-3' (SEQ ID NO: 3317)

C5-2565 19 nt Target #1:
5'-ACAGAUCCAAUUGAAAGGA-3' (SEQ ID NO: 2550)

C5-2565 19 nt Target #2:
5'-AACAGAUCCAAUUGAAAGG-3' (SEQ ID NO: 2934)

C5-2565 19 nt Target #3:
5'-GAACAGAUCCAAUUGAAAG-3' (SEQ ID NO: 3318)

C5-2566 19 nt Target #1:
5'-CAGAUCCAAUUGAAAGGAA-3' (SEQ ID NO: 2551)

C5-2566 19 nt Target #2:
5'-ACAGAUCCAAUUGAAAGGA-3' (SEQ ID NO: 2935)

C5-2566 19 nt Target #3:
5'-AACAGAUCCAAUUGAAAGG-3' (SEQ ID NO: 3319)

C5-2567 19 nt Target #1:
5'-AGAUCCAAUUGAAAGGAAC-3' (SEQ ID NO: 2552)

C5-2567 19 nt Target #2:
5'-CAGAUCCAAUUGAAAGGAA-3' (SEQ ID NO: 2936)

C5-2567 19 nt Target #3:
5'-ACAGAUCCAAUUGAAAGGA-3' (SEQ ID NO: 3320)

C5-2568 19 nt Target #1:
5'-GAUCCAAUUGAAAGGAACU-3' (SEQ ID NO: 2553)

C5-2568 19 nt Target #2:
5'-AGAUCCAAUUGAAAGGAAC-3' (SEQ ID NO: 2937)

C5-2568 19 nt Target #3:
5'-CAGAUCCAAUUGAAAGGAA-3' (SEQ ID NO: 3321)

C5-2569 19 nt Target #1:
5'-AUCCAAUUGAAAGGAACUG-3' (SEQ ID NO: 2554)

C5-2569 19 nt Target #2:
5'-GAUCCAAUUGAAAGGAACU-3' (SEQ ID NO: 2938)

C5-2569 19 nt Target #3:
5'-AGAUCCAAUUGAAAGGAAC-3' (SEQ ID NO: 3322)

C5-2570 19 nt Target #1:
5'-UCCAAUUGAAAGGAACUGU-3' (SEQ ID NO: 2555)

C5-2570 19 nt Target #2:
5'-AUCCAAUUGAAAGGAACUG-3' (SEQ ID NO: 2939)

C5-2570 19 nt Target #3:
5'-GAUCCAAUUGAAAGGAACU-3' (SEQ ID NO: 3323)

C5-2571 19 nt Target #1:
5'-CCAAUUGAAAGGAACUGUU-3' (SEQ ID NO: 2556)

C5-2571 19 nt Target #2:
5'-UCCAAUUGAAAGGAACUGU-3' (SEQ ID NO: 2940)

C5-2571 19 nt Target #3:
5'-AUCCAAUUGAAAGGAACUG-3' (SEQ ID NO: 3324)

C5-2572 19 nt Target #1:
5'-CAAUUGAAAGGAACUGUUU-3' (SEQ ID NO: 2557)

TABLE 6-continued

DsiRNA Component 19 Nucleotide Target Sequences in C5 mRNA

C5-2572 19 nt Target #2:
5'-CCAAUUGAAAGGAACUGUU-3' (SEQ ID NO: 2941)

C5-2572 19 nt Target #3:
5'-UCCAAUUGAAAGGAACUGU-3' (SEQ ID NO: 3325)

C5-2573 19 nt Target #1:
5'-AAUUGAAAGGAACUGUUUA-3' (SEQ ID NO: 2558)

C5-2573 19 nt Target #2:
5'-CAAUUGAAAGGAACUGUUU-3' (SEQ ID NO: 2942)

C5-2573 19 nt Target #3:
5'-CCAAUUGAAAGGAACUGUU-3' (SEQ ID NO: 3326)

C5-2574 19 nt Target #1:
5'-AUUGAAAGGAACUGUUUAC-3' (SEQ ID NO: 2559)

C5-2574 19 nt Target #2:
5'-AAUUGAAAGGAACUGUUUA-3' (SEQ ID NO: 2943)

C5-2574 19 nt Target #3:
5'-CAAUUGAAAGGAACUGUUU-3' (SEQ ID NO: 3327)

C5-2575 19 nt Target #1:
5'-UUGAAAGGAACUGUUUACA-3' (SEQ ID NO: 2560)

C5-2575 19 nt Target #2:
5'-AUUGAAAGGAACUGUUUAC-3' (SEQ ID NO: 2944)

C5-2575 19 nt Target #3:
5'-AAUUGAAAGGAACUGUUUA-3' (SEQ ID NO: 3328)

C5-2576 19 nt Target #1:
5'-UGAAAGGAACUGUUUACAA-3' (SEQ ID NO: 2561)

C5-2576 19 nt Target #2:
5'-UUGAAAGGAACUGUUUACA-3' (SEQ ID NO: 2945)

C5-2576 19 nt Target #3:
5'-AUUGAAAGGAACUGUUUAC-3' (SEQ ID NO: 3329)

C5-2577 19 nt Target #1:
5'-GAAAGGAACUGUUUACAAC-3' (SEQ ID NO: 2562)

C5-2577 19 nt Target #2:
5'-UGAAAGGAACUGUUUACAA-3' (SEQ ID NO: 2946)

C5-2577 19 nt Target #3:
5'-UUGAAAGGAACUGUUUACA-3' (SEQ ID NO: 3330)

C5-2578 19 nt Target #1:
5'-AAAGGAACUGUUUACAACU-3' (SEQ ID NO: 2563)

C5-2578 19 nt Target #2:
5'-GAAAGGAACUGUUUACAAC-3' (SEQ ID NO: 2947)

C5-2578 19 nt Target #3:
5'-UGAAAGGAACUGUUUACAA-3' (SEQ ID NO: 3331)

C5-2579 19 nt Target #1:
5'-AAGGAACUGUUUACAACUA-3' (SEQ ID NO: 2564)

C5-2579 19 nt Target #2:
5'-AAAGGAACUGUUUACAACU-3' (SEQ ID NO: 2948)

C5-2579 19 nt Target #3:
5'-GAAAGGAACUGUUUACAAC-3' (SEQ ID NO: 3332)

C5-2580 19 nt Target #1:
5'-AGGAACUGUUUACAACUAU-3' (SEQ ID NO: 2565)

C5-2580 19 nt Target #2:
5'-AAGGAACUGUUUACAACUA-3' (SEQ ID NO: 2949)

C5-2580 19 nt Target #3:
5'-AAAGGAACUGUUUACAACU-3' (SEQ ID NO: 3333)

C5-2581 19 nt Target #1:
5'-GGAACUGUUUACAACUAUA-3' (SEQ ID NO: 2566)

C5-2581 19 nt Target #2:
5'-AGGAACUGUUUACAACUAU-3' (SEQ ID NO: 2950)

C5-2581 19 nt Target #3:
5'-AAGGAACUGUUUACAACUA-3' (SEQ ID NO: 3334)

C5-2623 19 nt Target #1:
5'-GUUAAAAUGUCUGCUGUGG-3' (SEQ ID NO: 2567)

C5-2623 19 nt Target #2:
5'-UGUUAAAAUGUCUGCUGUG-3' (SEQ ID NO: 2951)

C5-2623 19 nt Target #3:
5'-GUGUUAAAAUGUCUGCUGU-3' (SEQ ID NO: 3335)

C5-2624 19 nt Target #1:
5'-UUAAAAUGUCUGCUGUGGA-3' (SEQ ID NO: 2568)

C5-2624 19 nt Target #2:
5'-GUUAAAAUGUCUGCUGUGG-3' (SEQ ID NO: 2952)

C5-2624 19 nt Target #3:
5'-UGUUAAAAUGUCUGCUGUG-3' (SEQ ID NO: 3336)

C5-2625 19 nt Target #1:
5'-UAAAAUGUCUGCUGUGGAG-3' (SEQ ID NO: 2569)

C5-2625 19 nt Target #2:
5'-UUAAAAUGUCUGCUGUGGA-3' (SEQ ID NO: 2953)

C5-2625 19 nt Target #3:
5'-GUUAAAAUGUCUGCUGUGG-3' (SEQ ID NO: 3337)

C5-2626 19 nt Target #1:
5'-AAAAUGUCUGCUGUGGAGG-3' (SEQ ID NO: 2570)

C5-2626 19 nt Target #2:
5'-UAAAAUGUCUGCUGUGGAG-3' (SEQ ID NO: 2954)

C5-2626 19 nt Target #3:
5'-UUAAAAUGUCUGCUGUGGA-3' (SEQ ID NO: 3338)

C5-2627 19 nt Target #1:
5'-AAAUGUCUGCUGUGGAGGG-3' (SEQ ID NO: 2571)

C5-2627 19 nt Target #2:
5'-AAAAUGUCUGCUGUGGAGG-3' (SEQ ID NO: 2955)

C5-2627 19 nt Target #3:
5'-UAAAAUGUCUGCUGUGGAG-3' (SEQ ID NO: 3339)

C5-2753 19 nt Target #1:
5'-UGCUUCCUCUGGAAAUUGG-3' (SEQ ID NO: 2572)

C5-2753 19 nt Target #2:
5'-GUGCUUCCUCUGGAAAUUG-3' (SEQ ID NO: 2956)

C5-2753 19 nt Target #3:
5'-UGUGCUUCCUCUGGAAAUU-3' (SEQ ID NO: 3340)

C5-2754 19 nt Target #1:
5'-GCUUCCUCUGGAAAUUGGC-3' (SEQ ID NO: 2573)

C5-2754 19 nt Target #2:
5'-UGCUUCCUCUGGAAAUUGG-3' (SEQ ID NO: 2957)

C5-2754 19 nt Target #3:
5'-GUGCUUCCUCUGGAAAUUG-3' (SEQ ID NO: 3341)

TABLE 6-continued

DsiRNA Component 19 Nucleotide Target Sequences in C5 mRNA

C5-2755 19 nt Target #1:
5'-CUUCCUCUGGAAAUUGGCC-3' (SEQ ID NO: 2574)

C5-2755 19 nt Target #2:
5'-GCUUCCUCUGGAAAUUGGC-3' (SEQ ID NO: 2958)

C5-2755 19 nt Target #3:
5'-UGCUUCCUCUGGAAAUUGG-3' (SEQ ID NO: 3342)

C5-2756 19 nt Target #1:
5'-UUCCUCUGGAAAUUGGCCU-3' (SEQ ID NO: 2575)

C5-2756 19 nt Target #2:
5'-CUUCCUCUGGAAAUUGGCC-3' (SEQ ID NO: 2959)

C5-2756 19 nt Target #3:
5'-GCUUCCUCUGGAAAUUGGC-3' (SEQ ID NO: 3343)

C5-2757 19 nt Target #1:
5'-UCCUCUGGAAAUUGGCCUU-3' (SEQ ID NO: 2576)

C5-2757 19 nt Target #2:
5'-UUCCUCUGGAAAUUGGCCU-3' (SEQ ID NO: 2960)

C5-2757 19 nt Target #3:
5'-CUUCCUCUGGAAAUUGGCC-3' (SEQ ID NO: 3344)

C5-2758 19 nt Target #1:
5'-CCUCUGGAAAUUGGCCUUC-3' (SEQ ID NO: 2577)

C5-2758 19 nt Target #2:
5'-UCCUCUGGAAAUUGGCCUU-3' (SEQ ID NO: 2961)

C5-2758 19 nt Target #3:
5'-UUCCUCUGGAAAUUGGCCU-3' (SEQ ID NO: 3345)

C5-2759 19 nt Target #1:
5'-CUCUGGAAAUUGGCCUUCA-3' (SEQ ID NO: 2578)

C5-2759 19 nt Target #2:
5'-CCUCUGGAAAUUGGCCUUC-3' (SEQ ID NO: 2962)

C5-2759 19 nt Target #3:
5'-UCCUCUGGAAAUUGGCCUU-3' (SEQ ID NO: 3346)

C5-2760 19 nt Target #1:
5'-UCUGGAAAUUGGCCUUCAC-3' (SEQ ID NO: 2579)

C5-2760 19 nt Target #2:
5'-CUCUGGAAAUUGGCCUUCA-3' (SEQ ID NO: 2963)

C5-2760 19 nt Target #3:
5'-CCUCUGGAAAUUGGCCUUC-3' (SEQ ID NO: 3347)

C5-2967 19 nt Target #1:
5'-AGAAAUCAAAGGAUUUUG-3' (SEQ ID NO: 2580)

C5-2967 19 nt Target #2:
5'-CAGAAAUCAAAGGAUUUU-3' (SEQ ID NO: 2964)

C5-2967 19 nt Target #3:
5'-ACAGAAAUCAAAGGAUUU-3' (SEQ ID NO: 3348)

C5-2968 19 nt Target #1:
5'-GAAAUCAAAGGAUUUUGA-3' (SEQ ID NO: 2581)

C5-2968 19 nt Target #2:
5'-AGAAAUCAAAGGAUUUUG-3' (SEQ ID NO: 2965)

C5-2968 19 nt Target #3:
5'-CAGAAAUCAAAGGAUUUU-3' (SEQ ID NO: 3349)

C5-2973 19 nt Target #1:
5'-CAAAAGGAUUUUGAGUGUA-3' (SEQ ID NO: 2582)

C5-2973 19 nt Target #2:
5'-UCAAAAGGAUUUUGAGUGU-3' (SEQ ID NO: 2966)

C5-2973 19 nt Target #3:
5'-AUCAAAAGGAUUUUGAGUG-3' (SEQ ID NO: 3350)

C5-3049 19 nt Target #1:
5'-AUCCUAACCCACCUCCCCA-3' (SEQ ID NO: 2583)

C5-3049 19 nt Target #2:
5'-UAUCCUAACCCACCUCCCC-3' (SEQ ID NO: 2967)

C5-3049 19 nt Target #3:
5'-AUAUCCUAACCCACCUCCC-3' (SEQ ID NO: 3351)

C5-3050 19 nt Target #1:
5'-UCCUAACCCACCUCCCCAA-3' (SEQ ID NO: 2584)

C5-3050 19 nt Target #2:
5'-AUCCUAACCCACCUCCCCA-3' (SEQ ID NO: 2968)

C5-3050 19 nt Target #3:
5'-UAUCCUAACCCACCUCCCC-3' (SEQ ID NO: 3352)

C5-3103 19 nt Target #1:
5'-CCAGUAUUCUAUGUUUUC-3' (SEQ ID NO: 2585)

C5-3103 19 nt Target #2:
5'-CCCAGUAUUCUAUGUUUU-3' (SEQ ID NO: 2969)

C5-3103 19 nt Target #3:
5'-UCCCAGUAUUCUAUGUUUU-3' (SEQ ID NO: 3353)

C5-3135 19 nt Target #1:
5'-AGGAAAUCAUUGGAACAUU-3' (SEQ ID NO: 2586)

C5-3135 19 nt Target #2:
5'-CAGGAAAUCAUUGGAACAU-3' (SEQ ID NO: 2970)

C5-3135 19 nt Target #3:
5'-ACAGGAAAUCAUUGGAACA-3' (SEQ ID NO: 3354)

C5-3136 19 nt Target #1:
5'-GGAAAUCAUUGGAACAUUU-3' (SEQ ID NO: 2587)

C5-3136 19 nt Target #2:
5'-AGGAAAUCAUUGGAACAUU-3' (SEQ ID NO: 2971)

C5-3136 19 nt Target #3:
5'-CAGGAAAUCAUUGGAACAU-3' (SEQ ID NO: 3355)

C5-3216 19 nt Target #1:
5'-GAGCAUUAUGUCCUACAGA-3' (SEQ ID NO: 2588)

C5-3216 19 nt Target #2:
5'-UGAGCAUUAUGUCCUACAG-3' (SEQ ID NO: 2972)

C5-3216 19 nt Target #3:
5'-UUGAGCAUUAUGUCCUACA-3' (SEQ ID NO: 3356)

C5-3281 19 nt Target #1:
5'-CUUGGUUAACAGCUUUUGC-3' (SEQ ID NO: 2589)

C5-3281 19 nt Target #2:
5'-ACUUGGUUAACAGCUUUUG-3' (SEQ ID NO: 2973)

C5-3281 19 nt Target #3:
5'-CACUUGGUUAACAGCUUUU-3' (SEQ ID NO: 3357)

C5-3284 19 nt Target #1:
5'-GGUUAACAGCUUUUGCUUU-3' (SEQ ID NO: 2590)

C5-3284 19 nt Target #2:
5'-UGGUUAACAGCUUUUGCUU-3' (SEQ ID NO: 2974)

TABLE 6-continued

DsiRNA Component 19 Nucleotide Target Sequences in C5 mRNA

C5-3284 19 nt Target #3:
5'-UUGGUUAACAGCUUUUGCU-3' (SEQ ID NO: 3358)

C5-3285 19 nt Target #1:
5'-GUUAACAGCUUUUGCUUUA-3' (SEQ ID NO: 2591)

C5-3285 19 nt Target #2:
5'-GGUUAACAGCUUUUGCUUU-3' (SEQ ID NO: 2975)

C5-3285 19 nt Target #3:
5'-UGGUUAACAGCUUUUGCUU-3' (SEQ ID NO: 3359)

C5-3298 19 nt Target #1:
5'-GCUUUAAGAGUACUUGGAC-3' (SEQ ID NO: 2592)

C5-3298 19 nt Target #2:
5'-UGCUUUAAGAGUACUUGGA-3' (SEQ ID NO: 2976)

C5-3298 19 nt Target #3:
5'-UUGCUUUAAGAGUACUUGG-3' (SEQ ID NO: 3360)

C5-3299 19 nt Target #1:
5'-CUUUAAGAGUACUUGGACA-3' (SEQ ID NO: 2593)

C5-3299 19 nt Target #2:
5'-GCUUUAAGAGUACUUGGAC-3' (SEQ ID NO: 2977)

C5-3299 19 nt Target #3:
5'-UGCUUUAAGAGUACUUGGA-3' (SEQ ID NO: 3361)

C5-3302 19 nt Target #1:
5'-UAAGAGUACUUGGACAAGU-3' (SEQ ID NO: 2594)

C5-3302 19 nt Target #2:
5'-UUAAGAGUACUUGGACAAG-3' (SEQ ID NO: 2978)

C5-3302 19 nt Target #3:
5'-UUUAAGAGUACUUGGACAA-3' (SEQ ID NO: 3362)

C5-3303 19 nt Target #1:
5'-AAGAGUACUUGGACAAGUA-3' (SEQ ID NO: 2595)

C5-3303 19 nt Target #2:
5'-UAAGAGUACUUGGACAAGU-3' (SEQ ID NO: 2979)

C5-3303 19 nt Target #3:
5'-UUAAGAGUACUUGGACAAG-3' (SEQ ID NO: 3363)

C5-3332 19 nt Target #1:
5'-UAGAGCAGAACCAAAAUUC-3' (SEQ ID NO: 2596)

C5-3332 19 nt Target #2:
5'-GUAGAGCAGAACCAAAAUU-3' (SEQ ID NO: 2980)

C5-3332 19 nt Target #3:
5'-CGUAGAGCAGAACCAAAAU-3' (SEQ ID NO: 3364)

C5-3333 19 nt Target #1:
5'-AGAGCAGAACCAAAAUUCA-3' (SEQ ID NO: 2597)

C5-3333 19 nt Target #2:
5'-UAGAGCAGAACCAAAAUUC-3' (SEQ ID NO: 2981)

C5-3333 19 nt Target #3:
5'-GUAGAGCAGAACCAAAAUU-3' (SEQ ID NO: 3365)

C5-3334 19 nt Target #1:
5'-GAGCAGAACCAAAAUUCAA-3' (SEQ ID NO: 2598)

C5-3334 19 nt Target #2:
5'-AGAGCAGAACCAAAAUUCA-3' (SEQ ID NO: 2982)

C5-3334 19 nt Target #3:
5'-UAGAGCAGAACCAAAAUUC-3' (SEQ ID NO: 3366)

C5-3335 19 nt Target #1:
5'-AGCAGAACCAAAAUUCAAU-3' (SEQ ID NO: 2599)

C5-3335 19 nt Target #2:
5'-GAGCAGAACCAAAAUUCAA-3' (SEQ ID NO: 2983)

C5-3335 19 nt Target #3:
5'-AGAGCAGAACCAAAAUUCA-3' (SEQ ID NO: 3367)

C5-3419 19 nt Target #1:
5'-CACAGUAUCAACCAAUAAA-3' (SEQ ID NO: 2600)

C5-3419 19 nt Target #2:
5'-UCACAGUAUCAACCAAUAA-3' (SEQ ID NO: 2984)

C5-3419 19 nt Target #3:
5'-UUCACAGUAUCAACCAAUA-3' (SEQ ID NO: 3368)

C5-3429 19 nt Target #1:
5'-ACCAAUAAAAUUACAGGGU-3' (SEQ ID NO: 2601)

C5-3429 19 nt Target #2:
5'-AACCAAUAAAAUUACAGGG-3' (SEQ ID NO: 2985)

C5-3429 19 nt Target #3:
5'-CAACCAAUAAAAUUACAGG-3' (SEQ ID NO: 3369)

C5-3430 19 nt Target #1:
5'-CCAAUAAAAUUACAGGGUA-3' (SEQ ID NO: 2602)

C5-3430 19 nt Target #2:
5'-ACCAAUAAAAUUACAGGGU-3' (SEQ ID NO: 2986)

C5-3430 19 nt Target #3:
5'-AACCAAUAAAAUUACAGGG-3' (SEQ ID NO: 3370)

C5-3431 19 nt Target #1:
5'-CAAUAAAAUUACAGGGUAC-3' (SEQ ID NO: 2603)

C5-3431 19 nt Target #2:
5'-CCAAUAAAAUUACAGGGUA-3' (SEQ ID NO: 2987)

C5-3431 19 nt Target #3:
5'-ACCAAUAAAAUUACAGGGU-3' (SEQ ID NO: 3371)

C5-3497 19 nt Target #1:
5'-CUGUGAUUGGAAUUAGAAA-3' (SEQ ID NO: 2604)

C5-3497 19 nt Target #2:
5'-ACUGUGAUUGGAAUUAGAA-3' (SEQ ID NO: 2988)

C5-3497 19 nt Target #3:
5'-UACUGUGAUUGGAAUUAGA-3' (SEQ ID NO: 3372)

C5-3498 19 nt Target #1:
5'-UGUGAUUGGAAUUAGAAAG-3' (SEQ ID NO: 2605)

C5-3498 19 nt Target #2:
5'-CUGUGAUUGGAAUUAGAAA-3' (SEQ ID NO: 2989)

C5-3498 19 nt Target #3:
5'-ACUGUGAUUGGAAUUAGAA-3' (SEQ ID NO: 3373)

C5-3499 19 nt Target #1:
5'-GUGAUUGGAAUUAGAAAGG-3' (SEQ ID NO: 2606)

C5-3499 19 nt Target #2:
5'-UGUGAUUGGAAUUAGAAAG-3' (SEQ ID NO: 2990)

C5-3499 19 nt Target #3:
5'-CUGUGAUUGGAAUUAGAAA-3' (SEQ ID NO: 3374)

C5-3500 19 nt Target #1:
5'-UGAUUGGAAUUAGAAAGGC-3' (SEQ ID NO: 2607)

TABLE 6-continued

DsiRNA Component 19 Nucleotide Target Sequences in C5 mRNA

C5-3500 19 nt Target #2:
5'-GUGAUUGGAAUUAGAAAGG-3' (SEQ ID NO: 2991)

C5-3500 19 nt Target #3:
5'-UGUGAUUGGAAUUAGAAAG-3' (SEQ ID NO: 3375)

C5-3672 19 nt Target #1:
5'-UUCAAUUGUUUCAGCUUUG-3' (SEQ ID NO: 2608)

C5-3672 19 nt Target #2:
5'-GUUCAAUUGUUUCAGCUUU-3' (SEQ ID NO: 2992)

C5-3672 19 nt Target #3:
5'-CGUUCAAUUGUUUCAGCUU-3' (SEQ ID NO: 3376)

C5-3690 19 nt Target #1:
5'-GAAGAGAGAAGCUUUGGUU-3' (SEQ ID NO: 2609)

C5-3690 19 nt Target #2:
5'-UGAAGAGAGAAGCUUUGGU-3' (SEQ ID NO: 2993)

C5-3690 19 nt Target #3:
5'-UUGAAGAGAGAAGCUUUGG-3' (SEQ ID NO: 3377)

C5-3691 19 nt Target #1:
5'-AAGAGAGAAGCUUUGGUUA-3' (SEQ ID NO: 2610)

C5-3691 19 nt Target #2:
5'-GAAGAGAGAAGCUUUGGUU-3' (SEQ ID NO: 2994)

C5-3691 19 nt Target #3:
5'-UGAAGAGAGAAGCUUUGGU-3' (SEQ ID NO: 3378)

C5-3692 19 nt Target #1:
5'-AGAGAGAAGCUUUGGUUAA-3' (SEQ ID NO: 2611)

C5-3692 19 nt Target #2:
5'-AAGAGAGAAGCUUUGGUUA-3' (SEQ ID NO: 2995)

C5-3692 19 nt Target #3:
5'-GAAGAGAGAAGCUUUGGUU-3' (SEQ ID NO: 3379)

C5-3696 19 nt Target #1:
5'-AGAAGCUUUGGUUAAAGGU-3' (SEQ ID NO: 2612)

C5-3696 19 nt Target #2:
5'-GAGAAGCUUUGGUUAAAGG-3' (SEQ ID NO: 2996)

C5-3696 19 nt Target #3:
5'-AGAGAAGCUUUGGUUAAAG-3' (SEQ ID NO: 3380)

C5-3697 19 nt Target #1:
5'-GAAGCUUUGGUUAAAGGUA-3' (SEQ ID NO: 2613)

C5-3697 19 nt Target #2:
5'-AGAAGCUUUGGUUAAAGGU-3' (SEQ ID NO: 2997)

C5-3697 19 nt Target #3:
5'-GAGAAGCUUUGGUUAAAGG-3' (SEQ ID NO: 3381)

C5-3722 19 nt Target #1:
5'-CCAUUUAUCGUUUUGGAA-3' (SEQ ID NO: 2614)

C5-3722 19 nt Target #2:
5'-CCCAUUUAUCGUUUUUGGA-3' (SEQ ID NO: 2998)

C5-3722 19 nt Target #3:
5'-ACCCAUUUAUCGUUUUUGG-3' (SEQ ID NO: 3382)

C5-3814 19 nt Target #1:
5'-GCUUUACUCACCAGUCUGA-3' (SEQ ID NO: 2615)

C5-3814 19 nt Target #2:
5'-UGCUUUACUCACCAGUCUG-3' (SEQ ID NO: 2999)

C5-3814 19 nt Target #3:
5'-AUGCUUUACUCACCAGUCU-3' (SEQ ID NO: 3383)

C5-3815 19 nt Target #1:
5'-CUUUACUCACCAGUCUGAA-3' (SEQ ID NO: 2616)

C5-3815 19 nt Target #2:
5'-GCUUUACUCACCAGUCUGA-3' (SEQ ID NO: 3000)

C5-3815 19 nt Target #3:
5'-UGCUUUACUCACCAGUCUG-3' (SEQ ID NO: 3384)

C5-3820 19 nt Target #1:
5'-CUCACCAGUCUGAACUUGA-3' (SEQ ID NO: 2617)

C5-3820 19 nt Target #2:
5'-ACUCACCAGUCUGAACUUG-3' (SEQ ID NO: 3001)

C5-3820 19 nt Target #3:
5'-UACUCACCAGUCUGAACUU-3' (SEQ ID NO: 3385)

C5-3824 19 nt Target #1:
5'-CCAGUCUGAACUUGAAAGA-3' (SEQ ID NO: 2618)

C5-3824 19 nt Target #2:
5'-ACCAGUCUGAACUUGAAAG-3' (SEQ ID NO: 3002)

C5-3824 19 nt Target #3:
5'-CACCAGUCUGAACUUGAAA-3' (SEQ ID NO: 3386)

C5-3880 19 nt Target #1:
5'-GAAGAGCAGAGGUAUGGAG-3' (SEQ ID NO: 2619)

C5-3880 19 nt Target #2:
5'-AGAAGAGCAGAGGUAUGGA-3' (SEQ ID NO: 3003)

C5-3880 19 nt Target #3:
5'-CAGAAGAGCAGAGGUAUGG-3' (SEQ ID NO: 3387)

C5-3881 19 nt Target #1:
5'-AAGAGCAGAGGUAUGGAGG-3' (SEQ ID NO: 2620)

C5-3881 19 nt Target #2:
5'-GAAGAGCAGAGGUAUGGAG-3' (SEQ ID NO: 3004)

C5-3881 19 nt Target #3:
5'-AGAAGAGCAGAGGUAUGGA-3' (SEQ ID NO: 3388)

C5-3949 19 nt Target #1:
5'-GAAUAUUCACUCCUGGUUA-3' (SEQ ID NO: 2621)

C5-3949 19 nt Target #2:
5'-GGAAUAUUCACUCCUGGUU-3' (SEQ ID NO: 3005)

C5-3949 19 nt Target #3:
5'-CGGAAUAUUCACUCCUGGU-3' (SEQ ID NO: 3389)

C5-4019 19 nt Target #1:
5'-CCUUACAUAAUUAUAAAU-3' (SEQ ID NO: 2622)

C5-4019 19 nt Target #2:
5'-GCCUUACAUAAUUAUAAA-3' (SEQ ID NO: 3006)

C5-4019 19 nt Target #3:
5'-UGCCUUACAUAAUUAUAAA-3' (SEQ ID NO: 3390)

C5-4132 19 nt Target #3:
5'-CAUGUAACAACUGUAGUUC-3' (SEQ ID NO: 2623)

C5-4132 19 nt Target #3:
5'-ACAUGUAACAACUGUAGUU-3' (SEQ ID NO: 3007)

C5-4132 19 nt Target #3:
5'-UACAUGUAACAACUGUAGU-3' (SEQ ID NO: 3391)

TABLE 6-continued

DsiRNA Component 19 Nucleotide Target Sequences in C5 mRNA

C5-4168 19 nt Target #1:
5'-GAGGAAGUUUGCAGCUUUU-3' (SEQ ID NO: 2624)

C5-4168 19 nt Target #2:
5'-UGAGGAAGUUUGCAGCUUU-3' (SEQ ID NO: 3008)

C5-4168 19 nt Target #3:
5'-CUGAGGAAGUUUGCAGCUU-3' (SEQ ID NO: 3392)

C5-4169 19 nt Target #1:
5'-AGGAAGUUUGCAGCUUUUA-3' (SEQ ID NO: 2625)

C5-4169 19 nt Target #2:
5'-GAGGAAGUUUGCAGCUUUU-3' (SEQ ID NO: 3009)

C5-4169 19 nt Target #3:
5'-UGAGGAAGUUUGCAGCUUU-3' (SEQ ID NO: 3393)

C5-4170 19 nt Target #1:
5'-GGAAGUUUGCAGCUUUUAU-3' (SEQ ID NO: 2626)

C5-4170 19 nt Target #2:
5'-AGGAAGUUUGCAGCUUUUA-3' (SEQ ID NO: 3010)

C5-4170 19 nt Target #3:
5'-GAGGAAGUUUGCAGCUUUU-3' (SEQ ID NO: 3394)

C5-4171 19 nt Target #1:
5'-GAAGUUUGCAGCUUUUAUU-3' (SEQ ID NO: 2627)

C5-4171 19 nt Target #2:
5'-GGAAGUUUGCAGCUUUUAU-3' (SEQ ID NO: 3011)

C5-4171 19 nt Target #3:
5'-AGGAAGUUUGCAGCUUUUA-3' (SEQ ID NO: 3395)

C5-4172 19 nt Target #1:
5'-AAGUUUGCAGCUUUUAUUU-3' (SEQ ID NO: 2628)

C5-4172 19 nt Target #2:
5'-GAAGUUUGCAGCUUUUAUU-3' (SEQ ID NO: 3012)

C5-4172 19 nt Target #3:
5'-GGAAGUUUGCAGCUUUUAU-3' (SEQ ID NO: 3396)

C5-4173 19 nt Target #1:
5'-AGUUUGCAGCUUUUAUUUG-3' (SEQ ID NO: 2629)

C5-4173 19 nt Target #2:
5'-AAGUUUGCAGCUUUUAUUU-3' (SEQ ID NO: 3013)

C5-4173 19 nt Target #3:
5'-GAAGUUUGCAGCUUUUAUU-3' (SEQ ID NO: 3397)

C5-4174 19 nt Target #1:
5'-GUUUGCAGCUUUUAUUUGA-3' (SEQ ID NO: 2630)

C5-4174 19 nt Target #2:
5'-AGUUUGCAGCUUUUAUUUG-3' (SEQ ID NO: 3014)

C5-4174 19 nt Target #3:
5'-AAGUUUGCAGCUUUUAUUU-3' (SEQ ID NO: 3398)

C5-4175 19 nt Target #1:
5'-UUUGCAGCUUUUAUUUGAA-3' (SEQ ID NO: 2631)

C5-4175 19 nt Target #2:
5'-GUUUGCAGCUUUUAUUUGA-3' (SEQ ID NO: 3015)

C5-4175 19 nt Target #3:
5'-AGUUUGCAGCUUUUAUUUG-3' (SEQ ID NO: 3399)

C5-4178 19 nt Target #1:
5'-GCAGCUUUUAUUUGAAAAU-3' (SEQ ID NO: 2632)

C5-4178 19 nt Target #2:
5'-UGCAGCUUUUAUUUGAAAA-3' (SEQ ID NO: 3016)

C5-4178 19 nt Target #3:
5'-UUGCAGCUUUUAUUUGAAA-3' (SEQ ID NO: 3400)

C5-4199 19 nt Target #1:
5'-AUACUCAGGAUAUUGAAGC-3' (SEQ ID NO: 2633)

C5-4199 19 nt Target #2:
5'-GAUACUCAGGAUAUUGAAG-3' (SEQ ID NO: 3017)

C5-4199 19 nt Target #3:
5'-CGAUACUCAGGAUAUUGAA-3' (SEQ ID NO: 3401)

C5-4204 19 nt Target #1:
5'-CAGGAUAUUGAAGCAUCCC-3' (SEQ ID NO: 2634)

C5-4204 19 nt Target #2:
5'-UCAGGAUAUUGAAGCAUCC-3' (SEQ ID NO: 3018)

C5-4204 19 nt Target #3:
5'-CUCAGGAUAUUGAAGCAUC-3' (SEQ ID NO: 3402)

C5-4262 19 nt Target #1:
5'-UAGCAUGUGCCAGCUACAA-3' (SEQ ID NO: 2635)

C5-4262 19 nt Target #2:
5'-GUAGCAUGUGCCAGCUACA-3' (SEQ ID NO: 3019)

C5-4262 19 nt Target #3:
5'-AGUAGCAUGUGCCAGCUAC-3' (SEQ ID NO: 3403)

C5-4263 19 nt Target #1:
5'-AGCAUGUGCCAGCUACAAG-3' (SEQ ID NO: 2636)

C5-4263 19 nt Target #2:
5'-UAGCAUGUGCCAGCUACAA-3' (SEQ ID NO: 3020)

C5-4263 19 nt Target #3:
5'-GUAGCAUGUGCCAGCUACA-3' (SEQ ID NO: 3404)

C5-4264 19 nt Target #1:
5'-GCAUGUGCCAGCUACAAGC-3' (SEQ ID NO: 2637)

C5-4264 19 nt Target #2:
5'-AGCAUGUGCCAGCUACAAG-3' (SEQ ID NO: 3021)

C5-4264 19 nt Target #3:
5'-UAGCAUGUGCCAGCUACAA-3' (SEQ ID NO: 3405)

C5-4265 19 nt Target #1:
5'-CAUGUGCCAGCUACAAGCC-3' (SEQ ID NO: 2638)

C5-4265 19 nt Target #2:
5'-GCAUGUGCCAGCUACAAGC-3' (SEQ ID NO: 3022)

C5-4265 19 nt Target #3:
5'-AGCAUGUGCCAGCUACAAG-3' (SEQ ID NO: 3406)

C5-4266 19 nt Target #1:
5'-AUGUGCCAGCUACAAGCCC-3' (SEQ ID NO: 2639)

C5-4266 19 nt Target #2:
5'-CAUGUGCCAGCUACAAGCC-3' (SEQ ID NO: 3023)

C5-4266 19 nt Target #3:
5'-GCAUGUGCCAGCUACAAGC-3' (SEQ ID NO: 3407)

C5-4267 19 nt Target #1:
5'-UGUGCCAGCUACAAGCCCA-3' (SEQ ID NO: 2640)

C5-4267 19 nt Target #2:
5'-AUGUGCCAGCUACAAGCCC-3' (SEQ ID NO: 3024)

TABLE 6-continued

DsiRNA Component 19 Nucleotide Target Sequences in C5 mRNA

C5-4267 19 nt Target #3:
5'-CAUGUGCCAGCUACAAGCC-3' (SEQ ID NO: 3408)

C5-4268 19 nt Target #1:
5'-GUGCCAGCUACAAGCCCAG-3' (SEQ ID NO: 2641)

C5-4268 19 nt Target #2:
5'-UGUGCCAGCUACAAGCCCA-3' (SEQ ID NO: 3025)

C5-4268 19 nt Target #3:
5'-AUGUGCCAGCUACAAGCCC-3' (SEQ ID NO: 3409)

C5-4269 19 nt Target #1:
5'-UGCCAGCUACAAGCCCAGC-3' (SEQ ID NO: 2642)

C5-4269 19 nt Target #2:
5'-GUGCCAGCUACAAGCCCAG-3' (SEQ ID NO: 3026)

C5-4269 19 nt Target #3:
5'-UGUGCCAGCUACAAGCCCA-3' (SEQ ID NO: 3410)

C5-4270 19 nt Target #1:
5'-GCCAGCUACAAGCCCAGCA-3' (SEQ ID NO: 2643)

C5-4270 19 nt Target #2:
5'-UGCCAGCUACAAGCCCAGC-3' (SEQ ID NO: 3027)

C5-4270 19 nt Target #3:
5'-GUGCCAGCUACAAGCCCAG-3' (SEQ ID NO: 3411)

C5-4423 19 nt Target #1:
5'-GAUGGACAUGUUAUUCUGC-3' (SEQ ID NO: 2644)

C5-4423 19 nt Target #2:
5'-AGAUGGACAUGUUAUUCUG-3' (SEQ ID NO: 3028)

C5-4423 19 nt Target #3:
5'-AAGAUGGACAUGUUAUUCU-3' (SEQ ID NO: 3412)

C5-4424 19 nt Target #1:
5'-AUGGACAUGUUAUUCUGCA-3' (SEQ ID NO: 2645)

C5-4424 19 nt Target #2:
5'-GAUGGACAUGUUAUUCUGC-3' (SEQ ID NO: 3029)

C5-4424 19 nt Target #3:
5'-AGAUGGACAUGUUAUUCUG-3' (SEQ ID NO: 3413)

C5-4426 19 nt Target #1:
5'-GGACAUGUUAUUCUGCAAC-3' (SEQ ID NO: 2646)

C5-4426 19 nt Target #2:
5'-UGGACAUGUUAUUCUGCAA-3' (SEQ ID NO: 3030)

C5-4426 19 nt Target #3:
5'-AUGGACAUGUUAUUCUGCA-3' (SEQ ID NO: 3414)

C5-4428 19 nt Target #1:
5'-ACAUGUUAUUCUGCAACUG-3' (SEQ ID NO: 2647)

C5-4428 19 nt Target #2:
5'-GACAUGUUAUUCUGCAACU-3' (SEQ ID NO: 3031)

C5-4428 19 nt Target #3:
5'-GGACAUGUUAUUCUGCAAC-3' (SEQ ID NO: 3415)

C5-4429 19 nt Target #1:
5'-CAUGUUAUUCUGCAACUGA-3' (SEQ ID NO: 2648)

C5-4429 19 nt Target #2:
5'-ACAUGUUAUUCUGCAACUG-3' (SEQ ID NO: 3032)

C5-4429 19 nt Target #3:
5'-GACAUGUUAUUCUGCAACU-3' (SEQ ID NO: 3416)

C5-4430 19 nt Target #1:
5'-AUGUUAUUCUGCAACUGAA-3' (SEQ ID NO: 2649)

C5-4430 19 nt Target #2:
5'-CAUGUUAUUCUGCAACUGA-3' (SEQ ID NO: 3033)

C5-4430 19 nt Target #3:
5'-ACAUGUUAUUCUGCAACUG-3' (SEQ ID NO: 3417)

C5-4435 19 nt Target #1:
5'-AUUCUGCAACUGAAUUCGA-3' (SEQ ID NO: 2650)

C5-4435 19 nt Target #2:
5'-UAUUCUGCAACUGAAUUCG-3' (SEQ ID NO: 3034)

C5-4435 19 nt Target #3:
5'-UUAUUCUGCAACUGAAUUC-3' (SEQ ID NO: 3418)

C5-4436 19 nt Target #1:
5'-UUCUGCAACUGAAUUCGAU-3' (SEQ ID NO: 2651)

C5-4436 19 nt Target #2:
5'-AUUCUGCAACUGAAUUCGA-3' (SEQ ID NO: 3035)

C5-4436 19 nt Target #3:
5'-UAUUCUGCAACUGAAUUCG-3' (SEQ ID NO: 3419)

C5-4558 19 nt Target #1:
5'-GAUAAACAGUGUACCAUGU-3' (SEQ ID NO: 2652)

C5-4558 19 nt Target #2:
5'-AGAUAAACAGUGUACCAUG-3' (SEQ ID NO: 3036)

C5-4558 19 nt Target #3:
5'-CAGAUAAACAGUGUACCAU-3' (SEQ ID NO: 3420)

C5-4559 19 nt Target #1:
5'-AUAAACAGUGUACCAUGUU-3' (SEQ ID NO: 2653)

C5-4559 19 nt Target #2:
5'-GAUAAACAGUGUACCAUGU-3' (SEQ ID NO: 3037)

C5-4559 19 nt Target #3:
5'-AGAUAAACAGUGUACCAUG-3' (SEQ ID NO: 3421)

C5-4561 19 nt Target #1:
5'-AAACAGUGUACCAUGUUUU-3' (SEQ ID NO: 2654)

C5-4561 19 nt Target #2:
5'-UAAACAGUGUACCAUGUUU-3' (SEQ ID NO: 3038)

C5-4561 19 nt Target #3:
5'-AUAAACAGUGUACCAUGUU-3' (SEQ ID NO: 3422)

C5-4563 19 nt Target #1:
5'-ACAGUGUACCAUGUUUUAU-3' (SEQ ID NO: 2655)

C5-4563 19 nt Target #2:
5'-AACAGUGUACCAUGUUUUA-3' (SEQ ID NO: 3039)

C5-4563 19 nt Target #3:
5'-AAACAGUGUACCAUGUUUU-3' (SEQ ID NO: 3423)

C5-4580 19 nt Target #1:
5'-AUAGCACUUCCAUAUCAA-3' (SEQ ID NO: 2656)

C5-4580 19 nt Target #2:
5'-UAUAGCACUUCCAUAUCA-3' (SEQ ID NO: 3040)

C5-4580 19 nt Target #3:
5'-UUUAUAGCACUUCCAUAUC-3' (SEQ ID NO: 3424)

C5-4601 19 nt Target #1:
5'-UUCAGAAAGUCUGUGAAGG-3' (SEQ ID NO: 2657)

TABLE 6-continued

DsiRNA Component 19 Nucleotide Target Sequences in C5 mRNA

C5-4601 19 nt Target #2:
5'-AUUCAGAAAGUCUGUGAAG-3' (SEQ ID NO: 3041)

C5-4601 19 nt Target #3:
5'-AAUUCAGAAAGUCUGUGAA-3' (SEQ ID NO: 3425)

C5-4602 19 nt Target #1:
5'-UCAGAAAGUCUGUGAAGGA-3' (SEQ ID NO: 2658)

C5-4602 19 nt Target #2:
5'-UUCAGAAAGUCUGUGAAGG-3' (SEQ ID NO: 3042)

C5-4602 19 nt Target #3:
5'-AUUCAGAAAGUCUGUGAAG-3' (SEQ ID NO: 3426)

C5-4603 19 nt Target #1:
5'-CAGAAAGUCUGUGAAGGAG-3' (SEQ ID NO: 3043)

C5-4603 19 nt Target #2:
5'-UCAGAAAGUCUGUGAAGGA-3' (SEQ ID NO: 3043)

C5-4603 19 nt Target #3:
5'-UUCAGAAAGUCUGUGAAGG-3' (SEQ ID NO: 3427)

C5-4604 19 nt Target #1:
5'-AGAAAGUCUGUGAAGGAGC-3' (SEQ ID NO: 2660)

C5-4604 19 nt Target #2:
5'-CAGAAAGUCUGUGAAGGAG-3' (SEQ ID NO: 3044)

C5-4604 19 nt Target #3:
5'-UCAGAAAGUCUGUGAAGGA-3' (SEQ ID NO: 3428)

C5-4717 19 nt Target #1:
5'-CCAGAGAUUGCAUAUGCUU-3' (SEQ ID NO: 2661)

C5-4717 19 nt Target #2:
5'-ACCAGAGAUUGCAUAUGCU-3' (SEQ ID NO: 3045)

C5-4717 19 nt Target #3:
5'-AACCAGAGAUUGCAUAUGC-3' (SEQ ID NO: 3429)

C5-4718 19 nt Target #1:
5'-CAGAGAUUGCAUAUGCUUA-3' (SEQ ID NO: 2662)

C5-4718 19 nt Target #2:
5'-CCAGAGAUUGCAUAUGCUU-3' (SEQ ID NO: 3046)

C5-4718 19 nt Target #3:
5'-ACCAGAGAUUGCAUAUGCU-3' (SEQ ID NO: 3430)

C5-4719 19 nt Target #1:
5'-AGAGAUUGCAUAUGCUUAU-3' (SEQ ID NO: 2663)

C5-4719 19 nt Target #2:
5'-CAGAGAUUGCAUAUGCUUA-3' (SEQ ID NO: 3047)

C5-4719 19 nt Target #3:
5'-CCAGAGAUUGCAUAUGCUU-3' (SEQ ID NO: 3431)

C5-4720 19 nt Target #1:
5'-GAGAUUGCAUAUGCUUAUA-3' (SEQ ID NO: 2664)

C5-4720 19 nt Target #2:
5'-AGAGAUUGCAUAUGCUUAU-3' (SEQ ID NO: 3048)

C5-4720 19 nt Target #3:
5'-CAGAGAUUGCAUAUGCUUA-3' (SEQ ID NO: 3432)

C5-4721 19 nt Target #1:
5'-AGAUUGCAUAUGCUUAUAA-3' (SEQ ID NO: 2665)

C5-4721 19 nt Target #2:
5'-GAGAUUGCAUAUGCUUAUA-3' (SEQ ID NO: 3049)

C5-4721 19 nt Target #3:
5'-AGAGAUUGCAUAUGCUUAU-3' (SEQ ID NO: 3433)

C5-4764 19 nt Target #1:
5'-AGAAAAUGUUUUUGUCAAG-3' (SEQ ID NO: 2666)

C5-4764 19 nt Target #2:
5'-UAGAAAAUGUUUUUGUCAA-3' (SEQ ID NO: 3050)

C5-4764 19 nt Target #3:
5'-GUAGAAAAUGUUUUUGUCA-3' (SEQ ID NO: 3434)

C5-4765 19 nt Target #1:
5'-GAAAAUGUUUUUGUCAAGU-3' (SEQ ID NO: 2667)

C5-4765 19 nt Target #2:
5'-AGAAAAUGUUUUUGUCAAG-3' (SEQ ID NO: 3051)

C5-4765 19 nt Target #3:
5'-UAGAAAAUGUUUUUGUCAA-3' (SEQ ID NO: 3435)

C5-4766 19 nt Target #1:
5'-AAAAUGUUUUUGUCAAGUA-3' (SEQ ID NO: 2668)

C5-4766 19 nt Target #2:
5'-GAAAAUGUUUUUGUCAAGU-3' (SEQ ID NO: 3052)

C5-4766 19 nt Target #3:
5'-AGAAAAUGUUUUUGUCAAG-3' (SEQ ID NO: 3436)

C5-4767 19 nt Target #1:
5'-AAAUGUUUUUGUCAAGUAC-3' (SEQ ID NO: 2669)

C5-4767 19 nt Target #2:
5'-AAAAUGUUUUUGUCAAGUA-3' (SEQ ID NO: 3053)

C5-4767 19 nt Target #3:
5'-GAAAAUGUUUUUGUCAAGU-3' (SEQ ID NO: 3437)

C5-4768 19 nt Target #1:
5'-AAUGUUUUUGUCAAGUACA-3' (SEQ ID NO: 2670)

C5-4768 19 nt Target #2:
5'-AAAUGUUUUUGUCAAGUAC-3' (SEQ ID NO: 3054)

C5-4768 19 nt Target #3:
5'-AAAAUGUUUUUGUCAAGUA-3' (SEQ ID NO: 3438)

C5-4929 19 nt Target #1:
5'-CCAGAUAAAAUACAAUUUC-3' (SEQ ID NO: 2671)

C5-4929 19 nt Target #2:
5'-UCCAGAUAAAAUACAAUUU-3' (SEQ ID NO: 3055)

C5-4929 19 nt Target #3:
5'-CUCCAGAUAAAAUACAAUU-3' (SEQ ID NO: 3439)

C5-5013 19 nt Target #1:
5'-AUGUUCAUCGUGUCAAGCA-3' (SEQ ID NO: 2672)

C5-5013 19 nt Target #2:
5'-CAUGUUCAUCGUGUCAAGC-3' (SEQ ID NO: 3056)

C5-5013 19 nt Target #3:
5'-ACAUGUUCAUCGUGUCAAG-3' (SEQ ID NO: 3440)

C5-5018 19 nt Target #1:
5'-CAUCGUGUCAAGCAUUUUU-3' (SEQ ID NO: 2673)

C5-5018 19 nt Target #2:
5'-UCAUCGUGUCAAGCAUUUU-3' (SEQ ID NO: 3057)

C5-5018 19 nt Target #3:
5'-UUCAUCGUGUCAAGCAUUU-3' (SEQ ID NO: 3441)

TABLE 6-continued

DsiRNA Component 19 Nucleotide Target Sequences in C5 mRNA

C5-5022 19 nt Target #1:
5'-GUGUCAAGCAUUUUUAGCU-3' (SEQ ID NO: 2674)

C5-5022 19 nt Target #2:
5'-CGUGUCAAGCAUUUUUAGC-3' (SEQ ID NO: 3058)

C5-5022 19 nt Target #3:
5'-UCGUGUCAAGCAUUUUUAG-3' (SEQ ID NO: 3442)

C5-5027 19 nt Target #1:
5'-AAGCAUUUUUAGCUAAUUU-3' (SEQ ID NO: 2675)

C5-5027 19 nt Target #2:
5'-CAAGCAUUUUUAGCUAAUU-3' (SEQ ID NO: 3059)

C5-5027 19 nt Target #3:
5'-UCAAGCAUUUUUAGCUAAU-3' (SEQ ID NO: 3443)

C5-5076 19 nt Target #1:
5'-UGGAUGCUAAAAUUCCUGA-3' (SEQ ID NO: 2676)

C5-5076 19 nt Target #2:
5'-AUGGAUGCUAAAAUUCCUG-3' (SEQ ID NO: 3060)

C5-5076 19 nt Target #3:
5'-AAUGGAUGCUAAAAUUCCU-3' (SEQ ID NO: 3444)

C5-5121 19 nt Target #1:
5'-AUGGACUCCUGUUGUUGAA-3' (SEQ ID NO: 2677)

C5-5121 19 nt Target #2:
5'-UAUGGACUCCUGUUGUUGA-3' (SEQ ID NO: 3061)

C5-5121 19 nt Target #3:
5'-UUAUGGACUCCUGUUGUUG-3' (SEQ ID NO: 3445)

C5-5123 19 nt Target #1:
5'-GGACUCCUGUUGUUGAAGU-3' (SEQ ID NO: 2678)

C5-5123 19 nt Target #2:
5'-UGGACUCCUGUUGUUGAAG-3' (SEQ ID NO: 3062)

C5-5123 19 nt Target #3:
5'-AUGGACUCCUGUUGUUGAA-3' (SEQ ID NO: 3446)

C5-5124 19 nt Target #1:
5'-GACUCCUGUUGUUGAAGUU-3' (SEQ ID NO: 2679)

C5-5124 19 nt Target #2:
5'-GGACUCCUGUUGUUGAAGU-3' (SEQ ID NO: 3063)

C5-5124 19 nt Target #3:
5'-UGGACUCCUGUUGUUGAAG-3' (SEQ ID NO: 3447)

C5-5224 19 nt Target #1:
5'-UUGCUUUUAUUAGAGAAUG-3' (SEQ ID NO: 2680)

C5-5224 19 nt Target #2:
5'-CUUGCUUUUAUUAGAGAAU-3' (SEQ ID NO: 3064)

C5-5224 19 nt Target #3:
5'-ACUUGCUUUUAUUAGAGAA-3' (SEQ ID NO: 3448)

C5-5225 19 nt Target #1:
5'-UGCUUUUAUUAGAGAAUGA-3' (SEQ ID NO: 2681)

C5-5225 19 nt Target #2:
5'-UUGCUUUUAUUAGAGAAUG-3' (SEQ ID NO: 3065)

TABLE 6-continued

DsiRNA Component 19 Nucleotide Target Sequences in C5 mRNA

C5-5225 19 nt Target #3:
5'-CUUGCUUUUAUUAGAGAAU-3' (SEQ ID NO: 3449)

C5-5226 19 nt Target #1:
5'-GCUUUUAUUAGAGAAUGAU-3' (SEQ ID NO: 2682)

C5-5226 19 nt Target #2:
5'-UGCUUUUAUUAGAGAAUGA-3' (SEQ ID NO: 3066)

C5-5226 19 nt Target #3:
5'-UUGCUUUUAUUAGAGAAUG-3' (SEQ ID NO: 3450)

C5-5227 19 nt Target #1:
5'-CUUUUAUUAGAGAAUGAUU-3' (SEQ ID NO: 2683)

C5-5227 19 nt Target #2:
5'-GCUUUUAUUAGAGAAUGAU-3' (SEQ ID NO: 3067)

C5-5227 19 nt Target #3:
5'-UGCUUUUAUUAGAGAAUGA-3' (SEQ ID NO: 3451)

C5-5295 19 nt Target #1:
5'-CAGAUACUCCUCCAAGGUU-3' (SEQ ID NO: 2684)

C5-5295 19 nt Target #2:
5'-ACAGAUACUCCUCCAAGGU-3' (SEQ ID NO: 3068)

C5-5295 19 nt Target #3:
5'-GACAGAUACUCCUCCAAGG-3' (SEQ ID NO: 3452)

C5-5464 19 nt Target #1:
5'-CAUUAAAGCCUGAGUUUGC-3' (SEQ ID NO: 2685)

C5-5464 19 nt Target #2:
5'-UCAUUAAAGCCUGAGUUUG-3' (SEQ ID NO: 3069)

C5-5464 19 nt Target #3:
5'-AUCAUUAAAGCCUGAGUUU-3' (SEQ ID NO: 3453)

C5-5465 19 nt Target #1:
5'-AUUAAAGCCUGAGUUUGCU-3' (SEQ ID NO: 2686)

C5-5465 19 nt Target #2:
5'-CAUUAAAGCCUGAGUUUGC-3' (SEQ ID NO: 3070)

C5-5465 19 nt Target #3:
5'-UCAUUAAAGCCUGAGUUUG-3' (SEQ ID NO: 3454)

C5-5468 19 nt Target #1:
5'-AAAGCCUGAGUUUGCUUUC-3' (SEQ ID NO: 2687)

C5-5468 19 nt Target #2:
5'-UAAAGCCUGAGUUUGCUUU-3' (SEQ ID NO: 3071)

C5-5468 19 nt Target #3:
5'-UUAAAGCCUGAGUUUGCUU-3' (SEQ ID NO: 3455)

C5-5469 19 nt Target #1:
5'-AAGCCUGAGUUUGCUUUCA-3' (SEQ ID NO: 2688)

C5-5469 19 nt Target #2:
5'-AAAGCCUGAGUUUGCUUUC-3' (SEQ ID NO: 3072)

C5-5469 19 nt Target #3:
5'-UAAAGCCUGAGUUUGCUUU-3' (SEQ ID NO: 3456)

TABLE 7

Human Anti-C5 DsiRNAs Predicted to have >50% Knockdown Efficacy (Asymmetrics)

```
5'-CUGCUACCUCCAACCAUGGGCCUtt-3'   (SEQ ID NO: 3480)
3'-AGGACGAUGGAGGUUGGUACCCGGAAA-5' (SEQ ID NO: 5790)

C5-40 Target:
5'-TCCTGCTACCTCCAACCATGGGCCTTT-3'   (SEQ ID NO: 8100)
  5'-UGCUACCUCCAACCAUGGGCCUUtt-3'   (SEQ ID NO: 3481)
3'-GGACGAUGGAGGUUGGUACCCGGAAAA-5'   (SEQ ID NO: 5791)

C5-41 Target:
5'-CCTGCTACCTCCAACCATGGGCCTTTT-3'   (SEQ ID NO: 8101)
  5'-GCUACCUCCAACCAUGGGCCUUUtg-3'   (SEQ ID NO: 3482)
3'-GACGAUGGAGGUUGGUACCCGGAAAAC-5'   (SEQ ID NO: 5792)

C5-42 Target:
5'-CTGCTACCTCCAACCATGGGCCTTTTG-3'   (SEQ ID NO: 8102)
  5'-CUACCUCCAACCAUGGGCCUUUUgg-3'   (SEQ ID NO: 3483)
3'-ACGAUGGAGGUUGGUACCCGGAAAACC-5'   (SEQ ID NO: 5793)

C5-43 Target:
5'-TGCTACCTCCAACCATGGGCCTTTTGG-3'   (SEQ ID NO: 8103)
  5'-CCUCCAACCAUGGGCCUUUUGGGaa-3'   (SEQ ID NO: 3484)
3'-AUGGAGGUUGGUACCCGGAAAACCCUU-5'   (SEQ ID NO: 5794)

C5-46 Target:
5'-TACCTCCAACCATGGGCCTTTTGGGAA-3'   (SEQ ID NO: 8104)
  5'-CUCCAACCAUGGGCCUUUUGGGAat-3'   (SEQ ID NO: 3485)
3'-UGGAGGUUGGUACCCGGAAAACCCUUA-5'   (SEQ ID NO: 5795)

C5-47 Target:
5'-ACCTCCAACCATGGGCCTTTTGGGAAT-3'   (SEQ ID NO: 8105)
  5'-UCCAACCAUGGGCCUUUUGGGAAta-3'   (SEQ ID NO: 3486)
3'-GGAGGUUGGUACCCGGAAAACCCUUAU-5'   (SEQ ID NO: 5796)

C5-48 Target:
5'-CCTCCAACCATGGGCCTTTTGGGAATA-3'   (SEQ ID NO: 8106)
  5'-CCAACCAUGGGCCUUUUGGGAAUac-3'   (SEQ ID NO: 3487)
3'-GAGGUUGGUACCCGGAAAACCCUUAUG-5'   (SEQ ID NO: 5797)

C5-49 Target:
5'-CTCCAACCATGGGCCTTTTGGGAATAC-3'   (SEQ ID NO: 8107)
  5'-CAACCAUGGGCCUUUUGGGAAUAct-3'   (SEQ ID NO: 3488)
3'-AGGUUGGUACCCGGAAAACCCUUAUGA-5'   (SEQ ID NO: 5798)

C5-50 Target:
5'-TCCAACCATGGGCCTTTTGGGAATACT-3'   (SEQ ID NO: 8108)
  5'-AACCAUGGGCCUUUUGGGAAUACtt-3'   (SEQ ID NO: 3489)
3'-GGUUGGUACCCGGAAAACCCUUAUGAA-5'   (SEQ ID NO: 5799)

C5-51 Target:
5'-CCAACCATGGGCCTTTTGGGAATACTT-3'   (SEQ ID NO: 8109)
  5'-ACCAUGGGCCUUUUGGGAAUACUtt-3'   (SEQ ID NO: 3490)
3'-GUUGGUACCCGGAAAACCCUUAUGAAA-5'   (SEQ ID NO: 5800)

C5-52 Target:
5'-CAACCATGGGCCTTTTGGGAATACTTT-3'   (SEQ ID NO: 8110)
  5'-CCAUGGGCCUUUUGGGAAUACUUtg-3'   (SEQ ID NO: 3491)
3'-UUGGUACCCGGAAAACCCUUAUGAAAC-5'   (SEQ ID NO: 5801)

C5-53 Target:
5'-AACCATGGGCCTTTTGGGAATACTTTG-3'   (SEQ ID NO: 8111)
  5'-CAUGGGCCUUUUGGGAAUACUUUgt-3'   (SEQ ID NO: 3492)
3'-UGGUACCCGGAAAACCCUUAUGAAACA-5'   (SEQ ID NO: 5802)

C5-54 Target:
5'-ACCATGGGCCTTTTGGGAATACTTTGT-3'   (SEQ ID NO: 8112)
  5'-AUGGGCCUUUUGGGAAUACUUUGtt-3'   (SEQ ID NO: 3493)
3'-GGUACCCGGAAAACCCUUAUGAAACAA-5'   (SEQ ID NO: 5803)

C5-55 Target:
5'-CCATGGGCCTTTTGGGAATACTTTGTT-3'   (SEQ ID NO: 8113)
  5'-UGGGCCUUUUGGGAAUACUUUGUtt-3'   (SEQ ID NO: 3494)
3'-GUACCCGGAAAACCCUUAUGAAACAAA-5'   (SEQ ID NO: 5804)

C5-56 Target:
5'-CATGGGCCTTTTGGGAATACTTTGTTT-3'   (SEQ ID NO: 8114)
  5'-GGGCCUUUUGGGAAUACUUUGUUtt-3'   (SEQ ID NO: 3495)
3'-UACCCGGAAAACCCUUAUGAAACAAAA-5'   (SEQ ID NO: 5805)

C5-57 Target:
5'-ATGGGCCTTTTGGGAATACTTTGTTTT-3'   (SEQ ID NO: 8115)
  5'-GGCCUUUUGGGAAUACUUUGUUUtt-3'   (SEQ ID NO: 3496)
3'-ACCCGGAAAACCCUUAUGAAACAAAAA-5'   (SEQ ID NO: 5806)

C5-58 Target:
5'-TGGGCCTTTTGGGAATACTTTGTTTTT-3'   (SEQ ID NO: 8116)
  5'-GCCUUUUGGGAAUACUUUGUUUUtt-3'   (SEQ ID NO: 3497)
3'-CCCGGAAAACCCUUAUGAAACAAAAAA-5'   (SEQ ID NO: 5807)

C5-59 Target:
5'-GGGCCTTTTGGGAATACTTTGTTTTTT-3'   (SEQ ID NO: 8117)
  5'-CCUUUUGGGAAUACUUUGUUUUUta-3'   (SEQ ID NO: 3498)
3'-CCGGAAAACCCUUAUGAAACAAAAAAU-5'   (SEQ ID NO: 5808)

C5-60 Target:
5'-GGCCTTTTGGGAATACTTTGTTTTTTA-3'   (SEQ ID NO: 8118)
  5'-CUUUUGGGAAUACUUUGUUUUUUaa-3'   (SEQ ID NO: 3499)
3'-CGGAAAACCCUUAUGAAACAAAAAAUU-5'   (SEQ ID NO: 5809)

C5-61 Target:
5'-GCCTTTTGGGAATACTTTGTTTTTTAA-3'   (SEQ ID NO: 8119)
  5'-UUUUGGGAAUACUUUGUUUUUUAat-3'   (SEQ ID NO: 3500)
3'-GGAAAACCCUUAUGAAACAAAAAAUUA-5'   (SEQ ID NO: 5810)

C5-62 Target:
5'-CCTTTTGGGAATACTTTGTTTTTTAAT-3'   (SEQ ID NO: 8120)
  5'-UUUGGGAAUACUUUGUUUUUUAAtc-3'   (SEQ ID NO: 3501)
3'-GAAAACCCUUAUGAAACAAAAAAUUAG-5'   (SEQ ID NO: 5811)
```

TABLE 7-continued

Human Anti-C5 DsiRNAs Predicted to have >50% Knockdown Efficacy (Asymmetrics)

C5-63 Target:
5'-CTTTTGGGAATACTTTGTTTTTTAATC-3' (SEQ ID NO: 8121)

5'-UUGGGAAUACUUUGUUUUUUAAUCt-3' (SEQ ID NO: 3502)

3'-AAAACCCUUAUGAAACAAAAAAUUAGA-5' (SEQ ID NO: 5812)

C5-64 Target:
5'-TTTTGGGAATACTTTGTTTTTTAATCT-3' (SEQ ID NO: 8122)

5'-UGGGAAUACUUUGUUUUUUAAUCtt-3' (SEQ ID NO: 3503)

3'-AAACCCUUAUGAAACAAAAAAUUAGAA-5' (SEQ ID NO: 5813)

C5-65 Target:
5'-TTTGGGAATACTTTGTTTTTTAATCTT-3' (SEQ ID NO: 8123)

5'-GGGAUACUUUGUUUUUUAAUCUtc-3' (SEQ ID NO: 3504)

3'-AACCCUUAUGAAACAAAAAAUUAGAAG-5' (SEQ ID NO: 5814)

C5-66 Target:
5'-TTGGGAATACTTTGTTTTTTAATCTTC-3' (SEQ ID NO: 8124)

5'-GGAAUACUUUGUUUUUUAAUCUUcc-3' (SEQ ID NO: 3505)

3'-ACCCUUAUGAAACAAAAAAUUAGAAGG-5' (SEQ ID NO: 5815)

C5-67 Target:
5'-TGGGAATACTTTGTTTTTTAATCTTCC-3' (SEQ ID NO: 8125)

5'-GAAUACUUUGUUUUUUAAUCUUCct-3' (SEQ ID NO: 3506)

3'-CCCUUAUGAAACAAAAAAUUAGAAGGA-5' (SEQ ID NO: 5816)

C5-68 Target:
5'-GGGAATACTTTGTTTTTTAATCTTCCT-3' (SEQ ID NO: 8126)

5'-AAUACUUUGUUUUUUAAUCUUCCtg-3' (SEQ ID NO: 3507)

3'-CCUUAUGAAACAAAAAAUUAGAAGGAC-5' (SEQ ID NO: 5817)

C5-69 Target:
5'-GGAATACTTTGTTTTTTAATCTTCCTG-3' (SEQ ID NO: 8127)

5'-AUACUUUGUUUUUUAAUCUUCCUgg-3' (SEQ ID NO: 3508)

3'-CUUAUGAAACAAAAAAUUAGAAGGACC-5' (SEQ ID NO: 5818)

C5-70 Target:
5'-GAATACTTTGTTTTTTAATCTTCCTGG-3' (SEQ ID NO: 8128)

5'-UACUUUGUUUUUUAAUCUUCCUGgg-3' (SEQ ID NO: 3509)

3'-UUAUGAAACAAAAAAUUAGAAGGACCC-5' (SEQ ID NO: 5819)

C5-71 Target:
5'-AATACTTTGTTTTTTAATCTTCCTGGG-3' (SEQ ID NO: 8129)

5'-ACUUUGUUUUUUAAUCUUCCUGGGg-3' (SEQ ID NO: 3510)

3'-UAUGAAACAAAAAAUUAGAAGGACCCC-5' (SEQ ID NO: 5820)

C5-72 Target:
5'-ATACTTTGTTTTTTAATCTTCCTGGGG-3' (SEQ ID NO: 8130)

5'-CUUUGUUUUUUAAUCUUCCUGGGGa-3' (SEQ ID NO: 3511)

3'-AUGAAACAAAAAAUUAGAAGGACCCCU-5' (SEQ ID NO: 5821)

C5-73 Target:
5'-TACTTTGTTTTTTAATCTTCCTGGGGA-3' (SEQ ID NO: 8131)

5'-UUUGUUUUUUAAUCUUCCUGGGGAa-3' (SEQ ID NO: 3512)

3'-UGAAACAAAAAAUUAGAAGGACCCCUU-5' (SEQ ID NO: 5822)

TABLE 7-continued

Human Anti-C5 DsiRNAs Predicted to have >50% Knockdown Efficacy (Asymmetrics)

C5-74 Target:
5'-ACTTTGTTTTTTAATCTTCCTGGGGAA-3' (SEQ ID NO: 8132)

5'-UUGUUUUUUAAUCUUCCUGGGGAaa-3' (SEQ ID NO: 3513)

3'-GAAACAAAAAAUUAGAAGGACCCCUUU-5' (SEQ ID NO: 5823)

C5-75 Target:
5'-CTTTGTTTTTTAATCTTCCTGGGGAAA-3' (SEQ ID NO: 8133)

5'-UGUUUUUUAAUCUUCCUGGGGAAaa-3' (SEQ ID NO: 3514)

3'-AAACAAAAAAUUAGAAGGACCCCUUUU-5' (SEQ ID NO: 5824)

C5-76 Target:
5'-TTTGTTTTTTAATCTTCCTGGGGAAAA-3' (SEQ ID NO: 8134)

5'-GUUUUUUAAUCUUCCUGGGGAAAac-3' (SEQ ID NO: 3515)

3'-AACAAAAAAUUAGAAGGACCCCUUUUG-5' (SEQ ID NO: 5825)

C5-77 Target:
5'-TTGTTTTTTAATCTTCCTGGGGAAAAC-3' (SEQ ID NO: 8135)

5'-UGGGGACAGGAGCAAACAUAUGUca-3' (SEQ ID NO: 3516)

3'-GGACCCCUGUCCUCGUUUGUAUACAGU-5' (SEQ ID NO: 5826)

C5-103 Target:
5'-CCTGGGGACAGGAGCAAACATATGTCA-3' (SEQ ID NO: 8136)

5'-GGGGACAGGAGCAAACAUAUGUCat-3' (SEQ ID NO: 3517)

3'-GACCCCUGUCCUCGUUUGUAUACAGUA-5' (SEQ ID NO: 5827)

C5-104 Target:
5'-CTGGGGACAGGAGCAAACATATGTCAT-3' (SEQ ID NO: 8137)

5'-GGGACAGGAGCAAACAUAUGUCAtt-3' (SEQ ID NO: 3518)

3'-ACCCCUGUCCUCGUUUGUAUACAGUAA-5' (SEQ ID NO: 5828)

C5-105 Target:
5'-TGGGGACAGGAGCAAACATATGTCATT-3' (SEQ ID NO: 8138)

5'-GGACAGGAGCAAACAUAUGUCAUtt-3' (SEQ ID NO: 3519)

3'-CCCCUGUCCUCGUUUGUAUACAGUAAA-5' (SEQ ID NO: 5829)

C5-106 Target:
5'-GGGGACAGGAGCAAACATATGTCATTT-3' (SEQ ID NO: 8139)

5'-GACAGGAGCAAACAUAUGUCAUUtc-3' (SEQ ID NO: 3520)

3'-CCCUGUCCUCGUUUGUAUACAGUAAAG-5' (SEQ ID NO: 5830)

C5-107 Target:
5'-GGGACAGGAGCAAACATATGTCATTTC-3' (SEQ ID NO: 8140)

5'-ACAGGAGCAAACAUAUGUCAUUUca-3' (SEQ ID NO: 3521)

3'-CCUGUCCUCGUUUGUAUACAGUAAAGU-5' (SEQ ID NO: 5831)

C5-108 Target:
5'-GGACAGGAGCAAACATATGTCATTTCA-3' (SEQ ID NO: 8141)

5'-CAGGAGCAAACAUAUGUCAUUUCag-3' (SEQ ID NO: 3522)

3'-CUGUCCUCGUUUGUAUACAGUAAAGUC-5' (SEQ ID NO: 5832)

C5-109 Target:
5'-GACAGGAGCAAACATATGTCATTTCAG-3' (SEQ ID NO: 8142)

5'-AGGAGCAAACAUAUGUCAUUUCAgc-3' (SEQ ID NO: 3523)

3'-UGUCCUCGUUUGUAUACAGUAAAGUCG-5' (SEQ ID NO: 5833)

TABLE 7-continued

Human Anti-C5 DsiRNAs Predicted to have >50%
Knockdown Efficacy (Asymmetrics)

C5-110 Target:
5'-ACAGGAGCAAACATATGTCATTTCAGC-3' (SEQ ID NO: 8143)

5'-GGAGCAAACAUAUGUCAUUUCAGCa-3' (SEQ ID NO: 3524)

3'-GUCCUCGUUUGUAUACAGUAAAGUCGU-5' (SEQ ID NO: 5834)

C5-111 Target:
5'-CAGGAGCAAACATATGTCATTTCAGCA-3' (SEQ ID NO: 8144)

5'-GAGCAAACAUAUGUCAUUUCAGCac-3' (SEQ ID NO: 3525)

3'-UCCUCGUUUGUAUACAGUAAAGUCGUG-5' (SEQ ID NO: 5835)

C5-112 Target:
5'-AGGAGCAAACATATGTCATTTCAGCAC-3' (SEQ ID NO: 8145)

5'-AGCAAACAUAUGUCAUUUCAGCAcc-3' (SEQ ID NO: 3526)

3'-CCUCGUUUGUAUACAGUAAAGUCGUGG-5' (SEQ ID NO: 5836)

C5-113 Target:
5'-GGAGCAAACATATGTCATTTCAGCACC-3' (SEQ ID NO: 8146)

5'-GCAAACAUAUGUCAUUUCAGCACca-3' (SEQ ID NO: 3527)

3'-CUCGUUUGUAUACAGUAAAGUCGUGGU-5' (SEQ ID NO: 5837)

C5-114 Target:
5'-GAGCAAACATATGTCATTTCAGCACCA-3' (SEQ ID NO: 8147)

5'-CAAACAUAUGUCAUUUCAGCACCaa-3' (SEQ ID NO: 3528)

3'-UCGUUUGUAUACAGUAAAGUCGUGGUU-5' (SEQ ID NO: 5838)

C5-115 Target:
5'-AGCAAACATATGTCATTTCAGCACCAA-3' (SEQ ID NO: 8148)

5'-AAACAUAUGUCAUUUCAGCACCAaa-3' (SEQ ID NO: 3529)

3'-CGUUUGUAUACAGUAAAGUCGUGGUUU-5' (SEQ ID NO: 5839)

C5-116 Target:
5'-GCAAACATATGTCATTTCAGCACCAAA-3' (SEQ ID NO: 8149)

5'-AACAUAUGUCAUUUCAGCACCAAaa-3' (SEQ ID NO: 3530)

3'-GUUUGUAUACAGUAAAGUCGUGGUUUU-5' (SEQ ID NO: 5840)

C5-117 Target:
5'-CAAACATATGTCATTTCAGCACCAAAA-3' (SEQ ID NO: 8150)

5'-ACAUAUGUCAUUUCAGCACCAAAaa-3' (SEQ ID NO: 3531)

3'-UUUGUAUACAGUAAAGUCGUGGUUUUU-5' (SEQ ID NO: 5841)

C5-118 Target:
5'-AAACATATGTCATTTCAGCACCAAAAA-3' (SEQ ID NO: 8151)

5'-CAUAUGUCAUUUCAGCACCAAAAat-3' (SEQ ID NO: 3532)

3'-UUGUAUACAGUAAAGUCGUGGUUUUUA-5' (SEQ ID NO: 5842)

C5-119 Target:
5'-AACATATGTCATTTCAGCACCAAAAAT-3' (SEQ ID NO: 8152)

5'-UAUGUCAUUUCAGCACCAAAAAUat-3' (SEQ ID NO: 3533)

3'-GUAUACAGUAAAGUCGUGGUUUUUAUA-5' (SEQ ID NO: 5843)

C5-121 Target:
5'-CATATGTCATTTCAGCACCAAAAATAT-3' (SEQ ID NO: 8153)

5'-AUGUCAUUUCAGCACCAAAAAUAtt-3' (SEQ ID NO: 3534)

3'-UAUACAGUAAAGUCGUGGUUUUUAUAA-5' (SEQ ID NO: 5844)

C5-122 Target:
5'-ATATGTCATTTCAGCACCAAAAATATT-3' (SEQ ID NO: 8154)

5'-UGUCAUUUCAGCACCAAAAAUAUtc-3' (SEQ ID NO: 3535)

3'-AUACAGUAAAGUCGUGGUUUUUAUAAG-5' (SEQ ID NO: 5845)

C5-123 Target:
5'-TATGTCATTTCAGCACCAAAAATATTC-3' (SEQ ID NO: 8155)

5'-GUCAUUUCAGCACCAAAAAUAUUcc-3' (SEQ ID NO: 3536)

3'-UACAGUAAAGUCGUGGUUUUUAUAAGG-5' (SEQ ID NO: 5846)

C5-124 Target:
5'-ATGTCATTTCAGCACCAAAAATATTCC-3' (SEQ ID NO: 8156)

5'-UCAUUUCAGCACCAAAAAUAUUCcg-3' (SEQ ID NO: 3537)

3'-ACAGUAAAGUCGUGGUUUUUAUAAGGC-5' (SEQ ID NO: 5847)

C5-125 Target:
5'-TGTCATTTCAGCACCAAAAATATTCCG-3' (SEQ ID NO: 8157)

5'-CAUUUCAGCACCAAAAAUAUUCCgt-3' (SEQ ID NO: 3538)

3'-CAGUAAAGUCGUGGUUUUUAUAAGGCA-5' (SEQ ID NO: 5848)

C5-126 Target:
5'-GTCATTTCAGCACCAAAAATATTCCGT-3' (SEQ ID NO: 8158)

5'-AUUUCAGCACCAAAAAUAUUCCGtg-3' (SEQ ID NO: 3539)

3'-AGUAAAGUCGUGGUUUUUAUAAGGCAC-5' (SEQ ID NO: 5849)

C5-127 Target:
5'-TCATTTCAGCACCAAAAATATTCCGTG-3' (SEQ ID NO: 8159)

5'-UUUCAGCACCAAAAAUAUUCCGUgt-3' (SEQ ID NO: 3540)

3'-GUAAAGUCGUGGUUUUUAUAAGGCACA-5' (SEQ ID NO: 5850)

C5-128 Target:
5'-CATTTCAGCACCAAAAATATTCCGTGT-3' (SEQ ID NO: 8160)

5'-UUCAGCACCAAAAAUAUUCCGUGtt-3' (SEQ ID NO: 3541)

3'-UAAAGUCGUGGUUUUUAUAAGGCACAA-5' (SEQ ID NO: 5851)

C5-129 Target:
5'-ATTTCAGCACCAAAAATATTCCGTGTT-3' (SEQ ID NO: 8161)

5'-UCAGCACCAAAAAUAUUCCGUGUtg-3' (SEQ ID NO: 3542)

3'-AAAGUCGUGGUUUUUAUAAGGCACAAC-5' (SEQ ID NO: 5852)

C5-130 Target:
5'-TTTCAGCACCAAAAATATTCCGTGTTG-3' (SEQ ID NO: 8162)

5'-CAGCACCAAAAAUAUUCCGUGUUgg-3' (SEQ ID NO: 3543)

3'-AAGUCGUGGUUUUUAUAAGGCACAACC-5' (SEQ ID NO: 5853)

C5-131 Target:
5'-TTCAGCACCAAAAATATTCCGTGTTGG-3' (SEQ ID NO: 8163)

5'-AGCACCAAAAAUAUUCCGUGUUGga-3' (SEQ ID NO: 3544)

3'-AGUCGUGGUUUUUAUAAGGCACAACCU-5' (SEQ ID NO: 5854)

C5-132 Target:
5'-TCAGCACCAAAAATATTCCGTGTTGGA-3' (SEQ ID NO: 8164)

5'-GCACCAAAAAUAUUCCGUGUUGGag-3' (SEQ ID NO: 3545)

3'-GUCGUGGUUUUUAUAAGGCACAACCUC-5' (SEQ ID NO: 5855)

TABLE 7-continued

Human Anti-C5 DsiRNAs Predicted to have >50% Knockdown Efficacy (Asymmetrics)

C5-133 Target:
5'-CAGCACCAAAAATATTCCGTGTTGGAG-3' (SEQ ID NO: 8165)

5'-CACCAAAAAUAUUCCGUGUUGGAgc-3' (SEQ ID NO: 3546)

3'-UCGUGGUUUUUAUAAGGCACAACCUCG-5' (SEQ ID NO: 5856)

C5-134 Target:
5'-AGCACCAAAAATATTCCGTGTTGGAGC-3' (SEQ ID NO: 8166)

5'-ACCAAAAAUAUUCCGUGUUGGAGca-3' (SEQ ID NO: 3547)

3'-CGUGGUUUUUAUAAGGCACAACCUCGU-5' (SEQ ID NO: 5857)

C5-135 Target:
5'-GCACCAAAAATATTCCGTGTTGGAGCA-3' (SEQ ID NO: 8167)

5'-CCAAAAAUAUUCCGUGUUGGAGCat-3' (SEQ ID NO: 3548)

3'-GUGGUUUUUAUAAGGCACAACCUCGUA-5' (SEQ ID NO: 5858)

C5-136 Target:
5'-CACCAAAAATATTCCGTGTTGGAGCAT-3' (SEQ ID NO: 8168)

5'-CAAAAAUAUUCCGUGUUGGAGCAtc-3' (SEQ ID NO: 3549)

3'-UGGUUUUUAUAAGGCACAACCUCGUAG-5' (SEQ ID NO: 5859)

C5-137 Target:
5'-ACCAAAAATATTCCGTGTTGGAGCATC-3' (SEQ ID NO: 8169)

5'-AAAAAUAUUCCGUGUUGGAGCAUct-3' (SEQ ID NO: 3550)

3'-GGUUUUUAUAAGGCACAACCUCGUAGA-5' (SEQ ID NO: 5860)

C5-138 Target:
5'-CCAAAAATATTCCGTGTTGGAGCATCT-3' (SEQ ID NO: 8170)

5'-AAAAUAUUCCGUGUUGGAGCAUCtg-3' (SEQ ID NO: 3551)

3'-GUUUUUAUAAGGCACAACCUCGUAGAC-5' (SEQ ID NO: 5861)

C5-139 Target:
5'-CAAAAATATTCCGTGTTGGAGCATCTG-3' (SEQ ID NO: 8171)

5'-AAAUAUUCCGUGUUGGAGCAUCUga-3' (SEQ ID NO: 3552)

3'-UUUUUAUAAGGCACAACCUCGUAGACU-5' (SEQ ID NO: 5862)

C5-140 Target:
5'-AAAAATATTCCGTGTTGGAGCATCTGA-3' (SEQ ID NO: 8172)

5'-AAUAUUCCGUGUUGGAGCAUCUGAa-3' (SEQ ID NO: 3553)

3'-UUUUAUAAGGCACAACCUCGUAGACUU-5' (SEQ ID NO: 5863)

C5-141 Target:
5'-AAAATATTCCGTGTTGGAGCATCTGAA-3' (SEQ ID NO: 8173)

5'-AUAUUCCGUGUUGGAGCAUCUGAaa-3' (SEQ ID NO: 3554)

3'-UUUAUAAGGCACAACCUCGUAGACUUU-5' (SEQ ID NO: 5864)

C5-142 Target:
5'-AAATATTCCGTGTTGGAGCATCTGAAA-3' (SEQ ID NO: 8174)

5'-UAUUCCGUGUUGGAGCAUCUGAAaa-3' (SEQ ID NO: 3555)

3'-UUAUAAGGCACAACCUCGUAGACUUUU-5' (SEQ ID NO: 5865)

C5-143 Target:
5'-AATATTCCGTGTTGGAGCATCTGAAAA-3' (SEQ ID NO: 8175)

5'-AUUCCGUGUUGGAGCAUCUGAAAat-3' (SEQ ID NO: 3556)

3'-UAUAAGGCACAACCUCGUAGACUUUUA-5' (SEQ ID NO: 5866)

C5-144 Target:
5'-ATATTCCGTGTTGGAGCATCTGAAAAT-3' (SEQ ID NO: 8176)

5'-UUCCGUGUUGGAGCAUCUGAAAAta-3' (SEQ ID NO: 3557)

3'-AUAAGGCACAACCUCGUAGACUUUUAU-5' (SEQ ID NO: 5867)

C5-145 Target:
5'-TATTCCGTGTTGGAGCATCTGAAAATA-3' (SEQ ID NO: 8177)

5'-UCCGUGUUGGAGCAUCUGAAAAUat-3' (SEQ ID NO: 3558)

3'-UAAGGCACAACCUCGUAGACUUUUAUA-5' (SEQ ID NO: 5868)

C5-146 Target:
5'-ATTCCGTGTTGGAGCATCTGAAAATAT-3' (SEQ ID NO: 8178)

5'-CCGUGUUGGAGCAUCUGAAAAUAtt-3' (SEQ ID NO: 3559)

3'-AAGGCACAACCUCGUAGACUUUUAUAA-5' (SEQ ID NO: 5869)

C5-147 Target:
5'-TTCCGTGTTGGAGCATCTGAAAATATT-3' (SEQ ID NO: 8179)

5'-CGUGUUGGAGCAUCUGAAAAUAUtg-3' (SEQ ID NO: 3560)

3'-AGGCACAACCUCGUAGACUUUUAUAAC-5' (SEQ ID NO: 5870)

C5-148 Target:
5'-TCCGTGTTGGAGCATCTGAAAATATTG-3' (SEQ ID NO: 8180)

5'-GUGUUGGAGCAUCUGAAAAUAUUgt-3' (SEQ ID NO: 3561)

3'-GGCACAACCUCGUAGACUUUUAUAACA-5' (SEQ ID NO: 5871)

C5-149 Target:
5'-CCGTGTTGGAGCATCTGAAAATATTGT-3' (SEQ ID NO: 8181)

5'-GUUUAUGGAUACACUGAAGCAUUtg-3' (SEQ ID NO: 3562)

3'-UUCAAAUACCUAUGUGACUUCGUAAAC-5' (SEQ ID NO: 5872)

C5-181 Target:
5'-AAGTTTATGGATACACTGAAGCATTTG-3' (SEQ ID NO: 8182)

5'-UAUGGAUACACUGAAGCAUUUGAtg-3' (SEQ ID NO: 3563)

3'-AAAUACCUAUGUGACUUCGUAAACUAC-5' (SEQ ID NO: 5873)

C5-184 Target:
5'-TTTATGGATACACTGAAGCATTTGATG-3' (SEQ ID NO: 8183)

5'-UGGAUACACUGAAGCAUUUGAUGca-3' (SEQ ID NO: 3564)

3'-AUACCUAUGUGACUUCGUAAACUACGU-5' (SEQ ID NO: 5874)

C5-186 Target:
5'-TATGGATACACTGAAGCATTTGATGCA-3' (SEQ ID NO: 8184)

5'-UGAAGCAUUUGAUGCAACAAUCUct-3' (SEQ ID NO: 3565)

3'-UGACUUCGUAAACUACGUUGUUAGAGA-5' (SEQ ID NO: 5875)

C5-195 Target:
5'-ACTGAAGCATTTGATGCAACAATCTCT-3' (SEQ ID NO: 8185)

5'-AAGCAUUUGAUGCAACAAUCUCUat-3' (SEQ ID NO: 3566)

3'-ACUUCGUAAACUACGUUGUUAGAGAUA-5' (SEQ ID NO: 5876)

C5-197 Target:
5'-TGAAGCATTTGATGCAACAATCTCTAT-3' (SEQ ID NO: 8186)

5'-GCAUUUGAUGCAACAAUCUCUAUta-3' (SEQ ID NO: 3567)

3'-UUCGUAAACUACGUUGUUAGAGAUAAU-5' (SEQ ID NO: 5877)

TABLE 7-continued

Human Anti-C5 DsiRNAs Predicted to have >50%
Knockdown Efficacy (Asymmetrics)

C5-199 Target:
5'-AAGCATTTGATCAACAATCTCTATTA-3' (SEQ ID NO: 8187)

5'-A<u>UUU</u>GA<u>U</u>GCAACA<u>AU</u>C<u>U</u>C<u>U</u>A<u>UU</u>Aaa-3' (SEQ ID NO: 3568)

3'-<u>CGUAA</u>ACUACGUUGUU<u>A</u>GAGA<u>U</u>A<u>AUUU</u>-5' (SEQ ID NO: 5878)

C5-201 Target:
5'-GCATTTGATGCAACAATCTCTATTAAA-3' (SEQ ID NO: 8188)

5'-<u>UUU</u>GA<u>U</u>GCAACA<u>AU</u>C<u>U</u>C<u>U</u>A<u>UU</u>Aaa-3' (SEQ ID NO: 3569)

3'-<u>GUAAA</u>CUACGUUGUU<u>A</u>GAGA<u>U</u>A<u>AUUU</u>-5' (SEQ ID NO: 5879)

C5-202 Target:
5'-CATTTGATGCAACAATCTCTATTAAAA-3' (SEQ ID NO: 8189)

5'-<u>UU</u>GA<u>U</u>GCAACA<u>AU</u>C<u>U</u>C<u>U</u>A<u>UU</u>AAAag-3' (SEQ ID NO: 3570)

3'-<u>UAAA</u>CUACGUUGUU<u>A</u>GAGA<u>U</u>A<u>AUUUUC</u>-5' (SEQ ID NO: 5880)

C5-203 Target:
5'-ATTTGATGCAACAATCTCTATTAAAAG-3' (SEQ ID NO: 8190)

5'-<u>GC</u>AACA<u>AU</u>C<u>U</u>C<u>U</u>A<u>UU</u>AAAAG<u>UU</u>Atc-3' (SEQ ID NO: 3571)

3'-<u>UAC</u>GUUGU<u>U</u>AGAGA<u>U</u>A<u>AUUUUC</u>A<u>AUAG</u>-5' (SEQ ID NO: 5881)

C5-208 Target:
5'-ATGCAACAATCTCTATTAAAGTTATC-3' (SEQ ID NO: 8191)

5'-<u>C</u>AACA<u>AU</u>C<u>U</u>C<u>U</u>A<u>UU</u>AAAAG<u>UU</u>AUcc-3' (SEQ ID NO: 3572)

3'-<u>AC</u>GUUGU<u>U</u>AGAGA<u>U</u>A<u>AUUUUC</u>A<u>AUAGG</u>-5' (SEQ ID NO: 5882)

C5-209 Target:
5'-TGCAACAATCTCTATTAAAGTTATCC-3' (SEQ ID NO: 8192)

5'-A<u>AC</u>A<u>AU</u>C<u>U</u>C<u>U</u>A<u>UU</u>AAAAG<u>UU</u>AUCct-3' (SEQ ID NO: 3573)

3'-<u>C</u>GUU<u>G</u>UU<u>A</u>GAGA<u>U</u>A<u>AUUUUC</u>A<u>AUAGGA</u>-5' (SEQ ID NO: 5883)

C5-210 Target:
5'-GCAACAATCTCTATTAAAGTTATCCT-3' (SEQ ID NO: 8193)

5'-A<u>AU</u>C<u>U</u>C<u>U</u>A<u>UU</u>AAA<u>A</u>G<u>UU</u>A<u>U</u>CC<u>U</u>Gat-3' (SEQ ID NO: 3574)

3'-<u>UGUU</u>AGAGA<u>U</u>AAUUUUC<u>A</u>AUAGG<u>ACUA</u>-5' (SEQ ID NO: 5884)

C5-213 Target:
5'-ACAATCTCTATTAAAGTTATCCTGAT-3' (SEQ ID NO: 8194)

5'-A<u>UC</u>U<u>C</u>UA<u>UU</u>AAA<u>A</u>G<u>UU</u>AUCC<u>U</u>GA<u>U</u>a-3' (SEQ ID NO: 3575)

3'-<u>GUU</u>AGAGA<u>U</u>A<u>AUUUUC</u>A<u>AUAGG</u>A<u>CUAU</u>-5' (SEQ ID NO: 5885)

C5-214 Target:
5'-CAATCTCTATTAAAGTTATCCTGATA-3' (SEQ ID NO: 8195)

5'-<u>UCUCU</u>A<u>UU</u>AAAAG<u>UU</u>A<u>U</u>CC<u>U</u>GA<u>U</u>aa-3' (SEQ ID NO: 3576)

3'-<u>UU</u>AGAGA<u>U</u>A<u>AUUUUC</u>A<u>AUAGG</u>AC<u>UAUU</u>-5' (SEQ ID NO: 5886)

C5-215 Target:
5'-AATCTCTATTAAAGTTATCCTGATAA-3' (SEQ ID NO: 8196)

5'-<u>C</u>U<u>CU</u>A<u>UU</u>AAAAG<u>UU</u>A<u>U</u>CC<u>U</u>GA<u>U</u>Aaa-3' (SEQ ID NO: 3577)

3'-<u>UAG</u>AGA<u>U</u>A<u>AUUUUC</u>A<u>AUAGG</u>AC<u>UAUU</u>-5' (SEQ ID NO: 5887)

C5-216 Target:
5'-ATCTCTATTAAAGTTATCCTGATAAA-3' (SEQ ID NO: 8197)

5'-<u>UC</u>U<u>A</u>UU<u>A</u>AAAG<u>UU</u>A<u>U</u>CC<u>U</u>GA<u>U</u>Aaa-3' (SEQ ID NO: 3578)

3'-<u>AGAG</u>A<u>U</u>AA<u>U</u>UUUCA<u>AU</u>AGGACUA<u>UUUU</u>-5' (SEQ ID NO: 5888)

TABLE 7-continued

Human Anti-C5 DsiRNAs Predicted to have >50%
Knockdown Efficacy (Asymmetrics)

C5-217 Target:
5'-TCTCTATTAAAAGTTATCCTGATAAAA-3' (SEQ ID NO: 8198)

5'-<u>U</u>A<u>UU</u>AAAAG<u>UU</u>A<u>U</u>CC<u>U</u>GA<u>U</u>AAAAaa-3' (SEQ ID NO: 3579)

3'-<u>AGA</u>U<u>AAUUUUC</u>A<u>AUAGG</u>ACUA<u>UUUUU</u>-5' (SEQ ID NO: 5889)

C5-219 Target:
5'-TCTATTAAAGTTATCCTGATAAAAAA-3' (SEQ ID NO: 8199)

5'-<u>UU</u>AAAAG<u>UU</u>A<u>U</u>CC<u>U</u>GA<u>U</u>AAAAAAtt-3' (SEQ ID NO: 3580)

3'-<u>A</u>U<u>AAUUUUC</u>A<u>AUAGG</u>A<u>C</u>UA<u>UUUUUU</u>AA-5' (SEQ ID NO: 5890)

C5-221 Target:
5'-TATTAAAGTTATCCTGATAAAAAATT-3' (SEQ ID NO: 8200)

5'-<u>U</u>A<u>AAA</u>G<u>UU</u>A<u>U</u>CC<u>U</u>GA<u>U</u>AAAAAA<u>U</u>tt-3' (SEQ ID NO: 3581)

3'-<u>U</u>AA<u>UUUUC</u>A<u>AUAGG</u>A<u>C</u>UA<u>UUUUUU</u>AAA-5' (SEQ ID NO: 5891)

C5-222 Target:
5'-ATTAAAGTTATCCTGATAAAAAATTT-3' (SEQ ID NO: 8201)

5'-<u>AA</u>G<u>UU</u>A<u>U</u>CC<u>U</u>GA<u>U</u>A<u>AAAAA</u>U<u>UU</u>Agt-3' (SEQ ID NO: 3582)

3'-<u>UUUUC</u>A<u>AUAGG</u>AC<u>U</u>A<u>UUUUUU</u>AAA<u>UCA</u>-5' (SEQ ID NO: 5892)

C5-225 Target:
5'-AAAAGTTATCCTGATAAAAAATTTAGT-3' (SEQ ID NO: 8202)

5'-<u>A</u>G<u>UU</u>A<u>U</u>CC<u>U</u>GA<u>U</u>A<u>AAAAA</u>U<u>UU</u>AG<u>U</u>tt-3' (SEQ ID NO: 3583)

3'-<u>UUUC</u>A<u>AUAGG</u>ACUA<u>UUUUUU</u>AAA<u>U</u>C<u>AA</u>-5' (SEQ ID NO: 5893)

C5-226 Target:
5'-AAAGTTATCCTGATAAAAAATTTAGTT-3' (SEQ ID NO: 8203)

5'-<u>U</u>A<u>U</u>CC<u>U</u>GA<u>U</u>A<u>AAAAA</u>U<u>UU</u>AG<u>UU</u>Act-3' (SEQ ID NO: 3584)

3'-<u>CAAU</u>AGGACUA<u>UUUUUU</u>AAA<u>U</u>C<u>AAU</u>GA-5' (SEQ ID NO: 5894)

C5-229 Target:
5'-GTTATCCTGATAAAAAATTTAGTTACT-3' (SEQ ID NO: 8204)

5'-<u>AUCC</u>U<u>G</u>A<u>U</u>A<u>AAAAA</u>U<u>UU</u>AG<u>UU</u>ACtc-3' (SEQ ID NO: 3585)

3'-<u>AAU</u>AGGACUA<u>UUUUUU</u>AAA<u>U</u>C<u>AAU</u>GAG-5' (SEQ ID NO: 5895)

C5-230 Target:
5'-TTATCCTGATAAAAAATTTAGTTACTC-3' (SEQ ID NO: 8205)

5'-<u>U</u>CC<u>U</u>GA<u>U</u>A<u>AAAAA</u>U<u>UU</u>AG<u>UU</u>AC<u>U</u>cc-3' (SEQ ID NO: 3586)

3'-<u>A</u>UAGGACUA<u>UUUUUU</u>AAA<u>U</u>C<u>AAU</u>GAGG-5' (SEQ ID NO: 5896)

C5-231 Target:
5'-TATCCTGATAAAAAATTTAGTTACTCC-3' (SEQ ID NO: 8206)

5'-<u>CC</u>U<u>G</u>A<u>U</u>A<u>AAAAA</u>U<u>UU</u>AG<u>UU</u>AC<u>U</u>Cct-3' (SEQ ID NO: 3587)

3'-<u>U</u>AGGACUA<u>UUUUUU</u>A<u>AAU</u>C<u>AAU</u>GAGGA-5' (SEQ ID NO: 5897)

C5-232 Target:
5'-ATCCTGATAAAAAATTTAGTTACTCCT-3' (SEQ ID NO: 8207)

5'-<u>CU</u>GA<u>U</u>A<u>AAAAA</u>U<u>UU</u>AG<u>UU</u>AC<u>U</u>CC<u>U</u>c-3' (SEQ ID NO: 3588)

3'-<u>AGG</u>ACUA<u>UUUUUU</u>A<u>AAU</u>C<u>AAU</u>GAGGAG-5' (SEQ ID NO: 5898)

C5-233 Target:
5'-TCCTGATAAAAAATTTAGTTACTCCTC-3' (SEQ ID NO: 8208)

5'-<u>U</u>GA<u>U</u>A<u>AAAAA</u>U<u>UU</u>AG<u>UU</u>AC<u>U</u>CC<u>U</u>Ca-3' (SEQ ID NO: 3589)

3'-<u>GG</u>ACUA<u>UUUUUU</u>A<u>AAU</u>C<u>AAU</u>GAGG<u>AGU</u>-5' (SEQ ID NO: 5899)

TABLE 7-continued

Human Anti-C5 DsiRNAs Predicted to have >50% Knockdown Efficacy (Asymmetrics)

C5-234 Target:
5'-CCTGATAAAAAATTTAGTTACTCCTCA-3' (SEQ ID NO: 8209)

5'-GAUAAAAAAUUUAGUUACUCCUCAg-3' (SEQ ID NO: 3590)

3'-GACUAUUUUUUAAAUCAAUGAGGAGUC-5' (SEQ ID NO: 5900)

C5-235 Target:
5'-CTGATAAAAAATTTAGTTACTCCTCAG-3' (SEQ ID NO: 8210)

5'-AUAAAAAAUUUAGUUACUCCUCAgg-3' (SEQ ID NO: 3591)

3'-ACUAUUUUUUAAAUCAAUGAGGAGUCC-5' (SEQ ID NO: 5901)

C5-236 Target:
5'-TGATAAAAAATTTAGTTACTCCTCAGG-3' (SEQ ID NO: 8211)

5'-UAAAAAAUUUAGUUACUCCUCAGgc-3' (SEQ ID NO: 3592)

3'-CUAUUUUUUAAAUCAAUGAGGAGUCCG-5' (SEQ ID NO: 5902)

C5-237 Target:
5'-GATAAAAAATTTAGTTACTCCTCAGGC-3' (SEQ ID NO: 8212)

5'-AAAAAAUUUAGUUACUCCUCAGGcc-3' (SEQ ID NO: 3593)

3'-UAUUUUUUAAAUCAAUGAGGAGUCCGG-5' (SEQ ID NO: 5903)

C5-238 Target:
5'-ATAAAAAATTTAGTTACTCCTCAGGCC-3' (SEQ ID NO: 8213)

5'-AAAAAUUUAGUUACUCCUCAGGCca-3' (SEQ ID NO: 3594)

3'-AUUUUUUAAAUCAAUGAGGAGUCCGGU-5' (SEQ ID NO: 5904)

C5-239 Target:
5'-TAAAAAATTTAGTTACTCCTCAGGCCA-3' (SEQ ID NO: 8214)

5'-AAAAUUUAGUUACUCCUCAGGCCat-3' (SEQ ID NO: 3595)

3'-UUUUUUAAAUCAAUGAGGAGUCCGGUA-5' (SEQ ID NO: 5905)

C5-240 Target:
5'-AAAAAATTTAGTTACTCCTCAGGCCAT-3' (SEQ ID NO: 8215)

5'-AAAUUUAGUUACUCCUCAGGCCAtg-3' (SEQ ID NO: 3596)

3'-UUUUUAAAUCAAUGAGGAGUCCGGUAC-5' (SEQ ID NO: 5906)

C5-241 Target:
5'-AAAAATTTAGTTACTCCTCAGGCCATG-3' (SEQ ID NO: 8216)

5'-AAUUUAGUUACUCCUCAGGCCAUgt-3' (SEQ ID NO: 3597)

3'-UUUUAAAUCAAUGAGGAGUCCGGUACA-5' (SEQ ID NO: 5907)

C5-242 Target:
5'-AAAATTTAGTTACTCCTCAGGCCATGT-3' (SEQ ID NO: 8217)

5'-AUUUAGUUACUCCUCAGGCCAUGtt-3' (SEQ ID NO: 3598)

3'-UUUAAAUCAAUGAGGAGUCCGGUACAA-5' (SEQ ID NO: 5908)

C5-243 Target:
5'-AAATTTAGTTACTCCTCAGGCCATGTT-3' (SEQ ID NO: 8218)

5'-UUUAGUUACUCCUCAGGCCAUGUtc-3' (SEQ ID NO: 3599)

3'-UUAAAUCAAUGAGGAGUCCGGUACAAG-5' (SEQ ID NO: 5909)

C5-244 Target:
5'-AATTTAGTTACTCCTCAGGCCATGTTC-3' (SEQ ID NO: 8219)

5'-UUAGUUACUCCUCAGGCCAUGUUca-3' (SEQ ID NO: 3600)

3'-UAAAUCAAUGAGGAGUCCGGUACAAGU-5' (SEQ ID NO: 5910)

TABLE 7-continued

Human Anti-C5 DsiRNAs Predicted to have >50% Knockdown Efficacy (Asymmetrics)

C5-245 Target:
5'-ATTTAGTTACTCCTCAGGCCATGTTCA-3' (SEQ ID NO: 8220)

5'-UAGUUACUCCUCAGGCCAUGUUCat-3' (SEQ ID NO: 3601)

3'-AAAUCAAUGAGGAGUCCGGUACAAGUA-5' (SEQ ID NO: 5911)

C5-246 Target:
5'-TTTAGTTACTCCTCAGGCCATGTTCAT-3' (SEQ ID NO: 8221)

5'-AGUUACUCCUCAGGCCAUGUUCAtt-3' (SEQ ID NO: 3602)

3'-AAUCAAUGAGGAGUCCGGUACAAGUAA-5' (SEQ ID NO: 5912)

C5-247 Target:
5'-TTAGTTACTCCTCAGGCCATGTTCATT-3' (SEQ ID NO: 8222)

5'-GUUACUCCUCAGGCCAUGUUCAUtt-3' (SEQ ID NO: 3603)

3'-AUCAAUGAGGAGUCCGGUACAAGUAAA-5' (SEQ ID NO: 5913)

C5-248 Target:
5'-TAGTTACTCCTCAGGCCATGTTCATTT-3' (SEQ ID NO: 8223)

5'-UUACUCCUCAGGCCAUGUUCAUUta-3' (SEQ ID NO: 3604)

3'-UCAAUGAGGAGUCCGGUACAAGUAAAU-5' (SEQ ID NO: 5914)

C5-249 Target:
5'-AGTTACTCCTCAGGCCATGTTCATTTA-3' (SEQ ID NO: 8224)

5'-UACUCCUCAGGCCAUGUUCAUUUat-3' (SEQ ID NO: 3605)

3'-CAAUGAGGAGUCCGGUACAAGUAAAUA-5' (SEQ ID NO: 5915)

C5-250 Target:
5'-GTTACTCCTCAGGCCATGTTCATTTAT-3' (SEQ ID NO: 8225)

5'-ACUCCUCAGGCCAUGUUCAUUUAtc-3' (SEQ ID NO: 3606)

3'-AAUGAGGAGUCCGGUACAAGUAAAUAG-5' (SEQ ID NO: 5916)

C5-251 Target:
5'-TTACTCCTCAGGCCATGTTCATTTATC-3' (SEQ ID NO: 8226)

5'-CUCCUCAGGCCAUGUUCAUUUAUcc-3' (SEQ ID NO: 3607)

3'-AUGAGGAGUCCGGUACAAGUAAAUAGG-5' (SEQ ID NO: 5917)

C5-252 Target:
5'-TACTCCTCAGGCCATGTTCATTTATCC-3' (SEQ ID NO: 8227)

5'-UCCUCAGGCCAUGUUCAUUUAUCct-3' (SEQ ID NO: 3608)

3'-UGAGGAGUCCGGUACAAGUAAAUAGGA-5' (SEQ ID NO: 5918)

C5-253 Target:
5'-ACTCCTCAGGCCATGTTCATTTATCCT-3' (SEQ ID NO: 8228)

5'-CCUCAGGCCAUGUUCAUUUAUCCtc-3' (SEQ ID NO: 3609)

3'-GAGGAGUCCGGUACAAGUAAAUAGGAG-5' (SEQ ID NO: 5919)

C5-254 Target:
5'-CTCCTCAGGCCATGTTCATTTATCCTC-3' (SEQ ID NO: 8229)

5'-CUCAGGCCAUGUUCAUUUAUCCUca-3' (SEQ ID NO: 3610)

3'-AGGAGUCCGGUACAAGUAAAUAGGAGU-5' (SEQ ID NO: 5920)

C5-255 Target:
5'-TCCTCAGGCCATGTTCATTTATCCTCA-3' (SEQ ID NO: 8230)

5'-UCAGGCCAUGUUCAUUUAUCCUCag-3' (SEQ ID NO: 3611)

3'-GGAGUCCGGUACAAGUAAAUAGGAGUC-5' (SEQ ID NO: 5921)

TABLE 7-continued

Human Anti-C5 DsiRNAs Predicted to have >50% Knockdown Efficacy (Asymmetrics)

```
C5-256 Target:
5'-CCTCAGGCCATGTTCATTTATCCTCAG-3'  (SEQ ID NO: 8231)

5'-CAGGCCAUGUUCAUUUAUCCUCAGa-3'  (SEQ ID NO: 3612)

3'-GAGUCCGGUACAAGUAAAUAGGAGUCU-5'  (SEQ ID NO: 5922)

C5-257 Target:
5'-CTCAGGCCATGTTCATTTATCCTCAGA-3'  (SEQ ID NO: 8232)

5'-AGGCCAUGUUCAUUUAUCCUCAGag-3'  (SEQ ID NO: 3613)

3'-AGUCCGGUACAAGUAAAUAGGAGUCUC-5'  (SEQ ID NO: 5923)

C5-258 Target:
5'-TCAGGCCATGTTCATTTATCCTCAGAG-3'  (SEQ ID NO: 8233)

5'-GGCCAUGUUCAUUUAUCCUCAGAGa-3'  (SEQ ID NO: 3614)

3'-GUCCGGUACAAGUAAAUAGGAGUCUCU-5'  (SEQ ID NO: 5924)

C5-259 Target:
5'-CAGGCCATGTTCATTTATCCTCAGAGA-3'  (SEQ ID NO: 8234)

5'-GCCAUGUUCAUUUAUCCUCAGAGaa-3'  (SEQ ID NO: 3615)

3'-UCCGGUACAAGUAAAUAGGAGUCUCUU-5'  (SEQ ID NO: 5925)

C5-260 Target:
5'-AGGCCATGTTCATTTATCCTCAGAGAA-3'  (SEQ ID NO: 8235)

5'-CCAUGUUCAUUUAUCCUCAGAGAat-3'  (SEQ ID NO: 3616)

3'-CCGGUACAAGUAAAUAGGAGUCUCUUA-5'  (SEQ ID NO: 5926)

C5-261 Target:
5'-GGCCATGTTCATTTATCCTCAGAGAAT-3'  (SEQ ID NO: 8236)

5'-CAUGUUCAUUUAUCCUCAGAGAAta-3'  (SEQ ID NO: 3617)

3'-CGGUACAAGUAAAUAGGAGUCUCUUAU-5'  (SEQ ID NO: 5927)

C5-262 Target:
5'-GCCATGTTCATTTATCCTCAGAGAATA-3'  (SEQ ID NO: 8237)

5'-AUGUUCAUUUAUCCUCAGAGAAUaa-3'  (SEQ ID NO: 3618)

3'-GGUACAAGUAAAUAGGAGUCUCUUAUU-5'  (SEQ ID NO: 5928)

C5-263 Target:
5'-CCATGTTCATTTATCCTCAGAGAATAA-3'  (SEQ ID NO: 8238)

5'-UGUUCAUUUAUCCUCAGAGAAUAaa-3'  (SEQ ID NO: 3619)

3'-GUACAAGUAAAUAGGAGUCUCUUAUUU-5'  (SEQ ID NO: 5929)

C5-264 Target:
5'-CATGTTCATTTATCCTCAGAGAATAAA-3'  (SEQ ID NO: 8239)

5'-UCAUUUAUCCUCAGAGAAUAAAUtc-3'  (SEQ ID NO: 3620)

3'-CAAGUAAAUAGGAGUCUCUUAUUUAAG-5'  (SEQ ID NO: 5930)

C5-267 Target:
5'-GTTCATTTATCCTCAGAGAATAAATTC-3'  (SEQ ID NO: 8240)

5'-CAUUUAUCCUCAGAGAAUAAAUUcc-3'  (SEQ ID NO: 3621)

3'-AAGUAAAUAGGAGUCUCUUAUUUAAGG-5'  (SEQ ID NO: 5931)

C5-268 Target:
5'-TTCATTTATCCTCAGAGAATAAATTCC-3'  (SEQ ID NO: 8241)

5'-AUUUAUCCUCAGAGAAUAAAUUCca-3'  (SEQ ID NO: 3622)

3'-AGUAAAUAGGAGUCUCUUAUUUAAGGU-5'  (SEQ ID NO: 5932)

C5-269 Target:
5'-TCATTTATCCTCAGAGAATAAATTCCA-3'  (SEQ ID NO: 8242)

5'-UUUAUCCUCAGAGAAUAAAUUCCaa-3'  (SEQ ID NO: 3623)

3'-GUAAAUAGGAGUCUCUUAUUUAAGGUU-5'  (SEQ ID NO: 5933)

C5-270 Target:
5'-CATTTATCCTCAGAGAATAAATTCCAA-3'  (SEQ ID NO: 8243)

5'-UUAUCCUCAGAGAAUAAAUUCCAaa-3'  (SEQ ID NO: 3624)

3'-UAAAUAGGAGUCUCUUAUUUAAGGUUU-5'  (SEQ ID NO: 5934)

C5-271 Target:
5'-ATTTATCCTCAGAGAATAAATTCCAAA-3'  (SEQ ID NO: 8244)

5'-UAUCCUCAGAGAAUAAAUUCCAAaa-3'  (SEQ ID NO: 3625)

3'-AAAUAGGAGUCUCUUAUUUAAGGUUUU-5'  (SEQ ID NO: 5935)

C5-272 Target:
5'-TTTATCCTCAGAGAATAAATTCCAAAA-3'  (SEQ ID NO: 8245)

5'-AUCCUCAGAGAAUAAAUUCCAAAac-3'  (SEQ ID NO: 3626)

3'-AAUAGGAGUCUCUUAUUUAAGGUUUUG-5'  (SEQ ID NO: 5936)

C5-273 Target:
5'-TTATCCTCAGAGAATAAATTCCAAAAC-3'  (SEQ ID NO: 8246)

5'-UCCUCAGAGAAUAAAUUCCAAAAct-3'  (SEQ ID NO: 3627)

3'-AUAGGAGUCUCUUAUUUAAGGUUUUGA-5'  (SEQ ID NO: 5937)

C5-274 Target:
5'-TATCCTCAGAGAATAAATTCCAAAACT-3'  (SEQ ID NO: 8247)

5'-CCUCAGAGAAUAAAUUCCAAAACtc-3'  (SEQ ID NO: 3628)

3'-UAGGAGUCUCUUAUUUAAGGUUUUGAG-5'  (SEQ ID NO: 5938)

C5-275 Target:
5'-ATCCTCAGAGAATAAATTCCAAAACTC-3'  (SEQ ID NO: 8248)

5'-CUCAGAGAAUAAAUUCCAAAACUct-3'  (SEQ ID NO: 3629)

3'-AGGAGUCUCUUAUUUAAGGUUUUGAGA-5'  (SEQ ID NO: 5939)

C5-276 Target:
5'-TCCTCAGAGAATAAATTCCAAAACTCT-3'  (SEQ ID NO: 8249)

5'-UCAGAGAAUAAAUUCCAAAACUCtg-3'  (SEQ ID NO: 3630)

3'-GGAGUCUCUUAUUUAAGGUUUUGAGAC-5'  (SEQ ID NO: 5940)

C5-277 Target:
5'-CCTCAGAGAATAAATTCCAAAACTCTG-3'  (SEQ ID NO: 8250)

5'-CAGAGAAUAAAUUCCAAAACUCUgc-3'  (SEQ ID NO: 3631)

3'-GAGUCUCUUAUUUAAGGUUUUGACGG-5'  (SEQ ID NO: 5941)

C5-278 Target:
5'-CTCAGAGAATAAATTCCAAAACTCTGC-3'  (SEQ ID NO: 8251)

5'-AGAGAAUAAAUUCCAAAACUCUGca-3'  (SEQ ID NO: 3632)

3'-AGUCUCUUAUUUAAGGUUUUGAGACGU-5'  (SEQ ID NO: 5942)

C5-279 Target:
5'-TCAGAGAATAAATTCCAAAACTCTGCA-3'  (SEQ ID NO: 8252)

5'-GAGAAUAAAUUCCAAAACUCUGCaa-3'  (SEQ ID NO: 3633)

3'-GUCUCUUAUUUAAGGUUUUGAGACGUU-5'  (SEQ ID NO: 5943)
```

TABLE 7-continued

Human Anti-C5 DsiRNAs Predicted to have >50% Knockdown Efficacy (Asymmetrics)

```
C5-280 Target:
5'-CAGAGAATAAATTCCAAAACTCTGCAA-3' (SEQ ID NO: 8253)

5'-AGAAUAAAUUCCAAAACUCUGCAat-3' (SEQ ID NO: 3634)

3'-UCUCUUAUUUAAGGUUUUGAGACGUUA-5' (SEQ ID NO: 5944)

C5-281 Target:
5'-AGAGAATAAATTCCAAAACTCTGCAAT-3' (SEQ ID NO: 8254)

5'-UCUUAACAAUACAACCAAAACAAtt-3' (SEQ ID NO: 3635)

3'-UUAGAAUUGUUAUGUUGGUUUUGUUAA-5' (SEQ ID NO: 5945)

C5-305 Target:
5'-AATCTTAACAATACAACCAAAACAATT-3' (SEQ ID NO: 8255)

5'-CUUAACAAUACAACCAAAACAAUtg-3' (SEQ ID NO: 3636)

3'-UAGAAUUGUUAUGUUGGUUUUGUUAAC-5' (SEQ ID NO: 5946)

C5-306 Target:
5'-ATCTTAACAATACAACCAAAACAATTG-3' (SEQ ID NO: 8256)

5'-UUAACAAUACAACCAAAACAAUUgc-3' (SEQ ID NO: 3637)

3'-AGAAUUGUUAUGUUGGUUUUGUUAACG-5' (SEQ ID NO: 5947)

C5-307 Target:
5'-TCTTAACAATACAACCAAAACAATTGC-3' (SEQ ID NO: 8257)

5'-UAACAAUACAACCAAAACAAUUGcc-3' (SEQ ID NO: 3638)

3'-GAAUUGUUAUGUUGGUUUUGUUAACGG-5' (SEQ ID NO: 5948)

C5-308 Target:
5'-CTTAACAATACAACCAAAACAATTGCC-3' (SEQ ID NO: 8258)

5'-AACAAUACAACCAAAACAAUUGCct-3' (SEQ ID NO: 3639)

3'-AAUUGUUAUGUUGGUUUUGUUAACGGA-5' (SEQ ID NO: 5949)

C5-309 Target:
5'-TTAACAATACAACCAAAACAATTGCCT-3' (SEQ ID NO: 8259)

5'-ACAAUACAACCAAAACAAUUGCCtg-3' (SEQ ID NO: 3640)

3'-AUUGUUAUGUUGGUUUUGUUAACGGAC-5' (SEQ ID NO: 5950)

C5-310 Target:
5'-TAACAATACAACCAAAACAATTGCCTG-3' (SEQ ID NO: 8260)

5'-CAAUACAACCAAAACAAUUGCCUgg-3' (SEQ ID NO: 3641)

3'-UUGUUAUGUUGGUUUUGUUAACGGACC-5' (SEQ ID NO: 5951)

C5-311 Target:
5'-AACAATACAACCAAAACAATTGCCTGG-3' (SEQ ID NO: 8261)

5'-AUUUGGAAGUUGUAUCAAAGCAUtt-3' (SEQ ID NO: 3642)

3'-CAUAAACCUUCAACAUAGUUUCGUAAA-5' (SEQ ID NO: 5952)

C5-362 Target:
5'-GTATTTGGAAGTTGTATCAAAGCATTT-3' (SEQ ID NO: 8262)

5'-UUUGGAAGUUGUAUCAAAGCAUUt-3' (SEQ ID NO: 3643)

3'-AUAAACCUUCAACAUAGUUUCGUAAAA-5' (SEQ ID NO: 5953)

C5-363 Target:
5'-TATTTGGAAGTTGTATCAAAGCATTTT-3' (SEQ ID NO: 8263)

5'-UAUCAAAGCAUUUUCAAAAUCAaa-3' (SEQ ID NO: 3644)

3'-ACAUAGUUUCGUAAAAGUUUUAGUUU-5' (SEQ ID NO: 5954)

C5-374 Target:
5'-TGTATCAAAGCATTTTTCAAAATCAAA-3' (SEQ ID NO: 8264)

5'-AUCAAAGCAUUUUUCAAAAUCAAaa-3' (SEQ ID NO: 3645)

3'-CAUAGUUUCGUAAAAAGUUUUAGUUUU-5' (SEQ ID NO: 5955)

C5-375 Target:
5'-GTATCAAAGCATTTTTCAAAATCAAAA-3' (SEQ ID NO: 8265)

5'-UCAAAGCAUUUUUCAAAAUCAAAaa-3' (SEQ ID NO: 3646)

3'-AUAGUUUCGUAAAAAGUUUUAGUUUUU-5' (SEQ ID NO: 5956)

C5-376 Target:
5'-TATCAAAGCATTTTTCAAAATCAAAAA-3' (SEQ ID NO: 8266)

5'-CAAAGCAUUUUUCAAAAUCAAAAag-3' (SEQ ID NO: 3647)

3'-UAGUUUCGUAAAAAGUUUUAGUUUUC-5' (SEQ ID NO: 5957)

C5-377 Target:
5'-ATCAAAGCATTTTTCAAAATCAAAAAG-3' (SEQ ID NO: 8267)

5'-AAAGCAUUUUUCAAAAUCAAAAAga-3' (SEQ ID NO: 3648)

3'-AGUUUCGUAAAAAGUUUUAGUUUUUCU-5' (SEQ ID NO: 5958)

C5-378 Target:
5'-TCAAAGCATTTTTCAAAATCAAAAAGA-3' (SEQ ID NO: 8268)

5'-CCAAUAACCUAUGACAAUGGAUUtc-3' (SEQ ID NO: 3649)

3'-ACGGUUAUUGGAUACUGUUACCUAAAG-5' (SEQ ID NO: 5959)

C5-406 Target:
5'-TGCCAATAACCTATGACAATGGATTTC-3' (SEQ ID NO: 8269)

5'-CAAUAACCUAUGACAAUGGAUUUct-3' (SEQ ID NO: 3650)

3'-CGGUUAUUGGAUACUGUUACCUAAGA-5' (SEQ ID NO: 5960)

C5-407 Target:
5'-GCCAATAACCTATGACAATGGATTTCT-3' (SEQ ID NO: 8270)

5'-AUAACCUAUGACAAUGGAUUUCUct-3' (SEQ ID NO: 3651)

3'-GUUAUGGAUACUGUUACCUAAAGAGA-5' (SEQ ID NO: 5961)

C5-409 Target:
5'-CAATAACCTATGACAATGGATTTCTCT-3' (SEQ ID NO: 8271)

5'-UAACCUAUGACAAUGGAUUUCUCtt-3' (SEQ ID NO: 3652)

3'-UUAUGGAUACUGUUACCUAAAGAGAA-5' (SEQ ID NO: 5962)

C5-410 Target:
5'-AATAACCTATGACAATGGATTTCTCTT-3' (SEQ ID NO: 8272)

5'-AACCUAUGACAAUGGAUUUCUCUtc-3' (SEQ ID NO: 3653)

3'-UAUGGAUACUGUUACCUAAAGAGAAG-5' (SEQ ID NO: 5963)

C5-411 Target:
5'-ATAACCTATGACAATGGATTTCTCTTC-3' (SEQ ID NO: 8273)

5'-ACCUAUGACAAUGGAUUUCUCUUca-3' (SEQ ID NO: 3654)

3'-AUUGGAUACUGUUACCUAAAGAGAAGU-5' (SEQ ID NO: 5964)

C5-412 Target:
5'-TAACCTATGACAATGGATTTCTCTTCA-3' (SEQ ID NO: 8274)

5'-CCUAUGACAAUGGAUUUCUCUUCat-3' (SEQ ID NO: 3655)

3'-UUGGAUACUGUUACCUAAAGAGAAGUA-5' (SEQ ID NO: 5965)
```

TABLE 7-continued

Human Anti-C5 DsiRNAs Predicted to have >50% Knockdown Efficacy (Asymmetrics)

C5-413 Target:
5'-AACCTATGACAATGGATTTCTCTTCAT-3' (SEQ ID NO: 8275)

5'-UAUGACAAUGGAUUUCUCUUCAUtc-3' (SEQ ID NO: 3656)

3'-GGAUACUGUUACCUAAAGAGAAGUAAG-5' (SEQ ID NO: 5966)

C5-415 Target:
5'-CCTATGACAATGGATTTCTCTTCATTC-3' (SEQ ID NO: 8276)

5'-AUGACAAUGGAUUUCUCUUCAUUca-3' (SEQ ID NO: 3657)

3'-GAUACUGUUACCUAAAGAGAAGUAAGU-5' (SEQ ID NO: 5967)

C5-416 Target:
5'-CTATGACAATGGATTTCTCTTCATTCA-3' (SEQ ID NO: 8277)

5'-UGACAAUGGAUUUCUCUUCAUUcat-3' (SEQ ID NO: 3658)

3'-AUACUGUUACCUAAAGAGAAGUAAGUA-5' (SEQ ID NO: 5968)

C5-417 Target:
5'-TATGACAATGGATTTCTCTTCATTCAT-3' (SEQ ID NO: 8278)

5'-AAUGGAUUUCUCUUCAUUCAUACag-3' (SEQ ID NO: 3659)

3'-UGUUACCUAAAGAGAAGUAAGUAUGUC-5' (SEQ ID NO: 5969)

C5-421 Target:
5'-ACAATGGATTTCTCTTCATTCATACAG-3' (SEQ ID NO: 8279)

5'-GGAUUUCUCUUCAUUCAUACAGAca-3' (SEQ ID NO: 3660)

3'-UACCUAAAGAGAAGUAAGUAUGUCUGU-5' (SEQ ID NO: 5970)

C5-424 Target:
5'-ATGGATTTCTCTTCATTCATACAGACA-3' (SEQ ID NO: 8280)

5'-AUUUCUCUUCAUUCAUACAGACAaa-3' (SEQ ID NO: 3661)

3'-CCUAAAGAGAAGUAAGUAUGUCUGUUU-5' (SEQ ID NO: 5971)

C5-426 Target:
5'-GGATTTCTCTTCATTCATACAGACAAA-3' (SEQ ID NO: 8281)

5'-UUUCUCUUCAUUCAUACAGACAAac-3' (SEQ ID NO: 3662)

3'-CUAAAGAGAAGUAAGUAUGUCUGUUUG-5' (SEQ ID NO: 5972)

C5-427 Target:
5'-GATTTCTCTTCATTCATACAGACAAAC-3' (SEQ ID NO: 8282)

5'-UUCUCUUCAUUCAUACAGACAAAcc-3' (SEQ ID NO: 3663)

3'-UAAAGAGAAGUAAGUAUGUCUGUUUGG-5' (SEQ ID NO: 5973)

C5-428 Target:
5'-ATTTCTCTTCATTCATACAGACAAACC-3' (SEQ ID NO: 8283)

5'-UCUCUUCAUUCAUACAGACAAACct-3' (SEQ ID NO: 3664)

3'-AAAGAGAAGUAAGUAUGUCUGUUUGGA-5' (SEQ ID NO: 5974)

C5-429 Target:
5'-TTTCTCTTCATTCATACAGACAAACCT-3' (SEQ ID NO: 8284)

5'-CUCUUCAUUCAUACAGACAAACCtg-3' (SEQ ID NO: 3665)

3'-AAGAGAAGUAAGUAUGUCUGUUUGGAC-5' (SEQ ID NO: 5975)

C5-430 Target:
5'-TTCTCTTCATTCATACAGACAAACCTG-3' (SEQ ID NO: 8285)

5'-UCUUCAUUCAUACAGACAAACCUgt-3' (SEQ ID NO: 3666)

3'-AGAGAAGUAAGUAUGUCUGUUUGGACA-5' (SEQ ID NO: 5976)

C5-431 Target:
5'-TCTCTTCATTCATACAGACAAACCTGT-3' (SEQ ID NO: 8286)

5'-CUUCAUUCAUACAGACAAACCUGtt-3' (SEQ ID NO: 3667)

3'-GAGAAGUAAGUAUGUCUGUUUGGACAA-5' (SEQ ID NO: 5977)

C5-432 Target:
5'-CTCTTCATTCATACAGACAAACCTGTT-3' (SEQ ID NO: 8287)

5'-UUCAUUCAUACAGACAAACCUGUtt-3' (SEQ ID NO: 3668)

3'-AGAAGUAAGUAUGUCUGUUUGGACAAA-5' (SEQ ID NO: 5978)

C5-433 Target:
5'-TCTTCATTCATACAGACAAACCTGTTT-3' (SEQ ID NO: 8288)

5'-UCAUUCAUACAGACAAACCUGUUta-3' (SEQ ID NO: 3669)

3'-GAAGUAAGUAUGUCUGUUUGGACAAAU-5' (SEQ ID NO: 5979)

C5-434 Target:
5'-CTTCATTCATACAGACAAACCTGTTTA-3' (SEQ ID NO: 8289)

5'-CAUUCAUACAGACAAACCUGUUUat-3' (SEQ ID NO: 3670)

3'-AAGUAAGUAUGUCUGUUUGGACAAAUA-5' (SEQ ID NO: 5980)

C5-435 Target:
5'-TTCATTCATACAGACAAACCTGTTTAT-3' (SEQ ID NO: 8290)

5'-UUCAUACAGACAAACCUGUUUAUac-3' (SEQ ID NO: 3671)

3'-GUAAGUAUGUCUGUUUGGACAAAUAUG-5' (SEQ ID NO: 5981)

C5-437 Target:
5'-CATTCATACAGACAAACCTGTTTATAC-3' (SEQ ID NO: 8291)

5'-UACAGACAAACCUGUUUAUACUCca-3' (SEQ ID NO: 3672)

3'-GUAUGUCUGUUUGGACAAAUAUGAGGU-5' (SEQ ID NO: 5982)

C5-441 Target:
5'-CATACAGACAAACCTGTTTATACTCCA-3' (SEQ ID NO: 8292)

5'-ACAGACAAACCUGUUUAUACUCCag-3' (SEQ ID NO: 3673)

3'-UAUGUCUGUUUGGACAAAUAUGAGGUC-5' (SEQ ID NO: 5983)

C5-442 Target:
5'-ATACAGACAAACCTGTTTATACTCCAG-3' (SEQ ID NO: 8293)

5'-CAGACAAACCUGUUUAUACUCCAga-3' (SEQ ID NO: 3674)

3'-AUGUCUGUUUGGACAAAUAUGAGGUCU-5' (SEQ ID NO: 5984)

C5-443 Target:
5'-TACAGACAAACCTGTTTATACTCCAGA-3' (SEQ ID NO: 8294)

5'-AGACAAACCUGUUUAUACUCCAGac-3' (SEQ ID NO: 3675)

3'-UGUCUGUUUGGACAAAUAUGAGGUCUG-5' (SEQ ID NO: 5985)

C5-444 Target:
5'-ACAGACAAACCTGTTTATACTCCAGAC-3' (SEQ ID NO: 8295)

5'-GACAAACCUGUUUAUACUCCAGAcc-3' (SEQ ID NO: 3676)

3'-GUCUGUUUGGACAAAUAUGAGGUCUGG-5' (SEQ ID NO: 5986)

C5-445 Target:
5'-CAGACAAACCTGTTTATACTCCAGACC-3' (SEQ ID NO: 8296)

5'-ACAAACCUGUUUAUACUCCAGACca-3' (SEQ ID NO: 3677)

3'-UCUGUUUGGACAAAUAUGAGGUCUGGU-5' (SEQ ID NO: 5987)

TABLE 7-continued

Human Anti-C5 DsiRNAs Predicted to have >50%
Knockdown Efficacy (Asymmetrics)

C5-446 Target:
5'-AGACAAACCTGTTTATACTCCAGACCA-3' (SEQ ID NO: 8297)

5'-C<u>AA</u>ACCUGUUUAU<u>AC</u>UCCAGACCAg-3' (SEQ ID NO: 3678)

3'-<u>CUG</u>UUUGGACAAAU<u>AU</u>GAGGUCU<u>GGUC</u>-5' (SEQ ID NO: 5988)

C5-447 Target:
5'-GACAAACCTGTTTATACTCCAGACCAG-3' (SEQ ID NO: 8298)

5'-A<u>AA</u>CCUGUUUAUA<u>CU</u>CCAGACCAgt-3' (SEQ ID NO: 3679)

3'-<u>UGU</u>UUGGACAAAU<u>AU</u>GAGGUCUGG<u>UCA</u>-5' (SEQ ID NO: 5989)

C5-448 Target:
5'-ACAAACCTGTTTATACTCCAGACCAGT-3' (SEQ ID NO: 8299)

5'-A<u>AC</u>CUGUUUAUACU<u>CC</u>AGACCAGtc-3' (SEQ ID NO: 3680)

3'-<u>GUU</u>UGGACAAAUAU<u>GA</u>GGUCUGG<u>UCAG</u>-5' (SEQ ID NO: 5990)

C5-449 Target:
5'-CAAACCTGTTTATACTCCAGACCAGTC-3' (SEQ ID NO: 8300)

5'-A<u>CC</u>UGUUUAUACU<u>CC</u>AGACCAGUca-3' (SEQ ID NO: 3681)

3'-<u>UUU</u>GGACAAAUAUG<u>AG</u>GUCUGGU<u>CAGU</u>-5' (SEQ ID NO: 5991)

C5-450 Target:
5'-AAACCTGTTTATACTCCAGACCAGTCA-3' (SEQ ID NO: 8301)

5'-C<u>CU</u>GUUUAUACUCC<u>AG</u>ACCAGUCag-3' (SEQ ID NO: 3682)

3'-<u>UUG</u>GACAAAUAUGA<u>GG</u>UCUGGUC<u>AGUC</u>-5' (SEQ ID NO: 5992)

C5-451 Target:
5'-AACCTGTTTATACTCCAGACCAGTCAG-3' (SEQ ID NO: 8302)

5'-C<u>UG</u>UUUAUACUCCAG<u>AC</u>CAGUCAgt-3' (SEQ ID NO: 3683)

3'-<u>UGG</u>ACAAAUAUGAGG<u>UC</u>UGGUCAG<u>UCA</u>-5' (SEQ ID NO: 5993)

C5-452 Target:
5'-ACCTGTTTATACTCCAGACCAGTCAGT-3' (SEQ ID NO: 8303)

5'-U<u>UA</u>GAGUUUAUUC<u>GU</u>UGAAUGACga-3' (SEQ ID NO: 3684)

3'-<u>UCA</u>AUCACAAAUAAGC<u>AA</u>CUUACU<u>GCU</u>-5' (SEQ ID NO: 5994)

C5-482 Target:
5'-AGTTAGAGTTTATTCGTTGAATGACGA-3' (SEQ ID NO: 8304)

5'-U<u>AG</u>AGUUUAUUCGU<u>UG</u>AAUGACGac-3' (SEQ ID NO: 3685)

3'-<u>CAA</u>UCUCAAAUAAGC<u>AA</u>CUUACU<u>GCUG</u>-5' (SEQ ID NO: 5995)

C5-483 Target:
5'-GTTAGAGTTTATTCGTTGAATGACGAC-3' (SEQ ID NO: 8305)

5'-A<u>GA</u>GUUUAUUCGUU<u>GA</u>AUGACGAct-3' (SEQ ID NO: 3686)

3'-<u>AAU</u>CUCAAAUAAGC<u>AA</u>CUUACUGC<u>UGA</u>-5' (SEQ ID NO: 5996)

C5-484 Target:
5'-TTAGAGTTTATTCGTTGAATGACGACT-3' (SEQ ID NO: 8306)

5'-G<u>AG</u>UUUAUUCGUUG<u>AA</u>UGACGACtt-3' (SEQ ID NO: 3687)

3'-<u>AUC</u>UCAAAUAAGC<u>AA</u>CUUACUGC<u>UGAA</u>-5' (SEQ ID NO: 5997)

C5-485 Target:
5'-TAGAGTTTATTCGTTGAATGACGACTT-3' (SEQ ID NO: 8307)

5'-G<u>AC</u>UUGAAGCCAGC<u>CA</u>AAAGAGAaa-3' (SEQ ID NO: 3688)

3'-<u>UGC</u>UGAACUUCGGUC<u>GG</u>UUUUCU<u>CUUU</u>-5' (SEQ ID NO: 5998)

TABLE 7-continued

Human Anti-C5 DsiRNAs Predicted to have >50%
Knockdown Efficacy (Asymmetrics)

C5-505 Target:
5'-ACGACTTGAAGCCAGCCAAAAGAGAAA-3' (SEQ ID NO: 8308)

5'-A<u>CU</u>UGAAGCCAGC<u>CA</u>AAAGAGAAac-3' (SEQ ID NO: 3689)

3'-<u>GCU</u>GAACUUCGG<u>UC</u>GGUUUUCUC<u>UUUG</u>-5' (SEQ ID NO: 5999)

C5-506 Target:
5'-CGACTTGAAGCCAGCCAAAAGAGAAAC-3' (SEQ ID NO: 8309)

5'-C<u>UU</u>GAAGCCAGCC<u>AA</u>AAGAGAAAct-3' (SEQ ID NO: 3690)

3'-<u>CUG</u>AACUUCGGUCGG<u>UU</u>UUCUCUUU<u>GA</u>-5' (SEQ ID NO: 6000)

C5-507 Target:
5'-GACTTGAAGCCAGCCAAAAGAGAAACT-3' (SEQ ID NO: 8310)

5'-U<u>UG</u>AAGCCAGCCA<u>AA</u>AGAGAAACtg-3' (SEQ ID NO: 3691)

3'-<u>UGA</u>ACUUCGGUCGG<u>UU</u>UUCUCUUU<u>GAC</u>-5' (SEQ ID NO: 6001)

C5-508 Target:
5'-ACTTGAAGCCAGCCAAAAGAGAAACTG-3' (SEQ ID NO: 8311)

5'-U<u>GA</u>AGCCAGCCAA<u>AA</u>GAGAAACUgt-3' (SEQ ID NO: 3692)

3'-<u>GAA</u>CUUCGGUCGG<u>UU</u>UUCUCUUUG<u>ACA</u>-5' (SEQ ID NO: 6002)

C5-509 Target:
5'-CTTGAAGCCAGCCAAAAGAGAAACTGT-3' (SEQ ID NO: 8312)

5'-G<u>AA</u>GCCAGCCAAAA<u>GA</u>GAAACUGtc-3' (SEQ ID NO: 3693)

3'-<u>AAC</u>UUCGGUCGGUUUU<u>C</u>UCUUUG<u>ACAG</u>-5' (SEQ ID NO: 6003)

C5-510 Target:
5'-TTGAAGCCAGCCAAAAGAGAAACTGTC-3' (SEQ ID NO: 8313)

5'-A<u>AG</u>CCAGCCAAAAG<u>AG</u>AAACUGUct-3' (SEQ ID NO: 3694)

3'-<u>ACU</u>UCGGUCGGUUUU<u>C</u>UCUUUGAC<u>AGA</u>-5' (SEQ ID NO: 6004)

C5-511 Target:
5'-TGAAGCCAGCCAAAAGAGAAACTGTCT-3' (SEQ ID NO: 8314)

5'-A<u>GC</u>CAGCCAAAAGA<u>GA</u>AACUGUCtt-3' (SEQ ID NO: 3695)

3'-<u>CUU</u>CGGUCGGUUUUC<u>U</u>CUUUGAC<u>AGAA</u>-5' (SEQ ID NO: 6005)

C5-512 Target:
5'-GAAGCCAGCCAAAAGAGAAACTGTCTT-3' (SEQ ID NO: 8315)

5'-G<u>CC</u>AGCCAAAAGA<u>GAA</u>ACUGUCUta-3' (SEQ ID NO: 3696)

3'-<u>UUC</u>GGUCGGUUUUC<u>U</u>CUUUGAC<u>AGAAU</u>-5' (SEQ ID NO: 6006)

C5-513 Target:
5'-AAGCCAGCCAAAAGAGAAACTGTCTTA-3' (SEQ ID NO: 8316)

5'-C<u>CA</u>GCCAAAAGAGA<u>AA</u>CUGUCUUaa-3' (SEQ ID NO: 3697)

3'-<u>UCG</u>GUCGGUUUUCU<u>CU</u>UUGACAG<u>AAUU</u>-5' (SEQ ID NO: 6007)

C5-514 Target:
5'-AGCCAGCCAAAAGAGAAACTGTCTTAA-3' (SEQ ID NO: 8317)

5'-C<u>AG</u>CCAAAAGAGA<u>AAC</u>UGUCUUAac-3' (SEQ ID NO: 3698)

3'-<u>CGG</u>UCGGUUUUCUC<u>UU</u>UGACAGA<u>AUUG</u>-5' (SEQ ID NO: 6008)

C5-515 Target:
5'-GCCAGCCAAAAGAGAAACTGTCTTAAC-3' (SEQ ID NO: 8318)

5'-A<u>GC</u>CAAAAGAGAA<u>ACU</u>GUCUUAAct-3' (SEQ ID NO: 3699)

3'-<u>GGU</u>CGGUUUUCUC<u>UU</u>UGACAGAA<u>UUGA</u>-5' (SEQ ID NO: 6009)

TABLE 7-continued

Human Anti-C5 DsiRNAs Predicted to have >50% Knockdown Efficacy (Asymmetrics)

C5-516 Target:
5'-CCAGCCAAAAGAGAAACTGTCTTAACT-3' (SEQ ID NO: 8319)

5'-GCCAAAAGAGAAACUGUCUUAACUtt-3' (SEQ ID NO: 3700)

3'-GUCGGUUUUCUCUUUGACAGAAUUGAA-5' (SEQ ID NO: 6010)

C5-517 Target:
5'-CAGCCAAAAGAGAAACTGTCTTAACTT-3' (SEQ ID NO: 8320)

5'-CCAAAAGAGAAACUGUCUUAACUtt-3' (SEQ ID NO: 3701)

3'-UCGGUUUUCUCUUUGACAGAAUUGAAA-5' (SEQ ID NO: 6011)

C5-518 Target:
5'-AGCCAAAAGAGAAACTGTCTTAACTTT-3' (SEQ ID NO: 8321)

5'-CAAAAGAGAAACUGUCUUAACUUtc-3' (SEQ ID NO: 3702)

3'-CGGUUUUCUCUUUGACAGAAUUGAAAG-5' (SEQ ID NO: 6012)

C5-519 Target:
5'-GCCAAAAGAGAAACTGTCTTAACTTTC-3' (SEQ ID NO: 8322)

5'-AAAAGAGAAACUGUCUUAACUUUca-3' (SEQ ID NO: 3703)

3'-GGUUUUCUCUUUGACAGAAUUGAAAGU-5' (SEQ ID NO: 6013)

C5-520 Target:
5'-CCAAAAGAGAAACTGTCTTAACTTTCA-3' (SEQ ID NO: 8323)

5'-AAAGAGAAACUGUCUUAACUUUCat-3' (SEQ ID NO: 3704)

3'-GUUUUCUCUUUGACAGAAUUGAAAGUA-5' (SEQ ID NO: 6014)

C5-521 Target:
5'-CAAAAGAGAAACTGTCTTAACTTTCAT-3' (SEQ ID NO: 8324)

5'-AAGAGAAACUGUCUUAACUUUCAta-3' (SEQ ID NO: 3705)

3'-UUUUCUCUUUGACAGAAUUGAAAGUAU-5' (SEQ ID NO: 6015)

C5-522 Target:
5'-AAAAGAGAAACTGTCTTAACTTTCATA-3' (SEQ ID NO: 8325)

5'-AGAGAAACUGUCUUAACUUUCAUag-3' (SEQ ID NO: 3706)

3'-UUUCUCUUUGACAGAAUUGAAAGUAUC-5' (SEQ ID NO: 6016)

C5-523 Target:
5'-AAAGAGAAACTGTCTTAACTTTCATAG-3' (SEQ ID NO: 8326)

5'-GAGAAACUGUCUUAACUUUCAUaga-3' (SEQ ID NO: 3707)

3'-UUCUCUUUGACAGAAUUGAAAGUAUCU-5' (SEQ ID NO: 6017)

C5-524 Target:
5'-AAGAGAAACTGTCTTAACTTTCATAGA-3' (SEQ ID NO: 8327)

5'-GAAACUGUCUUAACUUUCAUAGAtc-3' (SEQ ID NO: 3708)

3'-CUCUUUGACAGAAUUGAAAGUAUCUAG-5' (SEQ ID NO: 6018)

C5-526 Target:
5'-GAGAAACTGTCTTAACTTTCATAGATC-3' (SEQ ID NO: 8328)

5'-AAACUGUCUUAACUUUCAUAGAUcc-3' (SEQ ID NO: 3709)

3'-UCUUUGACAGAAUUGAAAGUAUCUAGG-5' (SEQ ID NO: 6019)

C5-527 Target:
5'-AGAAACTGTCTTAACTTTCATAGATCC-3' (SEQ ID NO: 8329)

5'-AACUGUCUUAACUUUCAUAGAUCct-3' (SEQ ID NO: 3710)

3'-CUUUGACAGAAUUGAAAGUAUCUAGGA-5' (SEQ ID NO: 6020)

C5-528 Target:
5'-GAAACTGTCTTAACTTTCATAGATCCT-3' (SEQ ID NO: 8330)

5'-UGUCUUAACUUUCAUAGAUCCUGaa-3' (SEQ ID NO: 3711)

3'-UGACAGAAUUGAAAGUAUCUAGGACUU-5' (SEQ ID NO: 6021)

C5-531 Target:
5'-ACTGTCTTAACTTTCATAGATCCTGAA-3' (SEQ ID NO: 8331)

5'-GUCUUAACUUUCAUAGAUCCUGAag-3' (SEQ ID NO: 3712)

3'-GACAGAAUUGAAAGUAUCUAGGACUUC-5' (SEQ ID NO: 6022)

C5-532 Target:
5'-CTGTCTTAACTTTCATAGATCCTGAAG-3' (SEQ ID NO: 8332)

5'-UCUUAACUUUCAUAGAUCCUGAAgg-3' (SEQ ID NO: 3713)

3'-ACAGAAUUGAAAGUAUCUAGGACUUCC-5' (SEQ ID NO: 6023)

C5-533 Target:
5'-TGTCTTAACTTTCATAGATCCTGAAGG-3' (SEQ ID NO: 8333)

5'-CUUAACUUUCAUAGAUCCUGAAGga-3' (SEQ ID NO: 3714)

3'-CAGAAUUGAAAGUAUCUAGGACUUCCU-5' (SEQ ID NO: 6024)

C5-534 Target:
5'-GTCTTAACTTTCATAGATCCTGAAGGA-3' (SEQ ID NO: 8334)

5'-UUAACUUUCAUAGAUCCUGAAGGat-3' (SEQ ID NO: 3715)

3'-AGAAUUGAAAGUAUCUAGGACUUCCUA-5' (SEQ ID NO: 6025)

C5-535 Target:
5'-TCTTAACTTTCATAGATCCTGAAGGAT-3' (SEQ ID NO: 8335)

5'-UAACUUUCAUAGAUCCUGAAGGAtc-3' (SEQ ID NO: 3716)

3'-GAAUUGAAAGUAUCUAGGACUUCCUAG-5' (SEQ ID NO: 6026)

C5-536 Target:
5'-CTTAACTTTCATAGATCCTGAAGGATC-3' (SEQ ID NO: 8336)

5'-AACUUUCAUAGAUCCUGAAGGAUca-3' (SEQ ID NO: 3717)

3'-AAUUGAAAGUAUCUAGGACUUCCUAGU-5' (SEQ ID NO: 6027)

C5-537 Target:
5'-TTAACTTTCATAGATCCTGAAGGATCA-3' (SEQ ID NO: 8337)

5'-ACUUUCAUAGAUCCUGAAGGAUCag-3' (SEQ ID NO: 3718)

3'-AUUGAAAGUAUCUAGGACUUCCUAGUC-5' (SEQ ID NO: 6028)

C5-538 Target:
5'-TAACTTTCATAGATCCTGAAGGATCAG-3' (SEQ ID NO: 8338)

5'-CUUUCAUAGAUCCUGAAGGAUCAga-3' (SEQ ID NO: 3719)

3'-UUGAAAGUAUCUAGGACUUCCUAGUCU-5' (SEQ ID NO: 6029)

C5-539 Target:
5'-AACTTTCATAGATCCTGAAGGATCAGA-3' (SEQ ID NO: 8339)

5'-UUUCAUAGAUCCUGAAGGAUCAGaa-3' (SEQ ID NO: 3720)

3'-UGAAAGUAUCUAGGACUUCCUAGUCUU-5' (SEQ ID NO: 6030)

C5-540 Target:
5'-ACTTTCATAGATCCTGAAGGATCAGAA-3' (SEQ ID NO: 8340)

5'-UUCAUAGAUCCUGAAGGAUCAGAag-3' (SEQ ID NO: 3721)

3'-GAAAGUAUCUAGGACUUCCUAGUCUUC-5' (SEQ ID NO: 6031)

TABLE 7-continued

Human Anti-C5 DsiRNAs Predicted to have >50% Knockdown Efficacy (Asymmetrics)

```
C5-541 Target:
5'-CTTTCATAGATCCTGAAGGATCAGAAG-3' (SEQ ID NO: 8341)

5'-UCAUAGAUCCUGAAGGAUCAGAAgt-3' (SEQ ID NO: 3722)

3'-AAAGUAUCUAGGACUUCCUAGUCUUCA-5' (SEQ ID NO: 6032)

C5-542 Target:
5'-TTTCATAGATCCTGAAGGATCAGAAGT-3' (SEQ ID NO: 8342)

5'-CAUAGAUCCUGAAGGAUCAGAAGtt-3' (SEQ ID NO: 3723)

3'-AAGUAUCUAGGACUUCCUAGUCUUCAA-5' (SEQ ID NO: 6033)

C5-543 Target:
5'-TTCATAGATCCTGAAGGATCAGAAGTT-3' (SEQ ID NO: 8343)

5'-AUAGAUCCUGAAGGAUCAGAAGUtg-3' (SEQ ID NO: 3724)

3'-AGUAUCUAGGACUUCCUAGUCUUCAAC-5' (SEQ ID NO: 6034)

C5-544 Target:
5'-TCATAGATCCTGAAGGATCAGAAGTTG-3' (SEQ ID NO: 8344)

5'-UAGAUCCUGAAGGAUCAGAAGUUga-3' (SEQ ID NO: 3725)

3'-GUAUCUAGGACUUCCUAGUCUUCAACU-5' (SEQ ID NO: 6035)

C5-545 Target:
5'-CATAGATCCTGAAGGATCAGAAGTTGA-3' (SEQ ID NO: 8345)

5'-AGAUCCUGAAGGAUCAGAAGUUGac-3' (SEQ ID NO: 3726)

3'-UAUCUAGGACUUCCUAGUCUUCAACUG-5' (SEQ ID NO: 6036)

C5-546 Target:
5'-ATAGATCCTGAAGGATCAGAAGTTGAC-3' (SEQ ID NO: 8346)

5'-UUGACAUGGUAGAAGAAAUUGAUca-3' (SEQ ID NO: 3727)

3'-UCAACUGUACCAUCUUCUUUAACUAGU-5' (SEQ ID NO: 6037)

C5-566 Target:
5'-AGTTGACATGGTAGAAGAAATTGATCA-3' (SEQ ID NO: 8347)

5'-UGACAUGGUAGAAGAAAUUGAUcat-3' (SEQ ID NO: 3728)

3'-CAACUGUACCAUCUUCUUUAACUAGUA-5' (SEQ ID NO: 6038)

C5-567 Target:
5'-GTTGACATGGTAGAAGAAATTGATCAT-3' (SEQ ID NO: 8348)

5'-CAUGGUAGAAGAAAUUGAUCAUAtt-3' (SEQ ID NO: 3729)

3'-CUGUACCAUCUUCUUUAACUAGUAUAA-5' (SEQ ID NO: 6039)

C5-570 Target:
5'-GACATGGTAGAAGAAATTGATCATATT-3' (SEQ ID NO: 8349)

5'-AUGGUAGAAGAAAUUGAUCAUAUtg-3' (SEQ ID NO: 3730)

3'-UGUACCAUCUUCUUUAACUAGUAUAAC-5' (SEQ ID NO: 6040)

C5-571 Target:
5'-ACATGGTAGAAGAAATTGATCATATTG-3' (SEQ ID NO: 8350)

5'-UGGUAGAAGAAAUUGAUCAUAUUgg-3' (SEQ ID NO: 3731)

3'-GUACCAUCUUCUUUAACUAGUAUAACC-5' (SEQ ID NO: 6041)

C5-572 Target:
5'-CATGGTAGAAGAAATTGATCATATTGG-3' (SEQ ID NO: 8351)

5'-UAGAAGAAAUUGAUCAUAUUGGAat-3' (SEQ ID NO: 3732)

3'-CCAUCUUCUUUAACUAGUAUAACCUUA-5' (SEQ ID NO: 6042)

C5-575 Target:
5'-GGTAGAAGAAATTGATCATATTGGAAT-3' (SEQ ID NO: 8352)

5'-AGAAGAAAUUGAUCAUAUUGGAAtt-3' (SEQ ID NO: 3733)

3'-CAUCUUCUUUAACUAGUAUAACCUUAA-5' (SEQ ID NO: 6043)

C5-576 Target:
5'-GTAGAAGAAATTGATCATATTGGAATT-3' (SEQ ID NO: 8353)

5'-GAAGAAAUUGAUCAUAUUGGAAUta-3' (SEQ ID NO: 3734)

3'-AUCUUCUUUAACUAGUAUAACCUUAAU-5' (SEQ ID NO: 6044)

C5-577 Target:
5'-TAGAAGAAATTGATCATATTGGAATTA-3' (SEQ ID NO: 8354)

5'-GAAAUUGAUCAUAUUGGAAUUAUct-3' (SEQ ID NO: 3735)

3'-UUCUUUAACUAGUAUAACCUUAAUAGA-5' (SEQ ID NO: 6045)

C5-580 Target:
5'-AAGAAATTGATCATATTGGAATTATCT-3' (SEQ ID NO: 8355)

5'-AAAUUGAUCAUAUUGGAAUUAUCtc-3' (SEQ ID NO: 3736)

3'-UCUUUAACUAGUAUAACCUUAAUAGAG-5' (SEQ ID NO: 6046)

C5-581 Target:
5'-AGAAATTGATCATATTGGAATTATCTC-3' (SEQ ID NO: 8356)

5'-AAUUGAUCAUAUUGGAAUUAUCUct-3' (SEQ ID NO: 3737)

3'-CUUUAACUAGUAUAACCUUAAUAGAGA-5' (SEQ ID NO: 6047)

C5-582 Target:
5'-GAAATTGATCATATTGGAATTATCTCT-3' (SEQ ID NO: 8357)

5'-AUUGAUCAUAUUGGAAUUAUCUCtt-3' (SEQ ID NO: 3738)

3'-UUUAACUAGUAUAACCUUAAUAGAGAA-5' (SEQ ID NO: 6048)

C5-583 Target:
5'-AAATTGATCATATTGGAATTATCTCTT-3' (SEQ ID NO: 8358)

5'-UUGAUCAUAUUGGAAUUAUCUCUtt-3' (SEQ ID NO: 3739)

3'-UUAACUAGUAUAACCUUAAUAGAGAAA-5' (SEQ ID NO: 6049)

C5-584 Target:
5'-AATTGATCATATTGGAATTATCTCTTT-3' (SEQ ID NO: 8359)

5'-UGAUCAUAUUGGAAUUAUCUCUUtt-3' (SEQ ID NO: 3740)

3'-UAACUAGUAUAACCUUAAUAGAGAAAA-5' (SEQ ID NO: 6050)

C5-585 Target:
5'-ATTGATCATATTGGAATTATCTCTTTT-3' (SEQ ID NO: 8360)

5'-GAUCAUAUUGGAAUUAUCUCUUUtc-3' (SEQ ID NO: 3741)

3'-AACUAGUAUAACCUUAAUAGAGAAAAG-5' (SEQ ID NO: 6051)

C5-586 Target:
5'-TTGATCATATTGGAATTATCTCTTTTC-3' (SEQ ID NO: 8361)

5'-AUCAUAUUGGAAUUAUCUCUUUUcc-3' (SEQ ID NO: 3742)

3'-ACUAGUAUAACCUUAAUAGAGAAAAGG-5' (SEQ ID NO: 6052)

C5-587 Target:
5'-TGATCATATTGGAATTATCTCTTTTCC-3' (SEQ ID NO: 8362)

5'-UCAUAUUGGAAUUAUCUCUUUUCct-3' (SEQ ID NO: 3743)

3'-CUAGUAUAACCUUAAUAGAGAAAAGGA-5' (SEQ ID NO: 6053)
```

TABLE 7-continued

Human Anti-C5 DsiRNAs Predicted to have >50% Knockdown Efficacy (Asymmetrics)

```
C5-588 Target:
5'-GATCATATTGGAATTATCTCTTTTCCT-3'  (SEQ ID NO: 8363)

5'-CAUAUUGGAAUUAUCUCUUUUCCtg-3'  (SEQ ID NO: 3744)

3'-UAGUAUAACCUUAAUAGAGAAAAGGAC-5'  (SEQ ID NO: 6054)

C5-589 Target:
5'-ATCATATTGGAATTATCTCTTTTCCTG-3'  (SEQ ID NO: 8364)

5'-AUAUUGGAAUUAUCUCUUUUCCUga-3'  (SEQ ID NO: 3745)

3'-AGUAUAACCUUAAUAGAGAAAAGGACU-5'  (SEQ ID NO: 6055)

C5-590 Target:
5'-TCATATTGGAATTATCTCTTTTCCTGA-3'  (SEQ ID NO: 8365)

5'-UAUUGGAAUUAUCUCUUUUCCUGac-3'  (SEQ ID NO: 3746)

3'-GUAUAACCUUAAUAGAGAAAAGGACUG-5'  (SEQ ID NO: 6056)

C5-591 Target:
5'-CATATTGGAATTATCTCTTTTCCTGAC-3'  (SEQ ID NO: 8366)

5'-AUUGGAAUUAUCUCUUUUCCUGAct-3'  (SEQ ID NO: 3747)

3'-UAUAACCUUAAUAGAGAAAAGGACUGA-5'  (SEQ ID NO: 6057)

C5-592 Target:
5'-ATATTGGAATTATCTCTTTTCCTGACT-3'  (SEQ ID NO: 8367)

5'-UUGGAAUUAUCUCUUUUCCUGACtt-3'  (SEQ ID NO: 3748)

3'-AUAACCUUAAUAGAGAAAAGGACUGAA-5'  (SEQ ID NO: 6058)

C5-593 Target:
5'-TATTGGAATTATCTCTTTTCCTGACTT-3'  (SEQ ID NO: 8368)

5'-UGGAAUUAUCUCUUUUCCUGACUtc-3'  (SEQ ID NO: 3749)

3'-UAACCUUAAUAGAGAAAAGGACUGAAG-5'  (SEQ ID NO: 6059)

C5-594 Target:
5'-ATTGGAATTATCTCTTTTCCTGACTTC-3'  (SEQ ID NO: 8369)

5'-UCCUGACUUCAAGAUUCCGUCUAat-3'  (SEQ ID NO: 3750)

3'-AAAGGACUGAAGUUCUAAGGCAGAUUA-5'  (SEQ ID NO: 6060)

C5-609 Target:
5'-TTTCCTGACTTCAAGATTCCGTCTAAT-3'  (SEQ ID NO: 8370)

5'-CCUGACUUCAAGAUUCCGUCUAAtc-3'  (SEQ ID NO: 3751)

3'-AAGGACUGAAGUUCUAAGGCAGAUUAG-5'  (SEQ ID NO: 6061)

C5-610 Target:
5'-TTCCTGACTTCAAGATTCCGTCTAATC-3'  (SEQ ID NO: 8371)

5'-CUGACUUCAAGAUUCCGUCUAAUcc-3'  (SEQ ID NO: 3752)

3'-AGGACUGAAGUUCUAAGGCAGAUUAGG-5'  (SEQ ID NO: 6062)

C5-611 Target:
5'-TCCTGACTTCAAGATTCCGTCTAATCC-3'  (SEQ ID NO: 8372)

5'-UGACUUCAAGAUUCCGUCUAAUCct-3'  (SEQ ID NO: 3753)

3'-GGACUGAAGUUCUAAGGCAGAUUAGGA-5'  (SEQ ID NO: 6063)

C5-612 Target:
5'-CCTGACTTCAAGATTCCGTCTAATCCT-3'  (SEQ ID NO: 8373)

5'-GACUUCAAGAUUCCGUCUAAUCCta-3'  (SEQ ID NO: 3754)

3'-GACUGAAGUUCUAAGGCAGAUUAGGAU-5'  (SEQ ID NO: 6064)

C5-613 Target:
5'-CTGACTTCAAGATTCCGTCTAATCCTA-3'  (SEQ ID NO: 8374)

5'-ACUUCAAGAUUCCGUCUAAUCCUag-3'  (SEQ ID NO: 3755)

3'-ACUGAAGUUCUAAGGCAGAUUAGGAUC-5'  (SEQ ID NO: 6065)

C5-614 Target:
5'-TGACTTCAAGATTCCGTCTAATCCTAG-3'  (SEQ ID NO: 8375)

5'-CUUCAAGAUUCCGUCUAAUCCUAga-3'  (SEQ ID NO: 3756)

3'-CUGAAGUUCUAAGGCAGAUUAGGAUCU-5'  (SEQ ID NO: 6066)

C5-615 Target:
5'-GACTTCAAGATTCCGTCTAATCCTAGA-3'  (SEQ ID NO: 8376)

5'-UUCAAGAUUCCGUCUAAUCCUAGat-3'  (SEQ ID NO: 3757)

3'-UGAAGUUCUAAGGCAGAUUAGGAUCUA-5'  (SEQ ID NO: 6067)

C5-616 Target:
5'-ACTTCAAGATTCCGTCTAATCCTAGAT-3'  (SEQ ID NO: 8377)

5'-UCAAGAUUCCGUCUAAUCCUAGAta-3'  (SEQ ID NO: 3758)

3'-GAAGUUCUAAGGCAGAUUAGGAUCUAU-5'  (SEQ ID NO: 6068)

C5-617 Target:
5'-CTTCAAGATTCCGTCTAATCCTAGATA-3'  (SEQ ID NO: 8378)

5'-CAAGAUUCCGUCUAAUCCUAGAUat-3'  (SEQ ID NO: 3759)

3'-AAGUUCUAAGGCAGAUUAGGAUCUAUA-5'  (SEQ ID NO: 6069)

C5-618 Target:
5'-TTCAAGATTCCGTCTAATCCTAGATAT-3'  (SEQ ID NO: 8379)

5'-AAGAUUCCGUCUAAUCCUAGAUAtg-3'  (SEQ ID NO: 3760)

3'-AGUUCUAAGGCAGAUUAGGAUCUAUAC-5'  (SEQ ID NO: 6070)

C5-619 Target:
5'-TCAAGATTCCGTCTAATCCTAGATATG-3'  (SEQ ID NO: 8380)

5'-AGAUUCCGUCUAAUCCUAGAUAUgg-3'  (SEQ ID NO: 3761)

3'-GUUCUAAGGCAGAUUAGGAUCUAUACC-5'  (SEQ ID NO: 6071)

C5-620 Target:
5'-CAAGATTCCGTCTAATCCTAGATATGG-3'  (SEQ ID NO: 8381)

5'-GAUUCCGUCUAAUCCUAGAUAUGgt-3'  (SEQ ID NO: 3762)

3'-UUCUAAGGCAGAUUAGGAUCUAUACCA-5'  (SEQ ID NO: 6072)

C5-621 Target:
5'-AAGATTCCGTCTAATCCTAGATATGGT-3'  (SEQ ID NO: 8382)

5'-AUUCCGUCUAAUCCUAGAUAUGGta-3'  (SEQ ID NO: 3763)

3'-UCUAAGGCAGAUUAGGAUCUAUACCAU-5'  (SEQ ID NO: 6073)

C5-622 Target:
5'-AGATTCCGTCTAATCCTAGATATGGTA-3'  (SEQ ID NO: 8383)

5'-UUCCGUCUAAUCCUAGAUAUGGUat-3'  (SEQ ID NO: 3764)

3'-CUAAGGCAGAUUAGGAUCUAUACCAUA-5'  (SEQ ID NO: 6074)

C5-623 Target:
5'-GATTCCGTCTAATCCTAGATATGGTAT-3'  (SEQ ID NO: 8384)

5'-UCCGUCUAAUCCUAGAUAUGGUAtg-3'  (SEQ ID NO: 3765)

3'-UAAGGCAGAUUAGGAUCUAUACCAUAC-5'  (SEQ ID NO: 6075)
```

TABLE 7-continued

Human Anti-C5 DsiRNAs Predicted to have >50% Knockdown Efficacy (Asymmetrics)

C5-624 Target:
5'-ATTCCGTCTAATCCTAGATATGGTATG-3' (SEQ ID NO: 8385)

5'-CCGUCUAAUCCUAGAUAUGGUAUGt-3' (SEQ ID NO: 3766)

3'-AAGGCAGAUUAGGAUCUAUACCAUACA-5' (SEQ ID NO: 6076)

C5-625 Target:
5'-TTCCGTCTAATCCTAGATATGGTATGT-3' (SEQ ID NO: 8386)

5'-CGUCUAAUCCUAGAUAUGGUAUGtg-3' (SEQ ID NO: 3767)

3'-AGGCAGAUUAGGAUCUAUACCAUACAC-5' (SEQ ID NO: 6077)

C5-626 Target:
5'-TCCGTCTAATCCTAGATATGGTATGTG-3' (SEQ ID NO: 8387)

5'-GUCUAAUCCUAGAUAUGGUAUGUgg-3' (SEQ ID NO: 3768)

3'-GGCAGAUUAGGAUCUAUACCAUACACC-5' (SEQ ID NO: 6078)

C5-627 Target:
5'-CCGTCTAATCCTAGATATGGTATGTGG-3' (SEQ ID NO: 8388)

5'-UCUAAUCCUAGAUAUGGUAUGUGga-3' (SEQ ID NO: 3769)

3'-GCAGAUUAGGAUCUAUACCAUACACCU-5' (SEQ ID NO: 6079)

C5-628 Target:
5'-CGTCTAATCCTAGATATGGTATGTGGA-3' (SEQ ID NO: 8389)

5'-CUAAUCCUAGAUAUGGUAUGUGGac-3' (SEQ ID NO: 3770)

3'-CAGAUUAGGAUCUAUACCAUACACCUG-5' (SEQ ID NO: 6080)

C5-629 Target:
5'-GTCTAATCCTAGATATGGTATGTGGAC-3' (SEQ ID NO: 8390)

5'-UAAUCCUAGAUAUGGUAUGUGGAcg-3' (SEQ ID NO: 3771)

3'-AGAUUAGGAUCUAUACCAUACACCUGC-5' (SEQ ID NO: 6081)

C5-630 Target:
5'-TCTAATCCTAGATATGGTATGTGGACG-3' (SEQ ID NO: 8391)

5'-AAUCCUAGAUAUGGUAUGUGGACga-3' (SEQ ID NO: 3772)

3'-GAUUAGGAUCUAUACCAUACACCUGCU-5' (SEQ ID NO: 6082)

C5-631 Target:
5'-CTAATCCTAGATATGGTATGTGGACGA-3' (SEQ ID NO: 8392)

5'-AUCCUAGAUAUGGUAUGUGGACGat-3' (SEQ ID NO: 3773)

3'-AUUAGGAUCUAUACCAUACACCUGCUA-5' (SEQ ID NO: 6083)

C5-632 Target:
5'-TAATCCTAGATATGGTATGTGGACGAT-3' (SEQ ID NO: 8393)

5'-UCCUAGAUAUGGUAUGUGGACGAtc-3' (SEQ ID NO: 3774)

3'-UUAGGAUCUAUACCAUACACCUGCUAG-5' (SEQ ID NO: 6084)

C5-633 Target:
5'-AATCCTAGATATGGTATGTGGACGATC-3' (SEQ ID NO: 8394)

5'-CCUAGAUAUGGUAUGUGGACGAUca-3' (SEQ ID NO: 3775)

3'-UAGGAUCUAUACCAUACACCUGCUAGU-5' (SEQ ID NO: 6085)

C5-634 Target:
5'-ATCCTAGATATGGTATGTGGACGATCA-3' (SEQ ID NO: 8395)

5'-AGGCUAAAUAUAAGAGGACUUUtc-3' (SEQ ID NO: 3776)

3'-GUUCCGAUUUAUAUUUCUCCUGAAAAG-5' (SEQ ID NO: 6086)

C5-659 Target:
5'-CAAGGCTAAATATAAAGAGGACTTTTC-3' (SEQ ID NO: 8396)

5'-GGCUAAAUAUAAAGAGGACUUUUca-3' (SEQ ID NO: 3777)

3'-UUCCGAUUUAUAUUUCUCCUGAAAAGU-5' (SEQ ID NO: 6087)

C5-660 Target:
5'-AAGGCTAAATATAAAGAGGACTTTTCA-3' (SEQ ID NO: 8397)

5'-GCUAAAUAUAAAGAGGACUUUUCaa-3' (SEQ ID NO: 3778)

3'-UCCGAUUUAUAUUUCUCCUGAAAAGUU-5' (SEQ ID NO: 6088)

C5-661 Target:
5'-AGGCTAAATATAAAGAGGACTTTTCAA-3' (SEQ ID NO: 8398)

5'-CUAAAUAUAAAGAGGACUUUUCAac-3' (SEQ ID NO: 3779)

3'-CCGAUUUAUAUUUCUCCUGAAAAGUUG-5' (SEQ ID NO: 6089)

C5-662 Target:
5'-GGCTAAATATAAAGAGGACTTTTCAAC-3' (SEQ ID NO: 8399)

5'-UAAAUAUAAAGAGGACUUUUCAAca-3' (SEQ ID NO: 3780)

3'-CGAUUUAUAUUUCUCCUGAAAAGUUGU-5' (SEQ ID NO: 6090)

C5-663 Target:
5'-GCTAAATATAAAGAGGACTTTTCAACA-3' (SEQ ID NO: 8400)

5'-AAAUAUAAAGAGGACUUUUCAACaa-3' (SEQ ID NO: 3781)

3'-GAUUUAUAUUUCUCCUGAAAAGUUGUU-5' (SEQ ID NO: 6091)

C5-664 Target:
5'-CTAAATATAAAGAGGACTTTTCAACAA-3' (SEQ ID NO: 8401)

5'-AAUAUAAAGAGGACUUUUCAACAac-3' (SEQ ID NO: 3782)

3'-AUUUAUAUUUCUCCUGAAAAGUUGUUG-5' (SEQ ID NO: 6092)

C5-665 Target:
5'-TAAATATAAAGAGGACTTTTCAACAAC-3' (SEQ ID NO: 8402)

5'-AUAUAAAGAGGACUUUUCAACAAct-3' (SEQ ID NO: 3783)

3'-UUUAUAUUUCUCCUGAAAAGUUGUUGA-5' (SEQ ID NO: 6093)

C5-666 Target:
5'-AAATATAAAGAGGACTTTTCAACAACT-3' (SEQ ID NO: 8403)

5'-UAUAAAGAGGACUUUUCAACAACtg-3' (SEQ ID NO: 3784)

3'-UUAUAUUUCUCCUGAAAAGUUGUUGAC-5' (SEQ ID NO: 6094)

C5-667 Target:
5'-AATATAAAGAGGACTTTTCAACAACTG-3' (SEQ ID NO: 8404)

5'-AUAAAGAGGACUUUUCAACAACUgg-3' (SEQ ID NO: 3785)

3'-UAUAUUUCUCCUGAAAAGUUGUUGACC-5' (SEQ ID NO: 6095)

C5-668 Target:
5'-ATATAAAGAGGACTTTTCAACAACTGG-3' (SEQ ID NO: 8405)

5'-UAAAGAGGACUUUUCAACAACUGga-3' (SEQ ID NO: 3786)

3'-AUAUUUCUCCUGAAAAGUUGUUGACCU-5' (SEQ ID NO: 6096)

C5-669 Target:
5'-TATAAAGAGGACTTTTCAACAACTGGA-3' (SEQ ID NO: 8406)

5'-AAAGAGGACUUUUCAACAACUGGaa-3' (SEQ ID NO: 3787)

3'-UAUUUCUCCUGAAAAGUUGUUGACCUU-5' (SEQ ID NO: 6097)

TABLE 7-continued

Human Anti-C5 DsiRNAs Predicted to have >50% Knockdown Efficacy (Asymmetrics)

C5-670 Target:
5'-ATAAAGAGGACTTTTCAACAACTGGAA-3' (SEQ ID NO: 8407)

5'-A<u>G</u>AGGACUUUUC<u>A</u>AC<u>A</u>ACUGGAac-3' (SEQ ID NO: 3788)

3'-<u>AUU</u>U<u>C</u>UCCUGAAAA<u>G</u>UU<u>G</u>UUGAC<u>C</u>UUG-5' (SEQ ID NO: 6098)

C5-671 Target:
5'-TAAAGAGGACTTTTCAACAACTGGAAC-3' (SEQ ID NO: 8408)

5'-A<u>G</u>AGGACUUUUC<u>A</u>AC<u>A</u>ACUGGAAcc-3' (SEQ ID NO: 3789)

3'-<u>UUU</u>C<u>U</u>CCUGAAAAG<u>UU</u>G<u>U</u>UGACC<u>UUGG</u>-5' (SEQ ID NO: 6099)

C5-672 Target:
5'-AAAGAGGACTTTTCAACAACTGGAACC-3' (SEQ ID NO: 8409)

5'-G<u>AG</u>GACUUUUCAAC<u>A</u>ACUGGAACcg-3' (SEQ ID NO: 3790)

3'-<u>UUCU</u>C<u>C</u>UGAAAAGUU<u>G</u>UUGACCUUGGC-5' (SEQ ID NO: 6100)

C5-673 Target:
5'-AAGAGGACTTTTCAACAACTGGAACCG-3' (SEQ ID NO: 8410)

5'-A<u>GG</u>ACUUUUCAAC<u>A</u>ACUGGAACCgc-3' (SEQ ID NO: 3791)

3'-<u>UCU</u>CCUGAAAAGUU<u>G</u>UUGACCUUGGCG-5' (SEQ ID NO: 6101)

C5-674 Target:
5'-AGAGGACTTTTCAACAACTGGAACCGC-3' (SEQ ID NO: 8411)

5'-G<u>GA</u>CUUUUCAAC<u>A</u>ACUGGAACCGca-3' (SEQ ID NO: 3792)

3'-<u>CUC</u>CUGAAAAGUUG<u>UU</u>GACCUUGGCGU-5' (SEQ ID NO: 6102)

C5-675 Target:
5'-GAGGACTTTTCAACAACTGGAACCGCA-3' (SEQ ID NO: 8412)

5'-G<u>AC</u>UUUUCAACAACUGGAACCGCat-3' (SEQ ID NO: 3793)

3'-<u>UCC</u>UGAAAAGUUGUUGA<u>C</u>CUUGGCGUA-5' (SEQ ID NO: 6103)

C5-676 Target:
5'-AGGACTTTTCAACAACTGGAACCGCAT-3' (SEQ ID NO: 8413)

5'-A<u>C</u>UUUUCAACAACUGGAACCGCAta-3' (SEQ ID NO: 3794)

3'-<u>CCU</u>GAAAAGUUGUUGACCUUGGCGUAU-5' (SEQ ID NO: 6104)

C5-677 Target:
5'-GGACTTTTCAACAACTGGAACCGCATA-3' (SEQ ID NO: 8414)

5'-<u>UUUUG</u>AAGUUAAAG<u>AA</u>UAUGUCUtg-3' (SEQ ID NO: 3795)

3'-<u>AUAAA</u>CUUCAAUUU<u>C</u>UUAUACA<u>G</u>AAC-5' (SEQ ID NO: 6105)

C5-702 Target:
5'-TATTTTGAAGTTAAAGAATATGTCTTG-3' (SEQ ID NO: 8415)

5'-<u>UUUG</u>AAGUUAAAG<u>AA</u>UAUGUCUUGc-3' (SEQ ID NO: 3796)

3'-<u>UAAAA</u>CUUCAAUUU<u>C</u>UUAUACAG<u>AACG</u>-5' (SEQ ID NO: 6106)

C5-703 Target:
5'-ATTTTGAAGTTAAAGAATATGTCTTGC-3' (SEQ ID NO: 8416)

5'-<u>UUG</u>AAGUUAAAG<u>AA</u>UAUGUCUUGcc-3' (SEQ ID NO: 3797)

3'-<u>AAAA</u>CUUCAAUUU<u>C</u>UUAUACAGAAC<u>G</u>G-5' (SEQ ID NO: 6107)

C5-704 Target:
5'-TTTTGAAGTTAAAGAATATGTCTTGCC-3' (SEQ ID NO: 8417)

5'-U<u>G</u>AAGUUAAAGA<u>A</u>U<u>A</u>UGUCUUGCca-3' (SEQ ID NO: 3798)

3'-<u>AAA</u>CUUCAAUUUCUU<u>A</u>UACAGAACGGU-5' (SEQ ID NO: 6108)

TABLE 7-continued

Human Anti-C5 DsiRNAs Predicted to have >50% Knockdown Efficacy (Asymmetrics)

C5-705 Target:
5'-TTTGAAGTTAAAGAATATGTCTTGCCA-3' (SEQ ID NO: 8418)

5'-G<u>AAG</u>UUAAAGAAU<u>AU</u>GUCUUGCCac-3' (SEQ ID NO: 3799)

3'-<u>AAC</u>UUCAAUUUCUUA<u>U</u>ACAGAACG<u>G</u>UG-5' (SEQ ID NO: 6109)

C5-706 Target:
5'-TTGAAGTTAAAGAATATGTCTTGCCAC-3' (SEQ ID NO: 8419)

5'-<u>A</u>AGUUAAAGAAUAU<u>G</u>UCUUGCCAca-3' (SEQ ID NO: 3800)

3'-<u>ACU</u>UCAAUUUCUUAU<u>A</u>CAGAACG<u>G</u>UGU-5' (SEQ ID NO: 6110)

C5-707 Target:
5'-TGAAGTTAAAGAATATGTCTTGCCACA-3' (SEQ ID NO: 8420)

5'-<u>A</u>GUUAAAGAAUAUG<u>UC</u>UUGCCACat-3' (SEQ ID NO: 3801)

3'-<u>CUU</u>CAAUUUCUUAUA<u>C</u>AGAACGGUGUA-5' (SEQ ID NO: 6111)

C5-708 Target:
5'-GAAGTTAAAGAATATGTCTTGCCACAT-3' (SEQ ID NO: 8421)

5'-<u>G</u>UU<u>A</u>AAGAAUAUG<u>UC</u>UUGCCACAtt-3' (SEQ ID NO: 3802)

3'-<u>UUC</u>AAUUUCUUAUAC<u>A</u>GAACGGUGUAA-5' (SEQ ID NO: 6112)

C5-709 Target:
5'-AAGTTAAAGAATATGTCTTGCCACATT-3' (SEQ ID NO: 8422)

5'-<u>A</u>AG<u>A</u>AUAUGUCUUG<u>CC</u>ACAUUUUtc-3' (SEQ ID NO: 3803)

3'-<u>AUUU</u>CUUAUACAGA<u>A</u>CGGUGUA<u>AAAG</u>-5' (SEQ ID NO: 6113)

C5-713 Target:
5'-TAAAGAATATGTCTTGCCACATTTTTC-3' (SEQ ID NO: 8423)

5'-A<u>G</u>A<u>A</u>UAUGUCUUGCC<u>A</u>CAUUUUUct-3' (SEQ ID NO: 3804)

3'-<u>UUU</u>CUUAUACAGAAC<u>G</u>GUGUAAAA<u>AGA</u>-5' (SEQ ID NO: 6114)

C5-714 Target:
5'-AAAGAATATGTCTTGCCACATTTTTCT-3' (SEQ ID NO: 8424)

5'-G<u>A</u>A<u>U</u>AUGUCUUGCC<u>AC</u>AUUUUUCtg-3' (SEQ ID NO: 3805)

3'-<u>UUC</u>UUAUACAGAACG<u>G</u>UGUAAAAAGAC-5' (SEQ ID NO: 6115)

C5-715 Target:
5'-AAGAATATGTCTTGCCACATTTTTCTG-3' (SEQ ID NO: 8425)

5'-A<u>A</u>U<u>A</u>UGUCUUGCC<u>AC</u>AUUUUUCUgt-3' (SEQ ID NO: 3806)

3'-<u>UC</u>UU<u>A</u>UACAGAACGG<u>U</u>GUAAAAAGACA-5' (SEQ ID NO: 6116)

C5-716 Target:
5'-AGAATATGTCTTGCCACATTTTTCTGT-3' (SEQ ID NO: 8426)

5'-<u>A</u>U<u>A</u>UGUCUUGCCAC<u>A</u>UUUUUCUGtc-3' (SEQ ID NO: 3807)

3'-<u>CUU</u>AUACAGAACGGUGUAAAAAGACAG-5' (SEQ ID NO: 6117)

C5-717 Target:
5'-GAATATGTCTTGCCACATTTTTCTGTC-3' (SEQ ID NO: 8427)

5'-<u>U</u>A<u>U</u>GUCUUGCCAC<u>A</u>UUUUUCUGUct-3' (SEQ ID NO: 3808)

3'-<u>UUU</u>AUACAGAACGGUGUAAAAAGACAGA-5' (SEQ ID NO: 6118)

C5-718 Target:
5'-AATATGTCTTGCCACATTTTTCTGTCT-3' (SEQ ID NO: 8428)

5'-<u>A</u>UGUCUUGCCAC<u>A</u>UUUUUCUGUCtc-3' (SEQ ID NO: 3809)

3'-<u>UAUA</u>CAGAACGGUGU<u>A</u>AAAAGAC<u>AGAG</u>-5' (SEQ ID NO: 6119)

TABLE 7-continued

Human Anti-C5 DsiRNAs Predicted to have >50% Knockdown Efficacy (Asymmetrics)

C5-719 Target:
5'-ATATGTCTTGCCACATTTTTCTGTCTC-3' (SEQ ID NO: 8429)

5'-U<u>GUC</u>UUGCCACAU<u>UUUUC</u>UGUCUCca-3' (SEQ ID NO: 3810)

3'-<u>AUACAG</u>AACGGUGU<u>AAAAA</u>GACA<u>G</u>AGU-5' (SEQ ID NO: 6120)

C5-720 Target:
5'-TATGTCTTGCCACATTTTTCTGTCTCA-3' (SEQ ID NO: 8430)

5'-<u>GUC</u>UUGCCACAU<u>UUUUC</u>UGUCUCaa-3' (SEQ ID NO: 3811)

3'-<u>UACAG</u>AACGGUGU<u>AAAAA</u>GACAGAGUU-5' (SEQ ID NO: 6121)

C5-721 Target:
5'-ATGTCTTGCCACATTTTTCTGTCTCAA-3' (SEQ ID NO: 8431)

5'-U<u>C</u>UUGCCACAU<u>UUUUC</u>UGUCUCAat-3' (SEQ ID NO: 3812)

3'-<u>ACAG</u>AACGGUGUA<u>AAAA</u>GACAGA<u>G</u>UUA-5' (SEQ ID NO: 6122)

C5-722 Target:
5'-TGTCTTGCCACATTTTTCTGTCTCAAT-3' (SEQ ID NO: 8432)

5'-<u>C</u>UUGCCACAU<u>UUUUC</u>UGUCUCAAtc-3' (SEQ ID NO: 3813)

3'-<u>CAGA</u>ACGGUGUAA<u>AAA</u>GACAGAGUUAG-5' (SEQ ID NO: 6123)

C5-723 Target:
5'-GTCTTGCCACATTTTTCTGTCTCAATC-3' (SEQ ID NO: 8433)

5'-UU<u>G</u>CCACAU<u>UUUUC</u>UGUCUCAAUcg-3' (SEQ ID NO: 3814)

3'-<u>AGA</u>ACGGUGUAAAA<u>AG</u>ACAGAGUU<u>AGC</u>-5' (SEQ ID NO: 6124)

C5-724 Target:
5'-TCTTGCCACATTTTTCTGTCTCAATCG-3' (SEQ ID NO: 8434)

5'-U<u>GC</u>CACAU<u>UUUUC</u>UGUCUCAAUCga-3' (SEQ ID NO: 3815)

3'-<u>GAA</u>CGGUGUAAAA<u>A</u>GA<u>C</u>AGAGUU<u>AGCU</u>-5' (SEQ ID NO: 6125)

C5-725 Target:
5'-CTTGCCACATTTTTCTGTCTCAATCGA-3' (SEQ ID NO: 8435)

5'-G<u>CC</u>ACAU<u>UUUUC</u>UG<u>UC</u>UCAAUCGag-3' (SEQ ID NO: 3816)

3'-<u>AAC</u>GGUGUAAAAA<u>G</u>A<u>C</u>AGAGUU<u>AGCUC</u>-5' (SEQ ID NO: 6126)

C5-726 Target:
5'-TTGCCACATTTTTCTGTCTCAATCGAG-3' (SEQ ID NO: 8436)

5'-G<u>AAC</u>UUUAAGAAU<u>UUU</u>GAAAUUAct-3' (SEQ ID NO: 3817)

3'-<u>UUCU</u>UGAAAUUCUU<u>AAAA</u>CUUUA<u>AUGA</u>-5' (SEQ ID NO: 6127)

C5-777 Target:
5'-AAGAACTTTAAGAATTTTGAAATTACT-3' (SEQ ID NO: 8437)

5'-A<u>AC</u>UUUAAGAAUUU<u>U</u>GAAAUUACta-3' (SEQ ID NO: 3818)

3'-<u>UCUU</u>GAAAUUCUUA<u>AAAC</u>UUUA<u>AUGAU</u>-5' (SEQ ID NO: 6128)

C5-778 Target:
5'-AGAACTTTAAGAATTTTGAAATTACTA-3' (SEQ ID NO: 8438)

5'-A<u>C</u>UUUAAGAAUUUUG<u>A</u>AAUUAC<u>U</u>at-3' (SEQ ID NO: 3819)

3'-<u>CUUG</u>AAAUUCUUAA<u>AAC</u>UUUA<u>AUGAUA</u>-5' (SEQ ID NO: 6129)

C5-779 Target:
5'-GAACTTTAAGAATTTTGAAATTACTAT-3' (SEQ ID NO: 8439)

5'-U<u>UU</u>AAGAAUUUUG<u>AAAU</u>UACUAUaa-3' (SEQ ID NO: 3820)

3'-<u>UGAAA</u>UUCUUAAAAC<u>U</u>UUA<u>AUGAUAUU</u>-5' (SEQ ID NO: 6130)

C5-781 Target:
5'-ACTTTAAGAATTTTGAAATTACTATAA-3' (SEQ ID NO: 8440)

5'-U<u>U</u>AAGAAUUUUG<u>A</u>AA<u>U</u>UACUAUAaa-3' (SEQ ID NO: 3821)

3'-<u>GAAAU</u>UCUUAAAAC<u>UU</u>UA<u>AUGAUAUUU</u>-5' (SEQ ID NO: 6131)

C5-782 Target:
5'-CTTTAAGAATTTTGAAATTACTATAAA-3' (SEQ ID NO: 8441)

5'-U<u>AA</u>GAAUUUUGAAA<u>U</u>UACUAUAAaa-3' (SEQ ID NO: 3822)

3'-<u>AAAU</u>CUUAAAACUUUA<u>AUGAUAUUUU</u>-5' (SEQ ID NO: 6132)

C5-783 Target:
5'-TTTAAGAATTTTGAAATTACTATAAAA-3' (SEQ ID NO: 8442)

5'-A<u>AG</u>AAUUUUGAAAU<u>UA</u>CUAUAAAag-3' (SEQ ID NO: 3823)

3'-<u>AAUU</u>CUUAAAACUUU<u>A</u>AUGAUAUU<u>UUC</u>-5' (SEQ ID NO: 6133)

C5-784 Target:
5'-TTAAGAATTTTGAAATTACTATAAAAG-3' (SEQ ID NO: 8443)

5'-A<u>GAA</u>UUUUGAAAU<u>UAC</u>UAUAAAAgc-3' (SEQ ID NO: 3824)

3'-<u>AUUC</u>UUAAAACUUU<u>A</u>AUGAUAUU<u>UUCG</u>-5' (SEQ ID NO: 6134)

C5-785 Target:
5'-TAAGAATTTTGAAATTACTATAAAAGC-3' (SEQ ID NO: 8444)

5'-U<u>UUU</u>GAAAUUACU<u>AU</u>AAAAGCAAga-3' (SEQ ID NO: 3825)

3'-<u>UUAAA</u>ACUUUAAUG<u>AU</u>AUUUUCG<u>UUCU</u>-5' (SEQ ID NO: 6135)

C5-789 Target:
5'-AATTTGAAATTACTATAAAAGCAAGA-3' (SEQ ID NO: 8445)

5'-U<u>UU</u>GAAAUUACUAU<u>AAAA</u>GCAAGat-3' (SEQ ID NO: 3826)

3'-<u>UAAAA</u>CUUUAAUGAU<u>AUU</u>UUCGUU<u>CUA</u>-5' (SEQ ID NO: 6136)

C5-790 Target:
5'-ATTTTGAAATTACTATAAAAGCAAGAT-3' (SEQ ID NO: 8446)

5'-A<u>AA</u>UUACUAUAAAA<u>GC</u>AAGAUAUtt-3' (SEQ ID NO: 3827)

3'-<u>ACU</u>UUAAUGAUAUU<u>UUC</u>GUUCUAU<u>AAA</u>-5' (SEQ ID NO: 6137)

C5-794 Target:
5'-TGAAATTACTATAAAAGCAAGATATTT-3' (SEQ ID NO: 8447)

5'-A<u>AU</u>UACUAUAAAAG<u>C</u>AAGAUAUtt-3' (SEQ ID NO: 3828)

3'-<u>CUUU</u>AAUGAUAUUUUCG<u>UUCUAU<u>AAAA</u>-5' (SEQ ID NO: 6138)

C5-795 Target:
5'-GAAATTACTATAAAAGCAAGATATTTT-3' (SEQ ID NO: 8448)

5'-A<u>UU</u>ACUAUAAAAGC<u>A</u>AGAUAUUtt-3' (SEQ ID NO: 3829)

3'-<u>UUUA</u>AUGAUAUUUUCG<u>UUCUAUAAAA</u>-5' (SEQ ID NO: 6139)

C5-796 Target:
5'-AAATTACTATAAAAGCAAGATATTTTT-3' (SEQ ID NO: 8449)

5'-UU<u>A</u>CUAUAAAAGC<u>AA</u>GAUAUUUta-3' (SEQ ID NO: 3830)

3'-<u>UUAA</u>UGAUAUUUUCG<u>UU</u>CUAUAAAAU-5' (SEQ ID NO: 6140)

C5-797 Target:
5'-AATTACTATAAAAGCAAGATATTTTTA-3' (SEQ ID NO: 8450)

5'-U<u>AC</u>UAUAAAAGCAAG<u>A</u>UAUUUUat-3' (SEQ ID NO: 3831)

3'-<u>UAAU</u>GAUAUUUUCG<u>UUC</u>UAUAAAA<u>AUA</u>-5' (SEQ ID NO: 6141)

TABLE 7-continued

Human Anti-C5 DsiRNAs Predicted to have >50% Knockdown Efficacy (Asymmetrics)

C5-798 Target:
5'-ATTACTATAAAAGCAAGATATTTTTAT-3' (SEQ ID NO: 8451)

5'-ACUAUAAAAGCAAGAUAUUUUUAta-3' (SEQ ID NO: 3832)

3'-AAUGAUAUUUUCGUUCUAUAAAAAUAU-5' (SEQ ID NO: 6142)

C5-799 Target:
5'-TTACTATAAAAGCAAGATATTTTTATA-3' (SEQ ID NO: 8452)

5'-CUAUAAAAGCAAGAUAUUUUUAUaa-3' (SEQ ID NO: 3833)

3'-AUGAUAUUUUCGUUCUAUAAAAAUAUU-5' (SEQ ID NO: 6143)

C5-800 Target:
5'-TACTATAAAAGCAAGATATTTTTATAA-3' (SEQ ID NO: 8453)

5'-UAUAAAAGCAAGAUAUUUUUAUAat-3' (SEQ ID NO: 3834)

3'-UGAUAUUUUCGUUCUAUAAAAAUAUUA-5' (SEQ ID NO: 6144)

C5-801 Target:
5'-ACTATAAAAGCAAGATATTTTTATAAT-3' (SEQ ID NO: 8454)

5'-AUAAAAGCAAGAUAUUUUUAUAAta-3' (SEQ ID NO: 3835)

3'-GAUAUUUUCGUUCUAUAAAAAUAUUAU-5' (SEQ ID NO: 6145)

C5-802 Target:
5'-CTATAAAAGCAAGATATTTTTATAATA-3' (SEQ ID NO: 8455)

5'-UAAAAGCAAGAUAUUUUUAUAAUaa-3' (SEQ ID NO: 3836)

3'-AUAUUUUCGUUCUAUAAAAAUAUUAUU-5' (SEQ ID NO: 6146)

C5-803 Target:
5'-TATAAAAGCAAGATATTTTTATAATAA-3' (SEQ ID NO: 8456)

5'-AAAAGCAAGAUAUUUUUAUAAUAaa-3' (SEQ ID NO: 3837)

3'-UAUUUUCGUUCUAUAAAAAUAUUAUU-5' (SEQ ID NO: 6147)

C5-804 Target:
5'-ATAAAAGCAAGATATTTTTATAATAAA-3' (SEQ ID NO: 8457)

5'-AUAUUUUUAUAAUAAAGUAGUCAct-3' (SEQ ID NO: 3838)

3'-UCUAUAAAAAUAUUAUUUCAUCAGUGA-5' (SEQ ID NO: 6148)

C5-813 Target:
5'-AGATATTTTTATAATAAAGTAGTCACT-3' (SEQ ID NO: 8458)

5'-UAUUUUUAUAAUAAAGUAGUCACtg-3' (SEQ ID NO: 3839)

3'-CUAUAAAAAUAUUAUUUCAUCAGUGAC-5' (SEQ ID NO: 6149)

C5-814 Target:
5'-GATATTTTTATAATAAAGTAGTCACTG-3' (SEQ ID NO: 8459)

5'-AUUUUUAUAAUAAAGUAGUCACUga-3' (SEQ ID NO: 3840)

3'-UAUAAAAAUAUUAUUUCAUCAGUGACU-5' (SEQ ID NO: 6150)

C5-815 Target:
5'-ATATTTTTATAATAAAGTAGTCACTGA-3' (SEQ ID NO: 8460)

5'-UUUUUAUAAUAAAGUAGUCACUGag-3' (SEQ ID NO: 3841)

3'-AUAAAAAUAUUAUUUCAUCAGUGACUC-5' (SEQ ID NO: 6151)

C5-816 Target:
5'-TATTTTTATAATAAAGTAGTCACTGAG-3' (SEQ ID NO: 8461)

5'-UUUUUAUAAUAAAGUAGUCACUGAgg-3' (SEQ ID NO: 3842)

3'-UAAAAAUAUUAUUUCAUCAGUGACUCC-5' (SEQ ID NO: 6152)

C5-817 Target:
5'-ATTTTTATAATAAAGTAGTCACTGAGG-3' (SEQ ID NO: 8462)

5'-UUUAUAAUAAAGUAGUCACUGAGgc-3' (SEQ ID NO: 3843)

3'-AAAAAUAUUAUUUCAUCAGUGACUCCG-5' (SEQ ID NO: 6153)

C5-818 Target:
5'-TTTTTATAATAAAGTAGTCACTGAGGC-3' (SEQ ID NO: 8463)

5'-UUUAUAAUAAAGUAGUCACUGAGGct-3' (SEQ ID NO: 3844)

3'-AAAAUAUUAUUUCAUCAGUGACUCCGA-5' (SEQ ID NO: 6154)

C5-819 Target:
5'-TTTTATAATAAAGTAGTCACTGAGGCT-3' (SEQ ID NO: 8464)

5'-UAUAAUAAAGUAGUCACUGAGGCtg-3' (SEQ ID NO: 3845)

3'-AAAUAUUAUUUCAUCAGUGACUCCGAC-5' (SEQ ID NO: 6155)

C5-820 Target:
5'-TTTATAATAAAGTAGTCACTGAGGCTG-3' (SEQ ID NO: 8465)

5'-AUAAUAAAGUAGUCACUGAGGCUga-3' (SEQ ID NO: 3846)

3'-AAUAUUAUUUCAUCAGUGACUCCGACU-5' (SEQ ID NO: 6156)

C5-821 Target:
5'-TTATAATAAAGTAGTCACTGAGGCTGA-3' (SEQ ID NO: 8466)

5'-UAUAAUAAAGUAGUCACUGAGGCUGac-3' (SEQ ID NO: 3847)

3'-AUAUUAUUUCAUCAGUGACUCCGACUG-5' (SEQ ID NO: 6157)

C5-822 Target:
5'-TATAATAAAGTAGTCACTGAGGCTGAC-3' (SEQ ID NO: 8467)

5'-AAUAAAGUAGUCACUGAGGCUGAcg-3' (SEQ ID NO: 3848)

3'-UAUUAUUUCAUCAGUGACUCCGACUGC-5' (SEQ ID NO: 6158)

C5-823 Target:
5'-ATAATAAAGTAGTCACTGAGGCTGACG-3' (SEQ ID NO: 8468)

5'-AUAAAGUAGUCACUGAGGCUGACgt-3' (SEQ ID NO: 3849)

3'-AUUAUUUCAUCAGUGACUCCGACUGCA-5' (SEQ ID NO: 6159)

C5-824 Target:
5'-TAATAAAGTAGTCACTGAGGCTGACGT-3' (SEQ ID NO: 8469)

5'-UAAAGUAGUCACUGAGGCUGACGtt-3' (SEQ ID NO: 3850)

3'-UUAUUUCAUCAGUGACUCCGACUGCAA-5' (SEQ ID NO: 6160)

C5-825 Target:
5'-AATAAAGTAGTCACTGAGGCTGACGTT-3' (SEQ ID NO: 8470)

5'-AAAGUAGUCACUGAGGCUGACGUtt-3' (SEQ ID NO: 3851)

3'-UAUUUCAUCAGUGACUCCGACUGCAAA-5' (SEQ ID NO: 6161)

C5-826 Target:
5'-ATAAAGTAGTCACTGAGGCTGACGTTT-3' (SEQ ID NO: 8471)

5'-AAGUAGUCACUGAGGCUGACGUUta-3' (SEQ ID NO: 3852)

3'-AUUUCAUCAGUGACUCCGACUGCAAAU-5' (SEQ ID NO: 6162)

C5-827 Target:
5'-TAAAGTAGTCACTGAGGCTGACGTTTA-3' (SEQ ID NO: 8472)

5'-GUUUAUAUCACAUUUGGAAUAAGag-3' (SEQ ID NO: 3853)

3'-UGCAAAUAUAGUGUAAACCUUAUUCUC-5' (SEQ ID NO: 6163)

TABLE 7-continued

Human Anti-C5 DsiRNAs Predicted to have >50% Knockdown Efficacy (Asymmetrics)

C5-847 Target:
5'-ACGTTTATATCACATTTGGAATAAGAG-3' (SEQ ID NO: 8473)

5'-UUUAUAUCACAUUUGGAAUAAGAGa-3' (SEQ ID NO: 3854)

3'-GCAAAUAUAGUGUAAACCUUAUUCUCU-5' (SEQ ID NO: 6164)

C5-848 Target:
5'-CGTTTATATCACATTTGGAATAAGAGA-3' (SEQ ID NO: 8474)

5'-UUAUAUCACAUUUGGAAUAAGAGAa-3' (SEQ ID NO: 3855)

3'-CAAAUAUAGUGUAAACCUUAUUCUCUU-5' (SEQ ID NO: 6165)

C5-849 Target:
5'-GTTTATATCACATTTGGAATAAGAGAA-3' (SEQ ID NO: 8475)

5'-UAUAUCACAUUUGGAAUAAGAGAag-3' (SEQ ID NO: 3856)

3'-AAAUAUAGUGUAAACCUUAUUCUCUUC-5' (SEQ ID NO: 6166)

C5-850 Target:
5'-TTTATATCACATTTGGAATAAGAGAAG-3' (SEQ ID NO: 8476)

5'-AUAUCACAUUUGGAAUAAGAGAAga-3' (SEQ ID NO: 3857)

3'-AAUAUAGUGUAAACCUUAUUCUCUUCU-5' (SEQ ID NO: 6167)

C5-851 Target:
5'-TTATATCACATTTGGAATAAGAGAAGA-3' (SEQ ID NO: 8477)

5'-UAUCACAUUUGGAAUAAGAGAAGac-3' (SEQ ID NO: 3858)

3'-AUAUAGUGUAAACCUUAUUCUCUUCUG-5' (SEQ ID NO: 6168)

C5-852 Target:
5'-TATATCACATTTGGAATAAGAGAAGAC-3' (SEQ ID NO: 8478)

5'-AUCACAUUUGGAAUAAGAGAAGAct-3' (SEQ ID NO: 3859)

3'-UAUAGUGUAAACCUUAUUCUCUUCUGA-5' (SEQ ID NO: 6169)

C5-853 Target:
5'-ATATCACATTTGGAATAAGAGAAGACT-3' (SEQ ID NO: 8479)

5'-UCACAUUUGGAAUAAGAGAAGACtt-3' (SEQ ID NO: 3860)

3'-AUAGUGUAAACCUUAUUCUCUUCUGAA-5' (SEQ ID NO: 6170)

C5-854 Target:
5'-TATCACATTTGGAATAAGAGAAGACTT-3' (SEQ ID NO: 8480)

5'-CACAUUUGGAAUAAGAGAAGACUta-3' (SEQ ID NO: 3861)

3'-UAGUGUAAACCUUAUUCUCUUCUGAAU-5' (SEQ ID NO: 6171)

C5-855 Target:
5'-ATCACATTTGGAATAAGAGAAGACTTA-3' (SEQ ID NO: 8481)

5'-ACAUUUGGAAUAAGAGAAGACUUaa-3' (SEQ ID NO: 3862)

3'-AGUGUAAACCUUAUUCUCUUCUGAAUU-5' (SEQ ID NO: 6172)

C5-856 Target:
5'-TCACATTTGGAATAAGAGAAGACTTAA-3' (SEQ ID NO: 8482)

5'-CAUUUGGAAUAAGAGAAGACUUAaa-3' (SEQ ID NO: 3863)

3'-GUGUAAACCUUAUUCUCUUCUGAAUU-5' (SEQ ID NO: 6173)

C5-857 Target:
5'-CACATTTGGAATAAGAGAAGACTTAAA-3' (SEQ ID NO: 8483)

5'-AUUUGGAAUAAGAGAAGACUUAAaa-3' (SEQ ID NO: 3864)

3'-UGUAAACCUUAUUCUCUUCUGAAUUUU-5' (SEQ ID NO: 6174)

C5-858 Target:
5'-ACATTTGGAATAAGAGAAGACTTAAAA-3' (SEQ ID NO: 8484)

5'-UUUGGAAUAAGAGAAGACUUAAAag-3' (SEQ ID NO: 3865)

3'-GUAAACCUUAUUCUCUUCUGAAUUUUC-5' (SEQ ID NO: 6175)

C5-859 Target:
5'-CATTTGGAATAAGAGAAGACTTAAAAG-3' (SEQ ID NO: 8485)

5'-UUGGAAUAAGAGAAGACUUAAAAga-3' (SEQ ID NO: 3866)

3'-UAAACCUUAUUCUCUUCUGAAUUUUCU-5' (SEQ ID NO: 6176)

C5-860 Target:
5'-ATTTGGAATAAGAGAAGACTTAAAAGA-3' (SEQ ID NO: 8486)

5'-UGGAAUAAGAGAAGACUUAAAAGat-3' (SEQ ID NO: 3867)

3'-AAACCUUAUUCUCUUCUGAAUUUUCUA-5' (SEQ ID NO: 6177)

C5-861 Target:
5'-TTTGGAATAAGAGAAGACTTAAAAGAT-3' (SEQ ID NO: 8487)

5'-GGAAUAAGAGAAGACUUAAAAGAtg-3' (SEQ ID NO: 3868)

3'-AACCUUAUUCUCUUCUGAAUUUUCUAC-5' (SEQ ID NO: 6178)

C5-862 Target:
5'-TTGGAATAAGAGAAGACTTAAAAGATG-3' (SEQ ID NO: 8488)

5'-GAAUAAGAGAAGACUUAAAAGAUga-3' (SEQ ID NO: 3869)

3'-ACCUUAUUCUCUUCUGAAUUUUCUACU-5' (SEQ ID NO: 6179)

C5-863 Target:
5'-TGGAATAAGAGAAGACTTAAAAGATGA-3' (SEQ ID NO: 8489)

5'-AAUAAGAGAAGACUUAAAAGAUGat-3' (SEQ ID NO: 3870)

3'-CCUUAUUCUCUUCUGAAUUUUCUACUA-5' (SEQ ID NO: 6180)

C5-864 Target:
5'-GGAATAAGAGAAGACTTAAAAGATGAT-3' (SEQ ID NO: 8490)

5'-AUAAGAGAAGACUUAAAAGAUGAtc-3' (SEQ ID NO: 3871)

3'-CUUAUUCUCUUCUGAAUUUUCUACUAG-5' (SEQ ID NO: 6181)

C5-865 Target:
5'-GAATAAGAGAAGACTTAAAAGATGATC-3' (SEQ ID NO: 8491)

5'-UAAGAGAAGACUUAAAAGAUGAUca-3' (SEQ ID NO: 3872)

3'-UUAUUCUCUUCUGAAUUUUCUACUAGU-5' (SEQ ID NO: 6182)

C5-866 Target:
5'-AATAAGAGAAGACTTAAAAGATGATCA-3' (SEQ ID NO: 8492)

5'-AAGAGAAGACUUAAAAGAUGAUCaa-3' (SEQ ID NO: 3873)

3'-UAUUCUCUUCUGAAUUUUCUACUAGUU-5' (SEQ ID NO: 6183)

C5-867 Target:
5'-ATAAGAGAAGACTTAAAAGATGATCAA-3' (SEQ ID NO: 8493)

5'-AGAGAAGACUUAAAAGAUGAUCaaa-3' (SEQ ID NO: 3874)

3'-AUUCUCUUCUGAAUUUUCUACUAGUUU-5' (SEQ ID NO: 6184)

C5-868 Target:
5'-TAAGAGAAGACTTAAAAGATGATCAAA-3' (SEQ ID NO: 8494)

5'-GAGAAGACUUAAAAGAUGAUCAAaa-3' (SEQ ID NO: 3875)

3'-UUCUCUUCUGAAUUUUCUACUAGUUUU-5' (SEQ ID NO: 6185)

TABLE 7-continued

Human Anti-C5 DsiRNAs Predicted to have >50% Knockdown Efficacy (Asymmetrics)

C5-869 Target:
5'-AAGAGAAGACTTAAAAGATGATCAAAA-3' (SEQ ID NO: 8495)

5'-A<u>GA</u>AGACUUAAAAG<u>AU</u>GAUCAAAaa-3' (SEQ ID NO: 3876)

3'-<u>UCUC</u>UUCUGAAUUUU<u>CU</u>ACUAGU<u>UUUU</u>-5' (SEQ ID NO: 6186)

C5-870 Target:
5'-AGAGAAGACTTAAAAGATGATCAAAAA-3' (SEQ ID NO: 8496)

5'-G<u>AA</u>GACUUAAAAG<u>AU</u>GAUCAAAAag-3' (SEQ ID NO: 3877)

3'-<u>CUC</u>UUCUGAAUUUU<u>CU</u>ACUAGU<u>UUUUC</u>-5' (SEQ ID NO: 6187)

C5-871 Target:
5'-GAGAAGACTTAAAAGATGATCAAAAAG-3' (SEQ ID NO: 8497)

5'-A<u>AG</u>ACUUAAAAGAU<u>GA</u>UCAAAAAga-3' (SEQ ID NO: 3878)

3'-<u>UC</u>UU<u>C</u>UGAAUUUU<u>CU</u>ACUAGU<u>UUUU</u>CU-5' (SEQ ID NO: 6188)

C5-872 Target:
5'-AGAAGACTTAAAAGATGATCAAAAAGA-3' (SEQ ID NO: 8498)

5'-A<u>GA</u>CUUAAAAGAUG<u>AU</u>CAAAAAGaa-3' (SEQ ID NO: 3879)

3'-<u>C</u>UUCUGAAUUUU<u>CU</u>ACUAGU<u>UUUU</u>CUU-5' (SEQ ID NO: 6189)

C5-873 Target:
5'-GAAGACTTAAAAGATGATCAAAAAGAA-3' (SEQ ID NO: 8499)

5'-G<u>AC</u>UUAAAAGAUG<u>AU</u>CAAAAAGaa-3' (SEQ ID NO: 3880)

3'-<u>UUC</u>UGAAUUUU<u>CU</u>ACUAGU<u>UUUU</u>CUUU-5' (SEQ ID NO: 6190)

C5-874 Target:
5'-AAGACTTAAAAGATGATCAAAAAGAAA-3' (SEQ ID NO: 8500)

5'-A<u>C</u>UUAAAAGAUG<u>AU</u>CAAAAAGAAat-3' (SEQ ID NO: 3881)

3'-<u>UC</u>UG<u>A</u>AUUUUCUACUAG<u>U</u>UUUU<u>C</u>UUUA-5' (SEQ ID NO: 6191)

C5-875 Target:
5'-AGACTTAAAAGATGATCAAAAAGAAAT-3' (SEQ ID NO: 8501)

5'-C<u>UU</u>AAAAGAUGAU<u>C</u>AAAAAGAAAtg-3' (SEQ ID NO: 3882)

3'-<u>C</u>UG<u>A</u>AUUUUCUACUAGU<u>UUUU</u>CUUUAC-5' (SEQ ID NO: 6192)

C5-876 Target:
5'-GACTTAAAAGATGATCAAAAAGAAATG-3' (SEQ ID NO: 8502)

5'-<u>UU</u>AAAAGAUGAU<u>C</u>AAAAAGAAAUga-3' (SEQ ID NO: 3883)

3'-<u>U</u>GA<u>A</u>UUUUCUACUAGU<u>UUUU</u>CUUUACU-5' (SEQ ID NO: 6193)

C5-877 Target:
5'-ACTTAAAAGATGATCAAAAAGAAATGA-3' (SEQ ID NO: 8503)

5'-<u>U</u>AAAAGAUGAUC<u>A</u>AAAAGAAAUGat-3' (SEQ ID NO: 3884)

3'-<u>G</u>AA<u>U</u>UUCUACUAGU<u>UUUU</u>CUUUA<u>CUA</u>-5' (SEQ ID NO: 6194)

C5-878 Target:
5'-CTTAAAAGATGATCAAAAAGAAATGAT-3' (SEQ ID NO: 8504)

5'-<u>A</u>AAAGAUGAUCA<u>AAA</u>AGAAAUGAtg-3' (SEQ ID NO: 3885)

3'-<u>AA</u>UUUCUACUAG<u>U</u>UUUU<u>C</u>UUUA<u>C</u>UAC-5' (SEQ ID NO: 6195)

C5-879 Target:
5'-TTAAAAGATGATCAAAAAGAAATGATG-3' (SEQ ID NO: 8505)

5'-A<u>A</u>AGAUGAUCAAAA<u>A</u>GAAAUGAUgc-3' (SEQ ID NO: 3886)

3'-<u>A</u>UUUCUACUAGU<u>U</u>UUU<u>C</u>UUUAC<u>UACG</u>-5' (SEQ ID NO: 6196)

C5-880 Target:
5'-TAAAAGATGATCAAAAAGAAATGATGC-3' (SEQ ID NO: 8506)

5'-<u>A</u>AGAUGAUCAAAA<u>AG</u>AAAUGAUGca-3' (SEQ ID NO: 3887)

3'-<u>UUUU</u>CUACUAGUUU<u>UU</u>CUUUACU<u>ACGU</u>-5' (SEQ ID NO: 6197)

C5-881 Target:
5'-AAAAGATGATCAAAAAGAAATGATGCA-3' (SEQ ID NO: 8507)

5'-A<u>G</u>AUGAUCAAAAG<u>A</u>AAUGAUGCaa-3' (SEQ ID NO: 3888)

3'-<u>UUU</u>CUACUAGUUUU<u>C</u>UUUACUA<u>CGU</u>U-5' (SEQ ID NO: 6198)

C5-882 Target:
5'-AAAGATGATCAAAAAGAAATGATGCAA-3' (SEQ ID NO: 8508)

5'-G<u>AU</u>GAUCAAAAGA<u>AA</u>UGAUGCAaa-3' (SEQ ID NO: 3889)

3'-<u>UU</u>CUACUAGUUUU<u>C</u>UUUACUAC<u>G</u>UUU-5' (SEQ ID NO: 6199)

C5-883 Target:
5'-AAGATGATCAAAAAGAAATGATGCAAA-3' (SEQ ID NO: 8509)

5'-A<u>U</u>G<u>A</u>UCAAAAGA<u>AA</u>UGAUGCAAac-3' (SEQ ID NO: 3890)

3'-<u>UC</u>UACUAGUUUUCUUUACUAC<u>G</u>UUUG-5' (SEQ ID NO: 6200)

C5-884 Target:
5'-AGATGATCAAAAAGAAATGATGCAAAC-3' (SEQ ID NO: 8510)

5'-<u>U</u>G<u>AU</u>CAAAAGAA<u>A</u>UGAUGCAAAca-3' (SEQ ID NO: 3891)

3'-<u>C</u>UACUAGUUUUC<u>U</u>UUACUACGU<u>UUG</u>U-5' (SEQ ID NO: 6201)

C5-885 Target:
5'-GATGATCAAAAAGAAATGATGCAAACA-3' (SEQ ID NO: 8511)

5'-G<u>AUC</u>AAAAGAAAUGAUGCAAACag-3' (SEQ ID NO: 3892)

3'-<u>UA</u>CUAGUUUUCUUU<u>A</u>CUACGUU<u>UG</u>UC-5' (SEQ ID NO: 6202)

C5-886 Target:
5'-ATGATCAAAAAGAAATGATGCAAACAG-3' (SEQ ID NO: 8512)

5'-A<u>U</u>CAAAAGAAAUG<u>A</u>UGCAAACAgc-3' (SEQ ID NO: 3893)

3'-<u>A</u>CUAGUUUUCUUU<u>A</u>CUACGUU<u>U</u>GUCG-5' (SEQ ID NO: 6203)

C5-887 Target:
5'-TGATCAAAAAGAAATGATGCAAACAGC-3' (SEQ ID NO: 8513)

5'-<u>U</u>CAAAAGAAAUG<u>AU</u>GCAAACAGca-3' (SEQ ID NO: 3894)

3'-<u>C</u>UAGUUUUCUUU<u>A</u>C<u>U</u>ACGUU<u>U</u>GU<u>CGU</u>-5' (SEQ ID NO: 6204)

C5-888 Target:
5'-GATCAAAAAGAAATGATGCAAACAGCA-3' (SEQ ID NO: 8514)

5'-CAAAAGAAAUG<u>A</u>UGCAAACAGCaa-3' (SEQ ID NO: 3895)

3'-<u>U</u>AGUUUUCUUUA<u>C</u>UACGUU<u>U</u>GU<u>CGU</u>U-5' (SEQ ID NO: 6205)

C5-889 Target:
5'-ATCAAAAAGAAATGATGCAAACAGCAA-3' (SEQ ID NO: 8515)

5'-<u>A</u>AAAGAAAUGAU<u>G</u>C<u>A</u>AACAGCAat-3' (SEQ ID NO: 3896)

3'-<u>A</u>GUUUUCUUUACU<u>A</u>CGUUUGU<u>CGU</u>UA-5' (SEQ ID NO: 6206)

C5-890 Target:
5'-TCAAAAAGAAATGATGCAAACAGCAAT-3' (SEQ ID NO: 8516)

5'-<u>A</u>AAAGAAAUGAUGC<u>A</u>AACAGCAAtg-3' (SEQ ID NO: 3897)

3'-<u>GUUUU</u>CUUUACUAC<u>G</u>UUUGUCG<u>UUAC</u>-5' (SEQ ID NO: 6207)

TABLE 7-continued

Human Anti-C5 DsiRNAs Predicted to have >50% Knockdown Efficacy (Asymmetrics)

C5-891 Target:
5'-CAAAAAGAAATGATGCAAACAGCAATG-3' (SEQ ID NO: 8517)

5'-AAAGAAAUGAUGCAAACAGCAAUGc-3' (SEQ ID NO: 3898)

3'-UUUUUCUUUACUACGUUUGUCGUUACG-5' (SEQ ID NO: 6208)

C5-892 Target:
5'-AAAAAGAAATGATGCAAACAGCAATGC-3' (SEQ ID NO: 8518)

5'-AAGAAAUGAUGCAAACAGCAAUGca-3' (SEQ ID NO: 3899)

3'-UUUUCUUUACUACGUUUGUCGUUACGU-5' (SEQ ID NO: 6209)

C5-893 Target:
5'-AAAAGAAATGATGCAAACAGCAATGCA-3' (SEQ ID NO: 8519)

5'-AGAAAUGAUGCAAACAGCAAUGCaa-3' (SEQ ID NO: 3900)

3'-UUUCUUUACUACGUUUGUCGUUACGUU-5' (SEQ ID NO: 6210)

C5-894 Target:
5'-AAAGAAATGATGCAAACAGCAATGCAA-3' (SEQ ID NO: 8520)

5'-GAAAUGAUGCAAACAGCAAUGCAaa-3' (SEQ ID NO: 3901)

3'-UUCUUUACUACGUUUGUCGUUACGUUU-5' (SEQ ID NO: 6211)

C5-895 Target:
5'-AAGAAATGATGCAAACAGCAATGCAAA-3' (SEQ ID NO: 8521)

5'-AAAUGAUGCAAACAGCAAUGCAaa-3' (SEQ ID NO: 3902)

3'-UCUUUACUACGUUUGUCGUUACGUUUU-5' (SEQ ID NO: 6212)

C5-896 Target:
5'-AGAAATGATGCAAACAGCAATGCAAAA-3' (SEQ ID NO: 8522)

5'-AAUGAUGCAAACAGCAAUGCAAAac-3' (SEQ ID NO: 3903)

3'-CUUUACUACGUUUGUCGUUACGUUUUG-5' (SEQ ID NO: 6213)

C5-897 Target:
5'-GAAATGATGCAAACAGCAATGCAAAAC-3' (SEQ ID NO: 8523)

5'-AUGAUGCAAACAGCAAUGCAAAACa-3' (SEQ ID NO: 3904)

3'-UUUACUACGUUUGUCGUUACGUUUUGU-5' (SEQ ID NO: 6214)

C5-898 Target:
5'-AAATGATGCAAACAGCAATGCAAAACA-3' (SEQ ID NO: 8524)

5'-UGAUGCAAACAGCAAUGCAAAACac-3' (SEQ ID NO: 3905)

3'-UUACUACGUUUGUCGUUACGUUUUGUG-5' (SEQ ID NO: 6215)

C5-899 Target:
5'-AATGATGCAAACAGCAATGCAAAACAC-3' (SEQ ID NO: 8525)

5'-AUGUUGAUAAAUGGAAUUGCUCAag-3' (SEQ ID NO: 3906)

3'-GUUACAACUAUUUACCUUAACGAGUUC-5' (SEQ ID NO: 6216)

C5-925 Target:
5'-CAATGTTGATAAATGGAATTGCTCAAG-3' (SEQ ID NO: 8526)

5'-UGAUAAAUGGAAUUGCUCAAGUCac-3' (SEQ ID NO: 3907)

3'-CAACUAUUUACCUUAACGAGUUCAGUG-5' (SEQ ID NO: 6217)

C5-929 Target:
5'-GTTGATAAATGGAATTGCTCAAGTCAC-3' (SEQ ID NO: 8527)

5'-GAUAAAUGGAAUUGCUCAAGUCACa-3' (SEQ ID NO: 3908)

3'-AACUAUUUACCUUAACGAGUUCAGUGU-5' (SEQ ID NO: 6218)

C5-930 Target:
5'-TTGATAAATGGAATTGCTCAAGTCACA-3' (SEQ ID NO: 8528)

5'-UAAAUGGAAUUGCUCAAGUCACAtt-3' (SEQ ID NO: 3909)

3'-CUAUUUACCUUAACGAGUUCAGUGUAA-5' (SEQ ID NO: 6219)

C5-932 Target:
5'-GATAAATGGAATTGCTCAAGTCACATT-3' (SEQ ID NO: 8529)

5'-AAAUGGAAUUGCUCAAGUCACAUtt-3' (SEQ ID NO: 3910)

3'-UAUUUACCUUAACGAGUUCAGUGUAAA-5' (SEQ ID NO: 6220)

C5-933 Target:
5'-ATAAATGGAATTGCTCAAGTCACATTT-3' (SEQ ID NO: 8530)

5'-AAUGGAAUUGCUCAAGUCACAUUtg-3' (SEQ ID NO: 3911)

3'-AUUUACCUUAACGAGUUCAGUGUAAAC-5' (SEQ ID NO: 6221)

C5-934 Target:
5'-TAAATGGAATTGCTCAAGTCACATTTG-3' (SEQ ID NO: 8531)

5'-UGGAAUUGCUCAAGUCACAUUUGat-3' (SEQ ID NO: 3912)

3'-UUACCUUAACGAGUUCAGUGUAAACUA-5' (SEQ ID NO: 6222)

C5-936 Target:
5'-AATGGAATTGCTCAAGTCACATTTGAT-3' (SEQ ID NO: 8532)

5'-GGAAUUGCUCAAGUCACAUUUGAtt-3' (SEQ ID NO: 3913)

3'-UACCUUAACGAGUUCAGUGUAAACUAA-5' (SEQ ID NO: 6223)

C5-937 Target:
5'-ATGGAATTGCTCAAGTCACATTTGATT-3' (SEQ ID NO: 8533)

5'-GAAUUGCUCAAGUCACAUUUGAUtc-3' (SEQ ID NO: 3914)

3'-ACCUUAACGAGUUCAGUGUAAACUAAG-5' (SEQ ID NO: 6224)

C5-938 Target:
5'-TGGAATTGCTCAAGTCACATTTGATTC-3' (SEQ ID NO: 8534)

5'-AAUUGCUCAAGUCACAUUUGAUUct-3' (SEQ ID NO: 3915)

3'-CCUUAACGAGUUCAGUGUAAACUAAGA-5' (SEQ ID NO: 6225)

C5-939 Target:
5'-GGAATTGCTCAAGTCACATTTGATTCT-3' (SEQ ID NO: 8535)

5'-AUUGCUCAAGUCACAUUUGAUUCtg-3' (SEQ ID NO: 3916)

3'-CUUAACGAGUUCAGUGUAAACUAAGAC-5' (SEQ ID NO: 6226)

C5-940 Target:
5'-GAATTGCTCAAGTCACATTTGATTCTG-3' (SEQ ID NO: 8536)

5'-UUGCUCAAGUCACAUUUGAUUCUga-3' (SEQ ID NO: 3917)

3'-UUAACGAGUUCAGUGUAAACUAAGACU-5' (SEQ ID NO: 6227)

C5-941 Target:
5'-AATTGCTCAAGTCACATTTGATTCTGA-3' (SEQ ID NO: 8537)

5'-UGCUCAAGUCACAUUUGAUUCUGaa-3' (SEQ ID NO: 3918)

3'-UAACGAGUUCAGUGUAAACUAAGACUU-5' (SEQ ID NO: 6228)

C5-942 Target:
5'-ATTGCTCAAGTCACATTTGATTCTGAA-3' (SEQ ID NO: 8538)

5'-GCUCAAGUCACAUUUGAUUCUGAaa-3' (SEQ ID NO: 3919)

3'-AACGAGUUCAGUGUAAACUAAGACUUU-5' (SEQ ID NO: 6229)

TABLE 7-continued

Human Anti-C5 DsiRNAs Predicted to have >50% Knockdown Efficacy (Asymmetrics)

C5-943 Target:
5'-TTGCTCAAGTCACATTTGATTCTGAAA-3' (SEQ ID NO: 8539)

5'-UCAAGUCACAUUUGAUUCUGAAAca-3' (SEQ ID NO: 3920)

3'-CGAGUUCAGUGUAAACUAAGACUUUGU-5' (SEQ ID NO: 6230)

C5-945 Target:
5'-GCTCAAGTCACATTTGATTCTGAAACA-3' (SEQ ID NO: 8540)

5'-GUCACAUUUGAUUCUGAAACAGCag-3' (SEQ ID NO: 3921)

3'-UUCAGUGUAAACUAAGACUUUGUCGUC-5' (SEQ ID NO: 6231)

C5-949 Target:
5'-AAGTCACATTTGATTCTGAAACAGCAG-3' (SEQ ID NO: 8541)

5'-UCACAUUUGAUUCUGAAACAGCAgt-3' (SEQ ID NO: 3922)

3'-UCAGUGUAAACUAAGACUUUGUCGUCA-5' (SEQ ID NO: 6232)

C5-950 Target:
5'-AGTCACATTTGATTCTGAAACAGCAGT-3' (SEQ ID NO: 8542)

5'-CACAUUUGAUUCUGAAACAGCAGtc-3' (SEQ ID NO: 3923)

3'-CAGUGUAAACUAAGACUUUGUCGUCAG-5' (SEQ ID NO: 6233)

C5-951 Target:
5'-GTCACATTTGATTCTGAAACAGCAGTC-3' (SEQ ID NO: 8543)

5'-ACAUUUGAUUCUGAAACAGCAGUca-3' (SEQ ID NO: 3924)

3'-AGUGUAAACUAAGACUUUGUCGUCAGU-5' (SEQ ID NO: 6234)

C5-952 Target:
5'-TCACATTTGATTCTGAAACAGCAGTCA-3' (SEQ ID NO: 8544)

5'-AUUUGAUUCUGAAACAGCAGUCAaa-3' (SEQ ID NO: 3925)

3'-UGUAAACUAAGACUUUGUCGUCAGUU-5' (SEQ ID NO: 6235)

C5-954 Target:
5'-ACATTTGATTCTGAAACAGCAGTCAAA-3' (SEQ ID NO: 8545)

5'-UGAUUCUGAAACAGCAGUCAAAGaa-3' (SEQ ID NO: 3926)

3'-AAACUAAGACUUUGUCGUCAGUUUCUU-5' (SEQ ID NO: 6236)

C5-957 Target:
5'-TTTGATTCTGAAACAGCAGTCAAAGAA-3' (SEQ ID NO: 8546)

5'-GAUUCUGAAACAGCAGUCAAAGaac-3' (SEQ ID NO: 3927)

3'-AACUAAGACUUUGUCGUCAGUUUCUUG-5' (SEQ ID NO: 6237)

C5-958 Target:
5'-TTGATTCTGAAACAGCAGTCAAAGAAC-3' (SEQ ID NO: 8547)

5'-AUUCUGAAACAGCAGUCAAAGAAct-3' (SEQ ID NO: 3928)

3'-ACUAAGACUUUGUCGUCAGUUUCUUGA-5' (SEQ ID NO: 6238)

C5-959 Target:
5'-TGATTCTGAAACAGCAGTCAAAGAACT-3' (SEQ ID NO: 8548)

5'-UUCUGAAACAGCAGUCAAAGAACtg-3' (SEQ ID NO: 3929)

3'-CUAAGACUUUGUCGUCAGUUUCUUGAC-5' (SEQ ID NO: 6239)

C5-960 Target:
5'-GATTCTGAAACAGCAGTCAAAGAACTG-3' (SEQ ID NO: 8549)

5'-UCUGAAACAGCAGUCAAAGAACUgt-3' (SEQ ID NO: 3930)

3'-UAAGACUUUGUCGUCAGUUUCUUGACA-5' (SEQ ID NO: 6240)

TABLE 7-continued

Human Anti-C5 DsiRNAs Predicted to have >50% Knockdown Efficacy (Asymmetrics)

C5-961 Target:
5'-ATTCTGAAACAGCAGTCAAAGAACTGT-3' (SEQ ID NO: 8550)

5'-CUGAAACAGCAGUCAAAGAACUGtc-3' (SEQ ID NO: 3931)

3'-AAGACUUUGUCGUCAGUUUCUUGACAG-5' (SEQ ID NO: 6241)

C5-962 Target:
5'-TTCTGAAACAGCAGTCAAAGAACTGTC-3' (SEQ ID NO: 8551)

5'-UGAAACAGCAGUCAAAGAACUGUca-3' (SEQ ID NO: 3932)

3'-AGACUUUGUCGUCAGUUUCUUGACAGU-5' (SEQ ID NO: 6242)

C5-963 Target:
5'-TCTGAAACAGCAGTCAAAGAACTGTCA-3' (SEQ ID NO: 8552)

5'-GAAACAGCAGUCAAAGAACUGUCat-3' (SEQ ID NO: 3933)

3'-GACUUUGUCGUCAGUUUCUUGACAGUA-5' (SEQ ID NO: 6243)

C5-964 Target:
5'-CTGAAACAGCAGTCAAAGAACTGTCAT-3' (SEQ ID NO: 8553)

5'-AAACAGCAGUCAAAGAACUGUCAta-3' (SEQ ID NO: 3934)

3'-ACUUUGUCGUCAGUUUCUUGACAGUAU-5' (SEQ ID NO: 6244)

C5-965 Target:
5'-TGAAACAGCAGTCAAAGAACTGTCATA-3' (SEQ ID NO: 8554)

5'-AACAGCAGUCAAAGAACUGUCAUac-3' (SEQ ID NO: 3935)

3'-CUUUGUCGUCAGUUUCUUGACAGUAUG-5' (SEQ ID NO: 6245)

C5-966 Target:
5'-GAAACAGCAGTCAAAGAACTGTCATAC-3' (SEQ ID NO: 8555)

5'-ACAGCAGUCAAAGAACUGUCAUAct-3' (SEQ ID NO: 3936)

3'-UUUGUCGUCAGUUUCUUGACAGUAUGA-5' (SEQ ID NO: 6246)

C5-967 Target:
5'-AAACAGCAGTCAAAGAACTGTCATACT-3' (SEQ ID NO: 8556)

5'-AGCAGUCAAAGAACUGUCAUACUac-3' (SEQ ID NO: 3937)

3'-UGUCGUCAGUUUCUUGACAGUAUGAUG-5' (SEQ ID NO: 6247)

C5-969 Target:
5'-ACAGCAGTCAAAGAACTGTCATACTAC-3' (SEQ ID NO: 8557)

5'-CAGUCAAAGAACUGUCAUACUACag-3' (SEQ ID NO: 3938)

3'-UCGUCAGUUUCUUGACAGUAUGAUGUC-5' (SEQ ID NO: 6248)

C5-971 Target:
5'-AGCAGTCAAAGAACTGTCATACTACAG-3' (SEQ ID NO: 8558)

5'-AGUCAAAGAACUGUCAUACUACAgt-3' (SEQ ID NO: 3939)

3'-CGUCAGUUUCUUGACAGUAUGAUGUCA-5' (SEQ ID NO: 6249)

C5-972 Target:
5'-GCAGTCAAAGAACTGTCATACTACAGT-3' (SEQ ID NO: 8559)

5'-UCAAAGAACUGUCAUACUACAGUtt-3' (SEQ ID NO: 3940)

3'-UCAGUUUCUUGACAGUAUGAUGUCAAA-5' (SEQ ID NO: 6250)

C5-974 Target:
5'-AGTCAAAGAACTGTCATACTACAGTTT-3' (SEQ ID NO: 8560)

5'-CAAAGAACUGUCAUACUACAGUUta-3' (SEQ ID NO: 3941)

3'-CAGUUUCUUGACAGUAUGAUGUCAAAU-5' (SEQ ID NO: 6251)

TABLE 7-continued

Human Anti-C5 DsiRNAs Predicted to have >50% Knockdown Efficacy (Asymmetrics)

C5-975 Target:
5'-GTCAAAGAACTGTCATACTACAGTTTA-3' (SEQ ID NO: 8561)

5'-A<u>AAG</u>AACUGUCAU<u>AC</u>UACAGUUUAg-3' (SEQ ID NO: 3942)

3'-<u>AGU</u>UUCUUGACAGUA<u>UG</u>AUGUCA<u>AAUC</u>-5' (SEQ ID NO: 6252)

C5-976 Target:
5'-TCAAAGAACTGTCATACTACAGTTTAG-3' (SEQ ID NO: 8562)

5'-G<u>AA</u>CUGUCAUACU<u>AC</u>AGUUUAGAag-3' (SEQ ID NO: 3943)

3'-<u>UUC</u>UUGACAGUAUG<u>AU</u>GUCAAAU<u>CUUC</u>-5' (SEQ ID NO: 6253)

C5-979 Target:
5'-AAGAACTGTCATACTACAGTTTAGAAG-3' (SEQ ID NO: 8563)

5'-A<u>CUG</u>UCAUACUAC<u>AG</u>UUUAGAAGat-3' (SEQ ID NO: 3944)

3'-<u>CUU</u>GACAGUAUGAU<u>GU</u>CAAAUCUU<u>CUA</u>-5' (SEQ ID NO: 6254)

C5-981 Target:
5'-GAACTGTCATACTACAGTTTAGAGAT-3' (SEQ ID NO: 8564)

5'-C<u>UGU</u>CAUACUACAG<u>UU</u>UAGAAGAtt-3' (SEQ ID NO: 3945)

3'-<u>UUG</u>ACAGUAUGAUG<u>UC</u>AAAUCUUC<u>UAA</u>-5' (SEQ ID NO: 6255)

C5-982 Target:
5'-AACTGTCATACTACAGTTTAGAAGATT-3' (SEQ ID NO: 8565)

5'-U<u>GUC</u>AUACUACAG<u>UUU</u>AGAAGAUtt-3' (SEQ ID NO: 3946)

3'-<u>UGA</u>CAGUAUGAUGU<u>C</u>AAAUCUUC<u>UAAA</u>-5' (SEQ ID NO: 6256)

C5-983 Target:
5'-ACTGTCATACTACAGTTTAGAAGATTT-3' (SEQ ID NO: 8566)

5'-G<u>UC</u>AUACUACAGU<u>UUA</u>GAAGAUUta-3' (SEQ ID NO: 3947)

3'-<u>GAC</u>AGUAUGAUGUC<u>AA</u>AUCUUC<u>UAAAU</u>-5' (SEQ ID NO: 6257)

C5-984 Target:
5'-CTGTCATACTACAGTTTAGAAGATTTA-3' (SEQ ID NO: 8567)

5'-U<u>CAU</u>ACUACAGUU<u>UA</u>GAAGAUUUaa-3' (SEQ ID NO: 3948)

3'-<u>ACA</u>GUAUGAUGUCA<u>AA</u>UCUUCU<u>AAAUU</u>-5' (SEQ ID NO: 6258)

C5-985 Target:
5'-TGTCATACTACAGTTTAGAAGATTTAA-3' (SEQ ID NO: 8568)

5'-C<u>AU</u>ACUACAGUUU<u>AG</u>AAGAUUUAaa-3' (SEQ ID NO: 3949)

3'-<u>CAG</u>UAUGAUGUCAA<u>AU</u>CUUCUA<u>AAAUU</u>-5' (SEQ ID NO: 6259)

C5-986 Target:
5'-GTCATACTACAGTTTAGAAGATTTAAA-3' (SEQ ID NO: 8569)

5'-A<u>UA</u>CUACAGUUUA<u>GA</u>AGAUUUAAac-3' (SEQ ID NO: 3950)

3'-<u>AGU</u>AUGAUGUCAAA<u>UC</u>UUCUAA<u>AUUUG</u>-5' (SEQ ID NO: 6260)

C5-987 Target:
5'-TCATACTACAGTTTAGAAGATTTAAAC-3' (SEQ ID NO: 8570)

5'-U<u>AC</u>UACAGUUUAG<u>A</u>AGAUUUAAAca-3' (SEQ ID NO: 3951)

3'-<u>GUA</u>UGAUGUCAAAU<u>C</u>UUCUAAA<u>UUUG</u>-5' (SEQ ID NO: 6261)

C5-988 Target:
5'-CATACTACAGTTTAGAAGATTTAAACA-3' (SEQ ID NO: 8571)

5'-A<u>CU</u>ACAGUUUAGA<u>AG</u>AUUUAAACaa-3' (SEQ ID NO: 3952)

3'-<u>UAUG</u>AUGUCAAAUC<u>UU</u>CUAAAUUUGUU-5' (SEQ ID NO: 6262)

C5-989 Target:
5'-ATACTACAGTTTAGAAGATTTAAACAA-3' (SEQ ID NO: 8572)

5'-C<u>UA</u>CAGUUUAGAAG<u>AU</u>UUAAACAac-3' (SEQ ID NO: 3953)

3'-<u>AUG</u>AUGUCAAAUCU<u>UC</u>UAAAUUUG<u>UUG</u>-5' (SEQ ID NO: 6263)

C5-990 Target:
5'-TACTACAGTTTAGAAGATTTAAACAAC-3' (SEQ ID NO: 8573)

5'-U<u>AC</u>AGUUUAGAAGA<u>UU</u>UAAACAAca-3' (SEQ ID NO: 3954)

3'-<u>UGAU</u>GUCAAAUCUU<u>C</u>UAAAUUUGUUGU-5' (SEQ ID NO: 6264)

C5-991 Target:
5'-ACTACAGTTTAGAAGATTTAAACAACA-3' (SEQ ID NO: 8574)

5'-A<u>CA</u>GUUUAGAAGAU<u>UU</u>AAACAACaa-3' (SEQ ID NO: 3955)

3'-<u>GAU</u>GUCAAAUCUUC<u>UA</u>AAUUUGU<u>UGUU</u>-5' (SEQ ID NO: 6265)

C5-992 Target:
5'-CTACAGTTTAGAAGATTTAAACAACAA-3' (SEQ ID NO: 8575)

5'-C<u>AG</u>UUUAGAAGAUU<u>UA</u>AACAACAag-3' (SEQ ID NO: 3956)

3'-<u>AUG</u>UCAAAUCUUCU<u>AA</u>AUUUGUUG<u>UUC</u>-5' (SEQ ID NO: 6266)

C5-993 Target:
5'-TACAGTTTAGAAGATTTAAACAACAAG-3' (SEQ ID NO: 8576)

5'-A<u>GU</u>UUAGAAGAUUU<u>AA</u>ACAACAAgt-3' (SEQ ID NO: 3957)

3'-<u>UGU</u>CAAAUCUUCUA<u>AA</u>UUUGUUG<u>UUCA</u>-5' (SEQ ID NO: 6267)

C5-994 Target:
5'-ACAGTTTAGAAGATTTAAACAACAAGT-3' (SEQ ID NO: 8577)

5'-G<u>UU</u>UAGAAGAUUUA<u>AA</u>CAACAAGta-3' (SEQ ID NO: 3958)

3'-<u>GUC</u>AAAUCUUCUAA<u>AU</u>UUGUUGUU<u>CAU</u>-5' (SEQ ID NO: 6268)

C5-995 Target:
5'-CAGTTTAGAAGATTTAAACAACAAGTA-3' (SEQ ID NO: 8578)

5'-U<u>UU</u>AGAAGAUUUAA<u>AC</u>AACAAGUac-3' (SEQ ID NO: 3959)

3'-<u>UCA</u>AAUCUUCUAAA<u>UU</u>UGUUGUU<u>CAUG</u>-5' (SEQ ID NO: 6269)

C5-996 Target:
5'-AGTTTAGAAGATTTAAACAACAAGTAC-3' (SEQ ID NO: 8579)

5'-U<u>UA</u>GAAGAUUUAAA<u>C</u>AACAAGUAcc-3' (SEQ ID NO: 3960)

3'-<u>CAAA</u>UCUUCUAAAUUUGUUGUUC<u>AUGG</u>-5' (SEQ ID NO: 6270)

C5-997 Target:
5'-GTTTAGAAGATTTAAACAACAAGTACC-3' (SEQ ID NO: 8580)

5'-U<u>AG</u>AAGAUUUAAAC<u>AA</u>CAAGUACct-3' (SEQ ID NO: 3961)

3'-<u>AAAU</u>CUUCUAAAUUUGUUGUUC<u>AUGGA</u>-5' (SEQ ID NO: 6271)

C5-998 Target:
5'-TTTAGAAGATTTAAACAACAAGTACCT-3' (SEQ ID NO: 8581)

5'-A<u>GA</u>AGAUUUAAAC<u>AA</u>CAAGUACCtt-3' (SEQ ID NO: 3962)

3'-<u>AAU</u>CUUCUAAAUUUGUUGUUC<u>AUGGAA</u>-5' (SEQ ID NO: 6272)

C5-999 Target:
5'-TTAGAAGATTTAAACAACAAGTACCTT-3' (SEQ ID NO: 8582)

5'-G<u>AA</u>GAUUUAAAC<u>AA</u>CAAGUACCUtt-3' (SEQ ID NO: 3963)

3'-<u>AUC</u>UUCUAAAUUUGUUGUUCAUGG<u>AAA</u>-5' (SEQ ID NO: 6273)

TABLE 7-continued

Human Anti-C5 DsiRNAs Predicted to have >50% Knockdown Efficacy (Asymmetrics)

C5-1000 Target:
5'-TAGAAGATTTAAACAACAAGTACCTTT-3' (SEQ ID NO: 8583)

5'-A<u>AG</u>A<u>UUU</u>AAACAA<u>C</u>AA<u>G</u>UACCUUUta-3' (SEQ ID NO: 3964)

3'-<u>UCUUC</u>UAAAUUUGUU<u>G</u>UU<u>C</u>AUGGA<u>AAAU</u>-5' (SEQ ID NO: 6274)

C5-1001 Target:
5'-AGAAGATTTAAACAACAAGTACCTTTA-3' (SEQ ID NO: 8584)

5'-A<u>GAUUU</u>AAACAAC<u>A</u>AGUACCUUUat-3' (SEQ ID NO: 3965)

3'-<u>CUUCU</u>AAAUUUGUUG<u>UUC</u>AUGGA<u>AAUA</u>-5' (SEQ ID NO: 6275)

C5-1002 Target:
5'-GAAGATTTAAACAACAAGTACCTTTAT-3' (SEQ ID NO: 8585)

5'-G<u>AUUU</u>AAACAACAA<u>GU</u>ACCUUUAta-3' (SEQ ID NO: 3966)

3'-<u>UUCU</u>AAAUUUGUUGUU<u>C</u>AUGGAAA<u>AUAU</u>-5' (SEQ ID NO: 6276)

C5-1003 Target:
5'-AAGATTTAAACAACAAGTACCTTTATA-3' (SEQ ID NO: 8586)

5'-<u>AUUU</u>AAACAACAAG<u>UA</u>CCUUUAUat-3' (SEQ ID NO: 3967)

3'-<u>UCU</u>AAAUUUGUUGUU<u>C</u>AUGGAAAU<u>AUA</u>-5' (SEQ ID NO: 6277)

C5-1004 Target:
5'-AGATTTAAACAACAAGTACCTTTATAT-3' (SEQ ID NO: 8587)

5'-<u>UUU</u>AAACAACAAGU<u>AC</u>CUUUAUAtt-3' (SEQ ID NO: 3968)

3'-<u>CUAAA</u>UUUGUUGUU<u>C</u>AUGGAAAU<u>AUAA</u>-5' (SEQ ID NO: 6278)

C5-1005 Target:
5'-GATTTAAACAACAAGTACCTTTATATT-3' (SEQ ID NO: 8588)

5'-U<u>AC</u>CUUUAUAUUGC<u>U</u>GUAACAGUca-3' (SEQ ID NO: 3969)

3'-<u>UCAU</u>GGAAAUAUAA<u>CG</u>A<u>C</u>AUUGU<u>C</u>AGU-5' (SEQ ID NO: 6279)

C5-1018 Target:
5'-AGTACCTTTATATTGCTGTAACAGTCA-3' (SEQ ID NO: 8589)

5'-C<u>CUUU</u>AUAUUGCU<u>G</u>U<u>AA</u>CAGUCAta-3' (SEQ ID NO: 3970)

3'-<u>AUGG</u>AAAUAUAACGA<u>C</u>AUUGU<u>C</u>AGU<u>AU</u>-5' (SEQ ID NO: 6280)

C5-1020 Target:
5'-TACCTTTATATTGCTGTAACAGTCATA-3' (SEQ ID NO: 8590)

5'-C<u>UUU</u>AUAUUGCUGU<u>AA</u>CAGUCAU<u>ag</u>-3' (SEQ ID NO: 3971)

3'-<u>UGG</u>A<u>A</u>AUAUAACGA<u>C</u>AUUGU<u>C</u>AGU<u>AU</u>C-5' (SEQ ID NO: 6281)

C5-1021 Target:
5'-ACCTTTATATTGCTGTAACAGTCATAG-3' (SEQ ID NO: 8591)

5'-<u>UUU</u>A<u>U</u>AUUGCUGU<u>AA</u>CAGUCAU<u>A</u>ga-3' (SEQ ID NO: 3972)

3'-<u>GG</u>A<u>A</u>AUAUAACGAC<u>A</u>UUGU<u>C</u>AGU<u>AU</u>CU-5' (SEQ ID NO: 6282)

C5-1022 Target:
5'-CCTTTATATTGCTGTAACAGTCATAGA-3' (SEQ ID NO: 8592)

5'-<u>UU</u>A<u>U</u>AUUGCUGU<u>AA</u>C<u>A</u>GUCAU<u>A</u>Gag-3' (SEQ ID NO: 3973)

3'-<u>G</u>A<u>AA</u>UAUAACGACAUUGU<u>C</u>AGU<u>AUCUC</u>-5' (SEQ ID NO: 6283)

C5-1023 Target:
5'-CTTTATATTGCTGTAACAGTCATAGAG-3' (SEQ ID NO: 8593)

5'-U<u>AUA</u>UUGCUGU<u>AA</u>C<u>A</u>GUCAU<u>A</u>GAGt-3' (SEQ ID NO: 3974)

3'-<u>AAAU</u>A<u>U</u>AACGACAUUGU<u>C</u>AGU<u>AUCUCA</u>-5' (SEQ ID NO: 6284)

C5-1024 Target:
5'-TTTATATTGCTGTAACAGTCATAGAGT-3' (SEQ ID NO: 8594)

5'-<u>AUAU</u>UGCUGUAAC<u>A</u>GU<u>C</u>AUAGAGtc-3' (SEQ ID NO: 3975)

3'-<u>AAUAU</u>AACGACAUUGU<u>C</u>AGUAUC<u>UCAG</u>-5' (SEQ ID NO: 6285)

C5-1025 Target:
5'-TTATATTGCTGTAACAGTCATAGAGTC-3' (SEQ ID NO: 8595)

5'-<u>U</u>AU<u>U</u>GCUGUAACAG<u>U</u>C<u>A</u>UAGAGUct-3' (SEQ ID NO: 3976)

3'-<u>AUAU</u>AACGACAUUGU<u>C</u>AGUAUC<u>U</u>C<u>A</u>GA-5' (SEQ ID NO: 6286)

C5-1026 Target:
5'-TATATTGCTGTAACAGTCATAGAGTCT-3' (SEQ ID NO: 8596)

5'-A<u>UU</u>GCUGUAACAGU<u>C</u>AU<u>A</u>GAGUCta-3' (SEQ ID NO: 3977)

3'-<u>UAU</u>A<u>A</u>CGACAUUGU<u>C</u>AGUAUCUC<u>AG</u>AU-5' (SEQ ID NO: 6287)

C5-1027 Target:
5'-ATATTGCTGTAACAGTCATAGAGTCTA-3' (SEQ ID NO: 8597)

5'-<u>UUG</u>CUGUAACAGUC<u>A</u>U<u>A</u>GAGUCUac-3' (SEQ ID NO: 3978)

3'-<u>AUAA</u>CGACAUUGUCAGUAUCUC<u>A</u>G<u>AUG</u>-5' (SEQ ID NO: 6288)

C5-1028 Target:
5'-TATTGCTGTAACAGTCATAGAGTCTAC-3' (SEQ ID NO: 8598)

5'-<u>UG</u>CUGUAACAGUC<u>A</u>U<u>A</u>GAGUCUAca-3' (SEQ ID NO: 3979)

3'-<u>UAAC</u>GACAUUGU<u>C</u>AGU<u>A</u>UCUCAG<u>A</u>UGU-5' (SEQ ID NO: 6289)

C5-1029 Target:
5'-ATTGCTGTAACAGTCATAGAGTCTACA-3' (SEQ ID NO: 8599)

5'-G<u>C</u>UGUAACAGUCA<u>U</u>AGAGUCUACag-3' (SEQ ID NO: 3980)

3'-<u>AAC</u>GACAUUGUCAGU<u>A</u>UCUCAG<u>A</u>UGUC-5' (SEQ ID NO: 6290)

C5-1030 Target:
5'-TTGCTGTAACAGTCATAGAGTCTACAG-3' (SEQ ID NO: 8600)

5'-C<u>U</u>GUAACAGUCAU<u>AG</u>AGUCUACAgg-3' (SEQ ID NO: 3981)

3'-<u>AC</u>GACAUUGUCAGU<u>AU</u>CUCAGAU<u>GUCC</u>-5' (SEQ ID NO: 6291)

C5-1031 Target:
5'-TGCTGTAACAGTCATAGAGTCTACAGG-3' (SEQ ID NO: 8601)

5'-<u>UG</u>UAACAGUCAU<u>AG</u>AGUCUACAGgt-3' (SEQ ID NO: 3982)

3'-<u>CG</u>ACAUUGUCAGUAU<u>C</u>UCAGAU<u>GUCCA</u>-5' (SEQ ID NO: 6292)

C5-1032 Target:
5'-GCTGTAACAGTCATAGAGTCTACAGGT-3' (SEQ ID NO: 8602)

5'-<u>GU</u>AACAGUCAUAGA<u>G</u>UCUACAGGtg-3' (SEQ ID NO: 3983)

3'-<u>GAC</u>AUUGUCAGUAUCU<u>C</u>AGAUGU<u>CCAC</u>-5' (SEQ ID NO: 6293)

C5-1033 Target:
5'-CTGTAACAGTCATAGAGTCTACAGGTG-3' (SEQ ID NO: 8603)

5'-<u>U</u>AACAGUCAUAGA<u>GU</u>C<u>U</u>ACAGGUgg-3' (SEQ ID NO: 3984)

3'-<u>AC</u>AUUGUCAGUAUCU<u>C</u>AGAUGU<u>CC</u>ACC-5' (SEQ ID NO: 6294)

C5-1034 Target:
5'-TGTAACAGTCATAGAGTCTACAGGTGG-3' (SEQ ID NO: 8604)

5'-<u>AAC</u>AGUCAUAGAG<u>UC</u>UACAGGUGga-3' (SEQ ID NO: 3985)

3'-<u>C</u>AUUGUCAGUAUCU<u>C</u>AGAUGUCC<u>A</u>CCU-5' (SEQ ID NO: 6295)

TABLE 7-continued

Human Anti-C5 DsiRNAs Predicted to have >50% Knockdown Efficacy (Asymmetrics)

C5-1035 Target:
5'-GTAACAGTCATAGAGTCTACAGGTGGA-3' (SEQ ID NO: 8605)

5'-A<u>CAG</u>UCAUAGAGUC<u>UA</u>CAGGUGGAt-3' (SEQ ID NO: 3986)

3'-<u>AUUG</u>UCAGUAUCUC<u>AG</u>AUGUCCA<u>CCUA</u>-5' (SEQ ID NO: 6296)

C5-1036 Target:
5'-TAACAGTCATAGAGTCTACAGGTGGAT-3' (SEQ ID NO: 8606)

5'-C<u>AG</u>UCAUAGAGUCU<u>AC</u>AGGUGGAtt-3' (SEQ ID NO: 3987)

3'-<u>UUG</u>UC<u>A</u>GUAUCUC<u>AG</u>AUGUCCAC<u>CUAA</u>-5' (SEQ ID NO: 6297)

C5-1037 Target:
5'-AACAGTCATAGAGTCTACAGGTGGATT-3' (SEQ ID NO: 8607)

5'-A<u>GU</u>CAUAGAGUCUA<u>C</u>A<u>C</u>GGUGGAUtt-3' (SEQ ID NO: 3988)

3'-<u>UGU</u>C<u>A</u>GUAUCUCAGAUGUCCACCU<u>AAA</u>-5' (SEQ ID NO: 6298)

C5-1038 Target:
5'-ACAGTCATAGAGTCTACAGGTGGATTT-3' (SEQ ID NO: 8608)

5'-G<u>UC</u>AUAGAGUCUA<u>C</u>AGGUGGAUUtt-3' (SEQ ID NO: 3989)

3'-<u>GUC</u>A<u>G</u>UAUCUCAGAUG<u>U</u>CCACCU<u>AAAA</u>-5' (SEQ ID NO: 6299)

C5-1039 Target:
5'-CAGTCATAGAGTCTACAGGTGGATTTT-3' (SEQ ID NO: 8609)

5'-<u>UC</u>AUAGAGUCUA<u>C</u>AGGUGGAUUUtc-3' (SEQ ID NO: 3990)

3'-<u>UCA</u>GUAUCUCAGAUG<u>U</u>CCACCUA<u>AAAG</u>-5' (SEQ ID NO: 6300)

C5-1040 Target:
5'-AGTCATAGAGTCTACAGGTGGATTTTC-3' (SEQ ID NO: 8610)

5'-C<u>A</u>UAGAGUCUACAG<u>G</u>UGGAUUUUct-3' (SEQ ID NO: 3991)

3'-<u>CAGU</u>AUCUCAGAUGU<u>CC</u>ACCUAA<u>AAGA</u>-5' (SEQ ID NO: 6301)

C5-1041 Target:
5'-GTCATAGAGTCTACAGGTGGATTTTCT-3' (SEQ ID NO: 8611)

5'-<u>A</u>U<u>A</u>GAGUCUACAGG<u>U</u>GGAUUUUCtg-3' (SEQ ID NO: 3992)

3'-<u>AGU</u>AUCUCAGAUGU<u>CC</u>ACCUAAA<u>AGAC</u>-5' (SEQ ID NO: 6302)

C5-1042 Target:
5'-TCATAGAGTCTACAGGTGGATTTTCTG-3' (SEQ ID NO: 8612)

5'-U<u>AG</u>AGUCUACAGGU<u>GG</u>AUUUUCUga-3' (SEQ ID NO: 3993)

3'-<u>GUAU</u>CUCAGAUGUCC<u>A</u>CCUAAAA<u>GACU</u>-5' (SEQ ID NO: 6303)

C5-1043 Target:
5'-CATAGAGTCTACAGGTGGATTTTCTGA-3' (SEQ ID NO: 8613)

5'-A<u>GA</u>GUCUACAGGUG<u>GA</u>UUUUCUGaa-3' (SEQ ID NO: 3994)

3'-<u>UAU</u>CUCAGAUGUCC<u>A</u>CCUAAAAG<u>ACUU</u>-5' (SEQ ID NO: 6304)

C5-1044 Target:
5'-ATAGAGTCTACAGGTGGATTTTCTGAA-3' (SEQ ID NO: 8614)

5'-G<u>AG</u>UCUACAGGUGG<u>AU</u>UUUCUGAag-3' (SEQ ID NO: 3995)

3'-<u>AUC</u>UCAGAUGUCC<u>A</u>CCUAAAAGA<u>CUUC</u>-5' (SEQ ID NO: 6305)

C5-1045 Target:
5'-TAGAGTCTACAGGTGGATTTTCTGAAG-3' (SEQ ID NO: 8615)

5'-A<u>GU</u>CUACAGGUGG<u>A</u>UUUUCUGAAga-3' (SEQ ID NO: 3996)

3'-<u>UCUC</u>AGAUGUCCAC<u>CU</u>AAAAGAC<u>UUCU</u>-5' (SEQ ID NO: 6306)

TABLE 7-continued

Human Anti-C5 DsiRNAs Predicted to have >50% Knockdown Efficacy (Asymmetrics)

C5-1046 Target:
5'-AGAGTCTACAGGTGGATTTTCTGAAGA-3' (SEQ ID NO: 8616)

5'-G<u>UC</u>UACAGGUGGA<u>U</u>UUUCUGAAGag-3' (SEQ ID NO: 3997)

3'-<u>CUC</u>AGAUGUCCACCU<u>A</u>AAAGACUU<u>CUC</u>-5' (SEQ ID NO: 6307)

C5-1047 Target:
5'-GAGTCTACAGGTGGATTTTCTGAAGAG-3' (SEQ ID NO: 8617)

5'-<u>UC</u>UACAGGUGGAU<u>UUU</u>CUGAAGAgg-3' (SEQ ID NO: 3998)

3'-<u>UCAG</u>AUGUCCACCUAAAAGACUU<u>CUCC</u>-5' (SEQ ID NO: 6308)

C5-1048 Target:
5'-AGTCTACAGGTGGATTTTCTGAAGAGG-3' (SEQ ID NO: 8618)

5'-C<u>UA</u>CAGGUGGAUU<u>UUC</u>UGAAGAGgc-3' (SEQ ID NO: 3999)

3'-<u>CAG</u>AUGUCCACCUA<u>AAA</u>GACUUCU<u>CCG</u>-5' (SEQ ID NO: 6309)

C5-1049 Target:
5'-GTCTACAGGTGGATTTTCTGAAGAGGC-3' (SEQ ID NO: 8619)

5'-<u>UA</u>CAGGUGGAUUUUCUGAAGAGGca-3' (SEQ ID NO: 4000)

3'-<u>AGA</u>UGUCCACCUA<u>AAA</u>GACUUCU<u>CCGU</u>-5' (SEQ ID NO: 6310)

C5-1050 Target:
5'-TCTACAGGTGGATTTTCTGAAGAGGCA-3' (SEQ ID NO: 8620)

5'-<u>A</u>CAGGUGGAUUUU<u>C</u>UGAAGAGGcag-3' (SEQ ID NO: 4001)

3'-<u>GAU</u>GUCCACCUAAAAGACUUCU<u>CCGUC</u>-5' (SEQ ID NO: 6311)

C5-1051 Target:
5'-CTACAGGTGGATTTTCTGAAGAGGCAG-3' (SEQ ID NO: 8621)

5'-C<u>AG</u>GUGGAUUUUC<u>U</u>GAAGAGGCAga-3' (SEQ ID NO: 4002)

3'-<u>AUG</u>UCCACCUAAAG<u>A</u>CUUCUCC<u>GUCU</u>-5' (SEQ ID NO: 6312)

C5-1052 Target:
5'-TACAGGTGGATTTTCTGAAGAGGCAGA-3' (SEQ ID NO: 8622)

5'-<u>AGG</u>UGGAUUUUCU<u>GA</u>AGAGGCAGaa-3' (SEQ ID NO: 4003)

3'-<u>UGCC</u>ACCUAAAAGA<u>CUUCUCCGUCUU</u>-5' (SEQ ID NO: 6313)

C5-1053 Target:
5'-ACAGGTGGATTTTCTGAAGAGGCAGAA-3' (SEQ ID NO: 8623)

5'-G<u>GU</u>GGAUUUUCUG<u>A</u>AGAGGCAGAaa-3' (SEQ ID NO: 4004)

3'-<u>GUCC</u>ACCUAAAAGA<u>C</u>UUCUCCGUC<u>UUU</u>-5' (SEQ ID NO: 6314)

C5-1054 Target:
5'-CAGGTGGATTTTCTGAAGAGGCAGAAA-3' (SEQ ID NO: 8624)

5'-G<u>UGG</u>AUUUUCUGA<u>A</u>GAGGCAGAAat-3' (SEQ ID NO: 4005)

3'-<u>UCC</u>ACCUAAAAGAC<u>U</u>UCUCCGUC<u>UUUA</u>-5' (SEQ ID NO: 6315)

C5-1055 Target:
5'-AGGTGGATTTTCTGAAGAGGCAGAAAT-3' (SEQ ID NO: 8625)

5'-U<u>GG</u>AUUUUCUGAA<u>G</u>AGGCAGAAAta-3' (SEQ ID NO: 4006)

3'-<u>CC</u>ACCUAAAAGACUUCUCCGUCU<u>UUAU</u>-5' (SEQ ID NO: 6316)

C5-1056 Target:
5'-GGTGGATTTTCTGAAGAGGCAGAAATA-3' (SEQ ID NO: 8626)

5'-G<u>GA</u>UUUUCUGAAG<u>A</u>GGCAGAAAUac-3' (SEQ ID NO: 4007)

3'-<u>CACC</u>UAAAAGACUUCU<u>C</u>CGUCUUU<u>AUG</u>-5' (SEQ ID NO: 6317)

TABLE 7-continued

Human Anti-C5 DsiRNAs Predicted to have >50% Knockdown Efficacy (Asymmetrics)

C5-1057 Target:
5'-GTGGATTTTCTGAAGAGGCAGAAATAC-3' (SEQ ID NO: 8627)

5'-GAUUUUCUGAAGAGGCAGAAAUAcc-3' (SEQ ID NO: 4008)

3'-ACCUAAAAGACUUCUCCGUCUUUAUGG-5' (SEQ ID NO: 6318)

C5-1058 Target:
5'-TGGATTTTCTGAAGAGGCAGAAATACC-3' (SEQ ID NO: 8628)

5'-AUUUUCUGAAGAGGCAGAAAUACct-3' (SEQ ID NO: 4009)

3'-CCUAAAAGACUUCUCCGUCUUUAUGGA-5' (SEQ ID NO: 6319)

C5-1059 Target:
5'-GGATTTTCTGAAGAGGCAGAAATACCT-3' (SEQ ID NO: 8629)

5'-UUUUCUGAAGAGGCAGAAAUACCtg-3' (SEQ ID NO: 4010)

3'-CUAAAAGACUUCUCCGUCUUUAUGGAC-5' (SEQ ID NO: 6320)

C5-1060 Target:
5'-GATTTTCTGAAGAGGCAGAAATACCTG-3' (SEQ ID NO: 8630)

5'-UUUCUGAAGAGGCAGAAAUACCUgg-3' (SEQ ID NO: 4011)

3'-UAAAAGACUUCUCCGUCUUUAUGGACC-5' (SEQ ID NO: 6321)

C5-1061 Target:
5'-ATTTTCTGAAGAGGCAGAAATACCTGG-3' (SEQ ID NO: 8631)

5'-UUCUGAAGAGGCAGAAAUACCUGgc-3' (SEQ ID NO: 4012)

3'-AAAAGACUUCUCCGUCUUUAUGGACCG-5' (SEQ ID NO: 6322)

C5-1062 Target:
5'-TTTTCTGAAGAGGCAGAAATACCTGGC-3' (SEQ ID NO: 8632)

5'-UCUGAAGAGGCAGAAAUACCUGGca-3' (SEQ ID NO: 4013)

3'-AAAGACUUCUCCGUCUUUAUGGACCGU-5' (SEQ ID NO: 6323)

C5-1063 Target:
5'-TTTCTGAAGAGGCAGAAATACCTGGCA-3' (SEQ ID NO: 8633)

5'-CUGAAGAGGCAGAAAUACCUGGCat-3' (SEQ ID NO: 4014)

3'-AAGACUUCUCCGUCUUUAUGGACCGUA-5' (SEQ ID NO: 6324)

C5-1064 Target:
5'-TTCTGAAGAGGCAGAAATACCTGGCAT-3' (SEQ ID NO: 8634)

5'-UGAAGAGGCAGAAAUACCUGGCAtc-3' (SEQ ID NO: 4015)

3'-AGACUUCUCCGUCUUUAUGGACCGUAG-5' (SEQ ID NO: 6325)

C5-1065 Target:
5'-TCTGAAGAGGCAGAAATACCTGGCATC-3' (SEQ ID NO: 8635)

5'-GAAGAGGCAGAAAUACCUGGCAUca-3' (SEQ ID NO: 4016)

3'-GACUUCUCCGUCUUUAUGGACCGUAGU-5' (SEQ ID NO: 6326)

C5-1066 Target:
5'-CTGAAGAGGCAGAAATACCTGGCATCA-3' (SEQ ID NO: 8636)

5'-AAGAGGCAGAAAUACCUGGCAUCaa-3' (SEQ ID NO: 4017)

3'-ACUUCUCCGUCUUUAUGGACCGUAGUU-5' (SEQ ID NO: 6327)

C5-1067 Target:
5'-TGAAGAGGCAGAAATACCTGGCATCAA-3' (SEQ ID NO: 8637)

5'-AGAGGCAGAAAUACCUGGCAUCAaa-3' (SEQ ID NO: 4018)

3'-CUUCUCCGUCUUUAUGGACCGUAGUU-5' (SEQ ID NO: 6328)

TABLE 7-continued

Human Anti-C5 DsiRNAs Predicted to have >50% Knockdown Efficacy (Asymmetrics)

C5-1068 Target:
5'-GAAGAGGCAGAAATACCTGGCATCAAA-3' (SEQ ID NO: 8638)

5'-GAGGCAGAAAUACCUGGCAUCAAat-3' (SEQ ID NO: 4019)

3'-UUCUCCGUCUUUAUGGACCGUAGUUUA-5' (SEQ ID NO: 6329)

C5-1069 Target:
5'-AAGAGGCAGAAATACCTGGCATCAAAT-3' (SEQ ID NO: 8639)

5'-AGGCAGAAAUACCUGGCAUCAAAta-3' (SEQ ID NO: 4020)

3'-UCUCCGUCUUUAUGGACCGUAGUUUAU-5' (SEQ ID NO: 6330)

C5-1070 Target:
5'-AGAGGCAGAAATACCTGGCATCAAATA-3' (SEQ ID NO: 8640)

5'-GGCAGAAAUACCUGGCAUCAAAUat-3' (SEQ ID NO: 4021)

3'-CUCCGUCUUUAUGGACCGUAGUUUAUA-5' (SEQ ID NO: 6331)

C5-1071 Target:
5'-GAGGCAGAAATACCTGGCATCAAATAT-3' (SEQ ID NO: 8641)

5'-GCAGAAAUACCUGGCAUCAAAUAtg-3' (SEQ ID NO: 4022)

3'-UCCGUCUUUAUGGACCGUAGUUUAUAC-5' (SEQ ID NO: 6332)

C5-1072 Target:
5'-AGGCAGAAATACCTGGCATCAAATATG-3' (SEQ ID NO: 8642)

5'-CAGAAAUACCUGGCAUCAAAUAUgt-3' (SEQ ID NO: 4023)

3'-CCGUCUUUAUGGACCGUAGUUUAUACA-5' (SEQ ID NO: 6333)

C5-1073 Target:
5'-GGCAGAAATACCTGGCATCAAATATGT-3' (SEQ ID NO: 8643)

5'-AGAAAUACCUGGCAUCAAAUAUGtc-3' (SEQ ID NO: 4024)

3'-CGUCUUUAUGGACCGUAGUUUAUACAG-5' (SEQ ID NO: 6334)

C5-1074 Target:
5'-GCAGAAATACCTGGCATCAAATATGTC-3' (SEQ ID NO: 8644)

5'-GAAAUACCUGGCAUCAAAUAUGUcc-3' (SEQ ID NO: 4025)

3'-GUCUUUAUGGACCGUAGUUUAUACAGG-5' (SEQ ID NO: 6335)

C5-1075 Target:
5'-CAGAAATACCTGGCATCAAATATGTCC-3' (SEQ ID NO: 8645)

5'-AAAUACCUGGCAUCAAAUAUGUCct-3' (SEQ ID NO: 4026)

3'-UCUUUAUGGACCGUAGUUUAUACAGGA-5' (SEQ ID NO: 6336)

C5-1076 Target:
5'-AGAAATACCTGGCATCAAATATGTCCT-3' (SEQ ID NO: 8646)

5'-AAUACCUGGCAUCAAAUAUGUCCtc-3' (SEQ ID NO: 4027)

3'-CUUUAUGGACCGUAGUUUAUACAGGAG-5' (SEQ ID NO: 6337)

C5-1077 Target:
5'-GAAATACCTGGCATCAAATATGTCCTC-3' (SEQ ID NO: 8647)

5'-AUACCUGGCAUCAAAUAUGUCCUct-3' (SEQ ID NO: 4028)

3'-UUUAUGGACCGUAGUUUAUACAGGAGA-5' (SEQ ID NO: 6338)

C5-1078 Target:
5'-AAATACCTGGCATCAAATATGTCCTCT-3' (SEQ ID NO: 8648)

5'-UACCUGGCAUCAAAUAUGUCCUCtc-3' (SEQ ID NO: 4029)

3'-UUAUGGACCGUAGUUUAUACAGGAGAG-5' (SEQ ID NO: 6339)

TABLE 7-continued

Human Anti-C5 DsiRNAs Predicted to have >50% Knockdown Efficacy (Asymmetrics)

```
C5-1079 Target:
5'-AATACCTGGCATCAAATATGTCCTCTC-3'  (SEQ ID NO: 8649)

5'-ACCUGGCAUCAAAUAUGUCCUCUCt-3'  (SEQ ID NO: 4030)

3'-UAUGGACCGUAGUUUAUACAGGAGAGA-5'  (SEQ ID NO: 6340)

C5-1080 Target:
5'-ATACCTGGCATCAAATATGTCCTCTCT-3'  (SEQ ID NO: 8650)

5'-CCUGGCAUCAAAUAUGUCCUCUCtc-3'  (SEQ ID NO: 4031)

3'-AUGGACCGUAGUUUAUACAGGAGAGAG-5'  (SEQ ID NO: 6341)

C5-1081 Target:
5'-TACCTGGCATCAAATATGTCCTCTCTC-3'  (SEQ ID NO: 8651)

5'-CUGGCAUCAAAUAUGUCCUCUCUcc-3'  (SEQ ID NO: 4032)

3'-UGGACCGUAGUUUAUACAGGAGAGAGG-5'  (SEQ ID NO: 6342)

C5-1082 Target:
5'-ACCTGGCATCAAATATGTCCTCTCTCC-3'  (SEQ ID NO: 8652)

5'-UGGCAUCAAAUAUGUCCUCUCUCcc-3'  (SEQ ID NO: 4033)

3'-GGACCGUAGUUUAUACAGGAGAGAGGG-5'  (SEQ ID NO: 6343)

C5-1083 Target:
5'-CCTGGCATCAAATATGTCCTCTCTCCC-3'  (SEQ ID NO: 8653)

5'-GGCAUCAAAUAUGUCCUCUCUCCct-3'  (SEQ ID NO: 4034)

3'-GACCGUAGUUUAUACAGGAGAGAGGGA-5'  (SEQ ID NO: 6344)

C5-1084 Target:
5'-CTGGCATCAAATATGTCCTCTCTCCCT-3'  (SEQ ID NO: 8654)

5'-GCAUCAAAUAUGUCCUCUCUCCCta-3'  (SEQ ID NO: 4035)

3'-ACCGUAGUUUAUACAGGAGAGAGGGAU-5'  (SEQ ID NO: 6345)

C5-1085 Target:
5'-TGGCATCAAATATGTCCTCTCTCCCTA-3'  (SEQ ID NO: 8655)

5'-CAUCAAAUAUGUCCUCUCUCCCUac-3'  (SEQ ID NO: 4036)

3'-CCGUAGUUUAUACAGGAGAGAGGGAUG-5'  (SEQ ID NO: 6346)

C5-1086 Target:
5'-GGCATCAAATATGTCCTCTCTCCCTAC-3'  (SEQ ID NO: 8656)

5'-AUCAAAUAUGUCCUCUCUCCCUAca-3'  (SEQ ID NO: 4037)

3'-CGUAGUUUAUACAGGAGAGAGGGAUGU-5'  (SEQ ID NO: 6347)

C5-1087 Target:
5'-GCATCAAATATGTCCTCTCTCCCTACA-3'  (SEQ ID NO: 8657)

5'-CAAAUAUGUCCUCUCUCCCUACAaa-3'  (SEQ ID NO: 4038)

3'-UAGUUUAUACAGGAGAGAGGGAUGUUU-5'  (SEQ ID NO: 6348)

C5-1089 Target:
5'-ATCAAATATGTCCTCTCTCCCTACAAA-3'  (SEQ ID NO: 8658)

5'-AAAUAUGUCCUCUCUCCCUACAAac-3'  (SEQ ID NO: 4039)

3'-AGUUUAUACAGGAGAGAGGGAUGUUUG-5'  (SEQ ID NO: 6349)

C5-1090 Target:
5'-TCAAATATGTCCTCTCTCCCTACAAAC-3'  (SEQ ID NO: 8659)

5'-AAUAUGUCCUCUCUCCCUACAAAct-3'  (SEQ ID NO: 4040)

3'-GUUUAUACAGGAGAGAGGGAUGUUUGA-5'  (SEQ ID NO: 6350)

C5-1091 Target:
5'-CAAATATGTCCTCTCTCCCTACAAACT-3'  (SEQ ID NO: 8660)

5'-AUAUGUCCUCUCUCCCUACAAACtg-3'  (SEQ ID NO: 4041)

3'-UUUAUACAGGAGAGAGGGAUGUUUGAC-5'  (SEQ ID NO: 6351)

C5-1092 Target:
5'-AAATATGTCCTCTCTCCCTACAAACTG-3'  (SEQ ID NO: 8661)

5'-UAUGUCCUCUCUCCCUACAAACUga-3'  (SEQ ID NO: 4042)

3'-UUAUACAGGAGAGAGGGAUGUUUGACU-5'  (SEQ ID NO: 6352)

C5-1093 Target:
5'-AATATGTCCTCTCTCCCTACAAACTGA-3'  (SEQ ID NO: 8662)

5'-AUGUCCUCUCUCCCUACAAACUGaa-3'  (SEQ ID NO: 4043)

3'-UAUACAGGAGAGAGGGAUGUUUGACUU-5'  (SEQ ID NO: 6353)

C5-1094 Target:
5'-ATATGTCCTCTCTCCCTACAAACTGAA-3'  (SEQ ID NO: 8663)

5'-UGUCCUCUCUCCCUACAAACUGAat-3'  (SEQ ID NO: 4044)

3'-AUACAGGAGAGAGGGAUGUUUGACUUA-5'  (SEQ ID NO: 6354)

C5-1095 Target:
5'-TATGTCCTCTCTCCCTACAAACTGAAT-3'  (SEQ ID NO: 8664)

5'-GUCCUCUCUCCCUACAAACUGAAtt-3'  (SEQ ID NO: 4045)

3'-UACAGGAGAGAGGGAUGUUUGACUUAA-5'  (SEQ ID NO: 6355)

C5-1096 Target:
5'-ATGTCCTCTCTCCCTACAAACTGAATT-3'  (SEQ ID NO: 8665)

5'-UCCUCUCUCCCUACAAACUGAAUtt-3'  (SEQ ID NO: 4046)

3'-ACAGGAGAGAGGGAUGUUUGACUUAAA-5'  (SEQ ID NO: 6356)

C5-1097 Target:
5'-TGTCCTCTCTCCCTACAAACTGAATTT-3'  (SEQ ID NO: 8666)

5'-CCUCUCUCCCUACAAACUGAAUUtg-3'  (SEQ ID NO: 4047)

3'-CAGGAGAGAGGGAUGUUUGACUUAAAC-5'  (SEQ ID NO: 6357)

C5-1098 Target:
5'-GTCCTCTCTCCCTACAAACTGAATTTG-3'  (SEQ ID NO: 8667)

5'-CUCUCUCCCUACAAACUGAAUUUgg-3'  (SEQ ID NO: 4048)

3'-AGGAGAGAGGGAUGUUUGACUUAAACC-5'  (SEQ ID NO: 6358)

C5-1099 Target:
5'-TCCTCTCTCCCTACAAACTGAATTTGG-3'  (SEQ ID NO: 8668)

5'-UCUCUCCCUACAAACUGAAUUUGgt-3'  (SEQ ID NO: 4049)

3'-GGAGAGAGGGAUGUUUGACUUAAACCA-5'  (SEQ ID NO: 6359)

C5-1100 Target:
5'-CCTCTCTCCCTACAAACTGAATTTGGT-3'  (SEQ ID NO: 8669)

5'-CUCUCCCUACAAACUGAAUUUGGtt-3'  (SEQ ID NO: 4050)

3'-GAGAGAGGGAUGUUUGACUUAAACCAA-5'  (SEQ ID NO: 6360)

C5-1101 Target:
5'-CTCTCTCCCTACAAACTGAATTTGGTT-3'  (SEQ ID NO: 8670)

5'-UCUCCCUACAAACUGAAUUUGGUtg-3'  (SEQ ID NO: 4051)

3'-AGAGAGGGAUGUUUGACUUAAACCAAC-5'  (SEQ ID NO: 6361)
```

TABLE 7-continued

Human Anti-C5 DsiRNAs Predicted to have >50% Knockdown Efficacy (Asymmetrics)

C5-1102 Target:
5'-TCTCTCCCTACAAACTGAATTTGGTTG-3' (SEQ ID NO: 8671)

5'-CUCCCUACAAACUGAAUUUGGUUGc-3' (SEQ ID NO: 4052)

3'-GAGAGGGAUGUUUGACUUAAACCAACG-5' (SEQ ID NO: 6362)

C5-1103 Target:
5'-CTCTCCCTACAAACTGAATTTGGTTGC-3' (SEQ ID NO: 8672)

5'-UCCCUACAAACUGAAUUUGGUUGct-3' (SEQ ID NO: 4053)

3'-AGAGGGAUGUUUGACUUAAACCAACGA-5' (SEQ ID NO: 6363)

C5-1104 Target:
5'-TCTCCCTACAAACTGAATTTGGTTGCT-3' (SEQ ID NO: 8673)

5'-CCUACAAACUGAAUUUGGUUGCUac-3' (SEQ ID NO: 4054)

3'-AGGGAUGUUUGACUUAAACCAACGAUG-5' (SEQ ID NO: 6364)

C5-1106 Target:
5'-TCCCTACAAACTGAATTTGGTTGCTAC-3' (SEQ ID NO: 8674)

5'-CUACAAACUGAAUUUGGUUGCUAct-3' (SEQ ID NO: 4055)

3'-GGGAUGUUUGACUUAAACCAACGAUGA-5' (SEQ ID NO: 6365)

C5-1107 Target:
5'-CCCTACAAACTGAATTTGGTTGCTACT-3' (SEQ ID NO: 8675)

5'-UACAAACUGAAUUUGGUUGCUACtc-3' (SEQ ID NO: 4056)

3'-GGAUGUUUGACUUAAACCAACGAUGAG-5' (SEQ ID NO: 6366)

C5-1108 Target:
5'-CCTACAAACTGAATTTGGTTGCTACTC-3' (SEQ ID NO: 8676)

5'-AAACUGAAUUUGGUUGCUACUCCtc-3' (SEQ ID NO: 4057)

3'-UGUUUGACUUAAACCAACGAUGAGGAG-5' (SEQ ID NO: 6367)

C5-1111 Target:
5'-ACAAACTGAATTTGGTTGCTACTCCTC-3' (SEQ ID NO: 8677)

5'-AACUGAAUUUGGUUGCUACUCCUct-3' (SEQ ID NO: 4058)

3'-GUUUGACUUAAACCAACGAUGAGGAGA-5' (SEQ ID NO: 6368)

C5-1112 Target:
5'-CAAACTGAATTTGGTTGCTACTCCTCT-3' (SEQ ID NO: 8678)

5'-ACUGAAUUUGGUUGCUACUCCUCtt-3' (SEQ ID NO: 4059)

3'-UUUGACUUAAACCAACGAUGAGGAGAA-5' (SEQ ID NO: 6369)

C5-1113 Target:
5'-AAACTGAATTTGGTTGCTACTCCTCTT-3' (SEQ ID NO: 8679)

5'-CUGAAUUUGGUUGCUACUCCUCUtt-3' (SEQ ID NO: 4060)

3'-UUGACUUAAACCAACGAUGAGGAGAAA-5' (SEQ ID NO: 6370)

C5-1114 Target:
5'-AACTGAATTTGGTTGCTACTCCTCTTT-3' (SEQ ID NO: 8680)

5'-UGAAUUUGGUUGCUACUCCUCUtt-3' (SEQ ID NO: 4061)

3'-UGACUUAAACCAACGAUGAGGAGAAAA-5' (SEQ ID NO: 6371)

C5-1115 Target:
5'-ACTGAATTTGGTTGCTACTCCTCTTTT-3' (SEQ ID NO: 8681)

5'-GAAUUUGGUUGCUACUCCUCUUUtc-3' (SEQ ID NO: 4062)

3'-GACUUAAACCAACGAUGAGGAGAAAAG-5' (SEQ ID NO: 6372)

C5-1116 Target:
5'-CTGAATTTGGTTGCTACTCCTCTTTTC-3' (SEQ ID NO: 8682)

5'-AAUUUGGUUGCUACUCCUCUUUUcc-3' (SEQ ID NO: 4063)

3'-ACUUAAACCAACGAUGAGGAGAAAAGG-5' (SEQ ID NO: 6373)

C5-1117 Target:
5'-TGAATTTGGTTGCTACTCCTCTTTTCC-3' (SEQ ID NO: 8683)

5'-AUUUGGUUGCUACUCCUCUUUUCct-3' (SEQ ID NO: 4064)

3'-CUUAAACCAACGAUGAGGAGAAAAGGA-5' (SEQ ID NO: 6374)

C5-1118 Target:
5'-GAATTTGGTTGCTACTCCTCTTTTCCT-3' (SEQ ID NO: 8684)

5'-UUUGGUUGCUACUCCUCUUUUCCtg-3' (SEQ ID NO: 4065)

3'-UUAAACCAACGAUGAGGAGAAAAGGAC-5' (SEQ ID NO: 6375)

C5-1119 Target:
5'-AATTTGGTTGCTACTCCTCTTTTCCTG-3' (SEQ ID NO: 8685)

5'-UUGGUUGCUACUCCUCUUUUCCUga-3' (SEQ ID NO: 4066)

3'-UAAACCAACGAUGAGGAGAAAAGGACU-5' (SEQ ID NO: 6376)

C5-1120 Target:
5'-ATTTGGTTGCTACTCCTCTTTTCCTGA-3' (SEQ ID NO: 8686)

5'-UGGUUGCUACUCCUCUUUUCCUGaa-3' (SEQ ID NO: 4067)

3'-AAACCAACGAUGAGGAGAAAAGGACUU-5' (SEQ ID NO: 6377)

C5-1121 Target:
5'-TTTGGTTGCTACTCCTCTTTTCCTGAA-3' (SEQ ID NO: 8687)

5'-GGUUGCUACUCCUCUUUUCCUGAag-3' (SEQ ID NO: 4068)

3'-AACCAACGAUGAGGAGAAAAGGACUUC-5' (SEQ ID NO: 6378)

C5-1122 Target:
5'-TTGGTTGCTACTCCTCTTTTCCTGAAG-3' (SEQ ID NO: 8688)

5'-GUUGCUACUCCUCUUUUCCUGAAgc-3' (SEQ ID NO: 4069)

3'-ACCAACGAUGAGGAGAAAAGGACUUCG-5' (SEQ ID NO: 6379)

C5-1123 Target:
5'-TGGTTGCTACTCCTCTTTTCCTGAAGC-3' (SEQ ID NO: 8689)

5'-UUGCUACUCCUCUUUUCCUGAAGcc-3' (SEQ ID NO: 4070)

3'-CCAACGAUGAGGAGAAAAGGACUUCGG-5' (SEQ ID NO: 6380)

C5-1124 Target:
5'-GGTTGCTACTCCTCTTTTCCTGAAGCC-3' (SEQ ID NO: 8690)

5'-UGCUACUCCUCUUUUCCUGAAGCct-3' (SEQ ID NO: 4071)

3'-CAACGAUGAGGAGAAAAGGACUUCGGA-5' (SEQ ID NO: 6381)

C5-1125 Target:
5'-GTTGCTACTCCTCTTTTCCTGAAGCCT-3' (SEQ ID NO: 8691)

5'-GCUACUCCUCUUUUCCUGAAGCCtg-3' (SEQ ID NO: 4072)

3'-AACGAUGAGGAGAAAAGGACUUCGGAC-5' (SEQ ID NO: 6382)

C5-1126 Target:
5'-TTGCTACTCCTCTTTTCCTGAAGCCTG-3' (SEQ ID NO: 8692)

5'-CUACUCCUCUUUUCCUGAAGCCUgg-3' (SEQ ID NO: 4073)

3'-ACGAUGAGGAGAAAAGGACUUCGGACC-5' (SEQ ID NO: 6383)

TABLE 7-continued

Human Anti-C5 DsiRNAs Predicted to have >50% Knockdown Efficacy (Asymmetrics)

C5-1127 Target:
5'-TGCTACTCCTCTTTTCCTGAAGCCTGG-3' (SEQ ID NO: 8693)

5'-UACUCCUCUUUUCCUGAAGCCUGGg-3' (SEQ ID NO: 4074)

3'-CGAUGAGGAGAAAAGGACUUCGGACCC-5' (SEQ ID NO: 6384)

C5-1128 Target:
5'-GCTACTCCTCTTTTCCTGAAGCCTGGG-3' (SEQ ID NO: 8694)

5'-ACUCCUCUUUUCCUGAAGCCUGGGa-3' (SEQ ID NO: 4075)

3'-GAUGAGGAGAAAAGGACUUCGGACCCU-5' (SEQ ID NO: 6385)

C5-1129 Target:
5'-CTACTCCTCTTTTCCTGAAGCCTGGGA-3' (SEQ ID NO: 8695)

5'-CUCCUCUUUUCCUGAAGCCUGGGat-3' (SEQ ID NO: 4076)

3'-AUGAGGAGAAAAGGACUUCGGACCCUA-5' (SEQ ID NO: 6386)

C5-1130 Target:
5'-TACTCCTCTTTTCCTGAAGCCTGGGAT-3' (SEQ ID NO: 8696)

5'-UCCUCUUUUCCUGAAGCCUGGGAtt-3' (SEQ ID NO: 4077)

3'-UGAGGAGAAAAGGACUUCGGACCCUAA-5' (SEQ ID NO: 6387)

C5-1131 Target:
5'-ACTCCTCTTTTCCTGAAGCCTGGGATT-3' (SEQ ID NO: 8697)

5'-CCUCUUUUCCUGAAGCCUGGGAUtc-3' (SEQ ID NO: 4078)

3'-GAGGAGAAAAGGACUUCGGACCCUAAG-5' (SEQ ID NO: 6388)

C5-1132 Target:
5'-CTCCTCTTTTCCTGAAGCCTGGGATTC-3' (SEQ ID NO: 8698)

5'-CUCUUUUCCUGAAGCCUGGGAUUcc-3' (SEQ ID NO: 4079)

3'-AGGAGAAAAGGACUUCGGACCCUAAGG-5' (SEQ ID NO: 6389)

C5-1133 Target:
5'-TCCTCTTTTCCTGAAGCCTGGGATTCC-3' (SEQ ID NO: 8699)

5'-UCUUUUCCUGAAGCCUGGGAUUCca-3' (SEQ ID NO: 4080)

3'-GGAGAAAAGGACUUCGGACCCUAAGGU-5' (SEQ ID NO: 6390)

C5-1134 Target:
5'-CCTCTTTTCCTGAAGCCTGGGATTCCA-3' (SEQ ID NO: 8700)

5'-CUUUUCCUGAAGCCUGGGAUUCCat-3' (SEQ ID NO: 4081)

3'-GAGAAAAGGACUUCGGACCCUAAGGUA-5' (SEQ ID NO: 6391)

C5-1135 Target:
5'-CTCTTTTCCTGAAGCCTGGGATTCCAT-3' (SEQ ID NO: 8701)

5'-UUUUCCUGAAGCCUGGGAUUCCAta-3' (SEQ ID NO: 4082)

3'-AGAAAAGGACUUCGGACCCUAAGGUAU-5' (SEQ ID NO: 6392)

C5-1136 Target:
5'-TCTTTTCCTGAAGCCTGGGATTCCATA-3' (SEQ ID NO: 8702)

5'-UUUCCUGAAGCCUGGGAUUCCAUat-3' (SEQ ID NO: 4083)

3'-GAAAAGGACUUCGGACCCUAAGGUAUA-5' (SEQ ID NO: 6393)

C5-1137 Target:
5'-CTTTTCCTGAAGCCTGGGATTCCATAT-3' (SEQ ID NO: 8703)

5'-UUCCUGAAGCCUGGGAUUCCAUAtc-3' (SEQ ID NO: 4084)

3'-AAAAGGACUUCGGACCCUAAGGUAUAG-5' (SEQ ID NO: 6394)

C5-1138 Target:
5'-TTTTCCTGAAGCCTGGGATTCCATATC-3' (SEQ ID NO: 8704)

5'-UCCUGAAGCCUGGGAUUCCAUAUcc-3' (SEQ ID NO: 4085)

3'-AAAGGACUUCGGACCCUAAGGUAUAGG-5' (SEQ ID NO: 6395)

C5-1139 Target:
5'-TTTCCTGAAGCCTGGGATTCCATATCC-3' (SEQ ID NO: 8705)

5'-CCUGAAGCCUGGGAUUCCAUAUCcc-3' (SEQ ID NO: 4086)

3'-AAGGACUUCGGACCCUAAGGUAUAGGG-5' (SEQ ID NO: 6396)

C5-1140 Target:
5'-TTCCTGAAGCCTGGGATTCCATATCCC-3' (SEQ ID NO: 8706)

5'-CUGAAGCCUGGGAUUCCAUAUCCca-3' (SEQ ID NO: 4087)

3'-AGGACUUCGGACCCUAAGGUAUAGGGU-5' (SEQ ID NO: 6397)

C5-1141 Target:
5'-TCCTGAAGCCTGGGATTCCATATCCCA-3' (SEQ ID NO: 8707)

5'-UGAAGCCUGGGAUUCCAUAUCCCat-3' (SEQ ID NO: 4088)

3'-GGACUUCGGACCCUAAGGUAUAGGGUA-5' (SEQ ID NO: 6398)

C5-1142 Target:
5'-CCTGAAGCCTGGGATTCCATATCCCAT-3' (SEQ ID NO: 8708)

5'-GAAGCCUGGGAUUCCAUAUCCCAtc-3' (SEQ ID NO: 4089)

3'-GACUUCGGACCCUAAGGUAUAGGGUAG-5' (SEQ ID NO: 6399)

C5-1143 Target:
5'-CTGAAGCCTGGGATTCCATATCCCATC-3' (SEQ ID NO: 8709)

5'-CCAUCAAGGUGCAGGUUAAAGAUtc-3' (SEQ ID NO: 4090)

3'-AGGGUAGUUCCACGUCCAAUUUCUAAG-5' (SEQ ID NO: 6400)

C5-1163 Target:
5'-TCCCATCAAGGTGCAGGTTAAAGATTC-3' (SEQ ID NO: 8710)

5'-CAUCAAGGUGCAGGUUAAAGAUUcg-3' (SEQ ID NO: 4091)

3'-GGGUAGUUCCACGUCCAAUUUCUAAGC-5' (SEQ ID NO: 6401)

C5-1164 Target:
5'-CCCATCAAGGTGCAGGTTAAAGATTCG-3' (SEQ ID NO: 8711)

5'-AUCAAGGUGCAGGUUAAAGAUUCgc-3' (SEQ ID NO: 4092)

3'-GGUAGUUCCACGUCCAAUUUCUAAGCG-5' (SEQ ID NO: 6402)

C5-1165 Target:
5'-CCATCAAGGTGCAGGTTAAAGATTCGC-3' (SEQ ID NO: 8712)

5'-UCAAGGUGCAGGUUAAAGAUUCGct-3' (SEQ ID NO: 4093)

3'-GUAGUUCCACGUCCAAUUUCUAAGCGA-5' (SEQ ID NO: 6403)

C5-1166 Target:
5'-CATCAAGGTGCAGGTTAAAGATTCGCT-3' (SEQ ID NO: 8713)

5'-CAAGGUGCAGGUUAAAGAUUCGCtt-3' (SEQ ID NO: 4094)

3'-UAGUUCCACGUCCAAUUUCUAAGCGAA-5' (SEQ ID NO: 6404)

C5-1167 Target:
5'-ATCAAGGTGCAGGTTAAAGATTCGCTT-3' (SEQ ID NO: 8714)

5'-CGCUUGACCAGUUGGUAGGAGGAgt-3' (SEQ ID NO: 4095)

3'-AAGCGAACUGGUCAACCAUCCUCCUCA-5' (SEQ ID NO: 6405)

TABLE 7-continued

Human Anti-C5 DsiRNAs Predicted to have >50%
Knockdown Efficacy (Asymmetrics)

C5-1187 Target:
5'-TTCGCTTGACCAGTTGGTAGGAGGAGT-3' (SEQ ID NO: 8715)

5'-GCUUGACCAGUUGGUAGGAGGAGtc-3' (SEQ ID NO: 4096)

3'-AGCGAACUGGUCAACCAUCCUCCUCAG-5' (SEQ ID NO: 6406)

C5-1188 Target:
5'-TCGCTTGACCAGTTGGTAGGAGGAGTC-3' (SEQ ID NO: 8716)

5'-CUUGACCAGUUGGUAGGAGGAGUcc-3' (SEQ ID NO: 4097)

3'-GCGAACUGGUCAACCAUCCUCCUCAGG-5' (SEQ ID NO: 6407)

C5-1189 Target:
5'-CGCTTGACCAGTTGGTAGGAGGAGTCC-3' (SEQ ID NO: 8717)

5'-UUGACCAGUUGGUAGGAGGAGUCcc-3' (SEQ ID NO: 4098)

3'-CGAACUGGUCAACCAUCCUCCUCAGGG-5' (SEQ ID NO: 6408)

C5-1190 Target:
5'-GCTTGACCAGTTGGTAGGAGGAGTCCC-3' (SEQ ID NO: 8718)

5'-GUCCCAGUAACACUGAAUGCACAaa-3' (SEQ ID NO: 4099)

3'-CUCAGGGUCAUUGUGACUUACGUGUUU-5' (SEQ ID NO: 6409)

C5-1210 Target:
5'-GAGTCCCAGTAACACTGAATGCACAAA-3' (SEQ ID NO: 8719)

5'-UCCCAGUAACACUGAAUGCACAAac-3' (SEQ ID NO: 4100)

3'-UCAGGGUCAUUGUGACUUACGUGUUUG-5' (SEQ ID NO: 6410)

C5-1211 Target:
5'-AGTCCCAGTAACACTGAATGCACAAAC-3' (SEQ ID NO: 8720)

5'-CCCAGUAACACUGAAUGCACAAAca-3' (SEQ ID NO: 4101)

3'-CAGGGUCAUUGUGACUUACGUGUUUGU-5' (SEQ ID NO: 6411)

C5-1212 Target:
5'-GTCCCAGTAACACTGAATGCACAAACA-3' (SEQ ID NO: 8721)

5'-CCAGUAACACUGAAUGCACAAACaa-3' (SEQ ID NO: 4102)

3'-AGGGUCAUUGUGACUUACGUGUUUGUU-5' (SEQ ID NO: 6412)

C5-1213 Target:
5'-TCCCAGTAACACTGAATGCACAAACAA-3' (SEQ ID NO: 8722)

5'-CAGUAACACUGAAUGCACAAACAat-3' (SEQ ID NO: 4103)

3'-GGGUCAUUGUGACUUACGUGUUUGUUA-5' (SEQ ID NO: 6413)

C5-1214 Target:
5'-CCCAGTAACACTGAATGCACAAACAAT-3' (SEQ ID NO: 8723)

5'-AGUAACACUGAAUGCACAAACAAtt-3' (SEQ ID NO: 4104)

3'-GGUCAUUGUGACUUACGUGUUUGUUAA-5' (SEQ ID NO: 6414)

C5-1215 Target:
5'-CCAGTAACACTGAATGCACAAACAATT-3' (SEQ ID NO: 8724)

5'-GUAACACUGAAUGCACAAACAAUtg-3' (SEQ ID NO: 4105)

3'-GUCAUUGUGACUUACGUGUUUGUUAAC-5' (SEQ ID NO: 6415)

C5-1216 Target:
5'-CAGTAACACTGAATGCACAAACAATTG-3' (SEQ ID NO: 8725)

5'-UAACACUGAAUGCACAAACAAUUga-3' (SEQ ID NO: 4106)

3'-UCAUUGUGACUUACGUGUUUGUUAACU-5' (SEQ ID NO: 6416)

C5-1217 Target:
5'-AGTAACACTGAATGCACAAACAATTGA-3' (SEQ ID NO: 8726)

5'-AACACUGAAUGCACAAACAAUUGat-3' (SEQ ID NO: 4107)

3'-CAUUGUGACUUACGUGUUUGUUAACUA-5' (SEQ ID NO: 6417)

C5-1218 Target:
5'-GTAACACTGAATGCACAAACAATTGAT-3' (SEQ ID NO: 8727)

5'-ACACUGAAUGCACAAACAAUUGAtg-3' (SEQ ID NO: 4108)

3'-AUUGUGACUUACGUGUUUGUUAACUAC-5' (SEQ ID NO: 6418)

C5-1219 Target:
5'-TAACACTGAATGCACAAACAATTGATG-3' (SEQ ID NO: 8728)

5'-CACUGAAUGCACAAACAAUUGAUgt-3' (SEQ ID NO: 4109)

3'-UUGUGACUUACGUGUUUGUUAACUACA-5' (SEQ ID NO: 6419)

C5-1220 Target:
5'-AACACTGAATGCACAAACAATTGATGT-3' (SEQ ID NO: 8729)

5'-ACUGAAUGCACAAACAAUUGAUGta-3' (SEQ ID NO: 4110)

3'-UGUGACUUACGUGUUUGUUAACUACAU-5' (SEQ ID NO: 6420)

C5-1221 Target:
5'-ACACTGAATGCACAAACAATTGATGTA-3' (SEQ ID NO: 8730)

5'-GAAUGCACAAACAAUUGAUGUAAac-3' (SEQ ID NO: 4111)

3'-GACUUACGUGUUUGUUAACUACAUUUG-5' (SEQ ID NO: 6421)

C5-1224 Target:
5'-CTGAATGCACAAACAATTGATGTAAAC-3' (SEQ ID NO: 8731)

5'-AAUGCACAAACAAUUGAUGUAAAcc-3' (SEQ ID NO: 4112)

3'-ACUUACGUGUUUGUUAACUACAUUUGG-5' (SEQ ID NO: 6422)

C5-1225 Target:
5'-TGAATGCACAAACAATTGATGTAAACC-3' (SEQ ID NO: 8732)

5'-AUGCACAAACAAUUGAUGUAAACca-3' (SEQ ID NO: 4113)

3'-CUUACGUGUUUGUUAACUACAUUUGGU-5' (SEQ ID NO: 6423)

C5-1226 Target:
5'-GAATGCACAAACAATTGATGTAAACCA-3' (SEQ ID NO: 8733)

5'-AACCAAGAGACAUCUGACUUGGAtc-3' (SEQ ID NO: 4114)

3'-AUUUGGUUCUCUGUAGACUGAACCUAG-5' (SEQ ID NO: 6424)

C5-1246 Target:
5'-TAAACCAAGAGACATCTGACTTGGATC-3' (SEQ ID NO: 8734)

5'-ACCAAGAGACAUCUGACUUGGAUcc-3' (SEQ ID NO: 4115)

3'-UUUGGUUCUCUGUAGACUGAACCUAGG-5' (SEQ ID NO: 6425)

C5-1247 Target:
5'-AAACCAAGAGACATCTGACTTGGATCC-3' (SEQ ID NO: 8735)

5'-CCAAGAGACAUCUGACUUGGAUCca-3' (SEQ ID NO: 4116)

3'-UUGGUUCUCUGUAGACUGAACCUAGGU-5' (SEQ ID NO: 6426)

C5-1248 Target:
5'-AACCAAGAGACATCTGACTTGGATCCA-3' (SEQ ID NO: 8736)

5'-AAAAGUGUAACACGUGUUGAUGAtg-3' (SEQ ID NO: 4117)

3'-CGUUUUCACAUUGUGCACAACUACUAC-5' (SEQ ID NO: 6427)

TABLE 7-continued

Human Anti-C5 DsiRNAs Predicted to have >50% Knockdown Efficacy (Asymmetrics)

C5-1276 Target:
5'-GCAAAAGTGTAACACGTGTTGATGATG-3' (SEQ ID NO: 8737)

5'-AAAGUGUAACACGUGUUGAUGAUGg-3' (SEQ ID NO: 4118)

3'-GUUUUCACAUUGUGCACAACUACUACC-5' (SEQ ID NO: 6428)

C5-1277 Target:
5'-CAAAAGTGTAACACGTGTTGATGATGG-3' (SEQ ID NO: 8738)

5'-AAGUGUAACACGUGUUGAUGAUGGa-3' (SEQ ID NO: 4119)

3'-UUUUCACAUUGUGCACAACUACUACCU-5' (SEQ ID NO: 6429)

C5-1278 Target:
5'-AAAAGTGTAACACGTGTTGATGATGGA-3' (SEQ ID NO: 8739)

5'-AGUGUAACACGUGUUGAUGAUGGag-3' (SEQ ID NO: 4120)

3'-UUUCACAUUGUGCACAACUACUACCUC-5' (SEQ ID NO: 6430)

C5-1279 Target:
5'-AAAGTGTAACACGTGTTGATGATGGAG-3' (SEQ ID NO: 8740)

5'-GUGUAACACGUGUUGAUGAUGGAgt-3' (SEQ ID NO: 4121)

3'-UUCACAUUGUGCACAACUACUACCUCA-5' (SEQ ID NO: 6431)

C5-1280 Target:
5'-AAGTGTAACACGTGTTGATGATGGAGT-3' (SEQ ID NO: 8741)

5'-UGUAACACGUGUUGAUGAUGGAGta-3' (SEQ ID NO: 4122)

3'-UCACAUUGUGCACAACUACUACCUCAU-5' (SEQ ID NO: 6432)

C5-1281 Target:
5'-AGTGTAACACGTGTTGATGATGGAGTA-3' (SEQ ID NO: 8742)

5'-GUAACACGUGUUGAUGAUGGAGUag-3' (SEQ ID NO: 4123)

3'-CACAUUGUGCACAACUACUACCUCAUC-5' (SEQ ID NO: 6433)

C5-1282 Target:
5'-GTGTAACACGTGTTGATGATGGAGTAG-3' (SEQ ID NO: 8743)

5'-UAACACGUGUUGAUGAUGGAGUAgc-3' (SEQ ID NO: 4124)

3'-ACAUUGUGCACAACUACUACCUCAUCG-5' (SEQ ID NO: 6434)

C5-1283 Target:
5'-TGTAACACGTGTTGATGATGGAGTAGC-3' (SEQ ID NO: 8744)

5'-AACACGUGUUGAUGAUGGAGUAGct-3' (SEQ ID NO: 4125)

3'-CAUUGUGCACAACUACUACCUCAUCGA-5' (SEQ ID NO: 6435)

C5-1284 Target:
5'-GTAACACGTGTTGATGATGGAGTAGCT-3' (SEQ ID NO: 8745)

5'-ACACGUGUUGAUGAUGGAGUAGCtt-3' (SEQ ID NO: 4126)

3'-AUUGUGCACAACUACUACCUCAUCGAA-5' (SEQ ID NO: 6436)

C5-1285 Target:
5'-TAACACGTGTTGATGATGGAGTAGCTT-3' (SEQ ID NO: 8746)

5'-CACGUGUUGAUGAUGGAGUAGCUtc-3' (SEQ ID NO: 4127)

3'-UUGUGCACAACUACUACCUCAUCGAAG-5' (SEQ ID NO: 6437)

C5-1286 Target:
5'-AACACGTGTTGATGATGGAGTAGCTTC-3' (SEQ ID NO: 8747)

5'-ACGUGUUGAUGAUGGAGUAGCUUcc-3' (SEQ ID NO: 4128)

3'-UGUGCACAACUACUACCUCAUCGAAGG-5' (SEQ ID NO: 6438)

TABLE 7-continued

Human Anti-C5 DsiRNAs Predicted to have >50% Knockdown Efficacy (Asymmetrics)

C5-1287 Target:
5'-ACACGTGTTGATGATGGAGTAGCTTCC-3' (SEQ ID NO: 8748)

5'-CGUGUUGAUGAUGGAGUAGCUUCct-3' (SEQ ID NO: 4129)

3'-GUGCACAACUACUACCUCAUCGAAGGA-5' (SEQ ID NO: 6439)

C5-1288 Target:
5'-CACGTGTTGATGATGGAGTAGCTTCCT-3' (SEQ ID NO: 8749)

5'-GUGUUGAUGAUGGAGUAGCUUCCtt-3' (SEQ ID NO: 4130)

3'-UGCACAACUACUACCUCAUCGAAGGAA-5' (SEQ ID NO: 6440)

C5-1289 Target:
5'-ACGTGTTGATGATGGAGTAGCTTCCTT-3' (SEQ ID NO: 8750)

5'-UGUUGAUGAUGGAGUAGCUUCCUtt-3' (SEQ ID NO: 4131)

3'-GCACAACUACUACCUCAUCGAAGGAAA-5' (SEQ ID NO: 6441)

C5-1290 Target:
5'-CGTGTTGATGATGGAGTAGCTTCCTTT-3' (SEQ ID NO: 8751)

5'-GUUGAUGAUGGAGUAGCUUCCUUtg-3' (SEQ ID NO: 4132)

3'-CACAACUACUACCUCAUCGAAGGAAAC-5' (SEQ ID NO: 6442)

C5-1291 Target:
5'-GTGTTGATGATGGAGTAGCTTCCTTTG-3' (SEQ ID NO: 8752)

5'-UUGAUGAUGGAGUAGCUUCCUUUgt-3' (SEQ ID NO: 4133)

3'-ACAACUACUACCUCAUCGAAGGAAACA-5' (SEQ ID NO: 6443)

C5-1292 Target:
5'-TGTTGATGATGGAGTAGCTTCCTTTGT-3' (SEQ ID NO: 8753)

5'-UUAAUCUCCCAUCUGGAGUGACGgt-3' (SEQ ID NO: 4134)

3'-CGAAUUAGAGGGUAGACCUCACUGCCA-5' (SEQ ID NO: 6444)

C5-1319 Target:
5'-GCTTAATCTCCCATCTGGAGTGACGGT-3' (SEQ ID NO: 8754)

5'-UAAUCUCCCAUCUGGAGUGACGGtg-3' (SEQ ID NO: 4135)

3'-GAAUUAGAGGGUAGACCUCACUGCCAC-5' (SEQ ID NO: 6445)

C5-1320 Target:
5'-CTTAATCTCCCATCTGGAGTGACGGTG-3' (SEQ ID NO: 8755)

5'-AAUCUCCCAUCUGGAGUGACGGUgc-3' (SEQ ID NO: 4136)

3'-AAUUAGAGGGUAGACCUCACUGCCACG-5' (SEQ ID NO: 6446)

C5-1321 Target:
5'-TTAATCTCCCATCTGGAGTGACGGTGC-3' (SEQ ID NO: 8756)

5'-AUCUCCCAUCUGGAGUGACGGUGct-3' (SEQ ID NO: 4137)

3'-AUUAGAGGGUAGACCUCACUGCCACGA-5' (SEQ ID NO: 6447)

C5-1322 Target:
5'-TAATCTCCCATCTGGAGTGACGGTGCT-3' (SEQ ID NO: 8757)

5'-UCUCCCAUCUGGAGUGACGGUGCtg-3' (SEQ ID NO: 4138)

3'-UUAGAGGGUAGACCUCACUGCCACGAC-5' (SEQ ID NO: 6448)

C5-1323 Target:
5'-AATCTCCCATCTGGAGTGACGGTGCTG-3' (SEQ ID NO: 8758)

5'-UCCCAUCUGGAGUGACGGUGCUGga-3' (SEQ ID NO: 4139)

3'-AGAGGGUAGACCUCACUGCCACGACCU-5' (SEQ ID NO: 6449)

TABLE 7-continued

Human Anti-C5 DsiRNAs Predicted to have >50% Knockdown Efficacy (Asymmetrics)

C5-1325 Target:
5'-TCTCCCATCTGGAGTGACGGTGCTGGA-3' (SEQ ID NO: 8759)

5'-CCAUCUGGAGUGACGGUGCUGGAgt-3' (SEQ ID NO: 4140)

3'-AGGGUAGACCUCACUGCCACGACCUCA-5' (SEQ ID NO: 6450)

C5-1327 Target:
5'-TCCCATCTGGAGTGACGGTGCTGGAGT-3' (SEQ ID NO: 8760)

5'-CAUCUGGAGUGACGGUGCUGGAGtt-3' (SEQ ID NO: 4141)

3'-GGGUAGACCUCACUGCCACGACCUCAA-5' (SEQ ID NO: 6451)

C5-1328 Target:
5'-CCCATCTGGAGTGACGGTGCTGGAGTT-3' (SEQ ID NO: 8761)

5'-AUCUGGAGUGACGGUGCUGGAGUtt-3' (SEQ ID NO: 4142)

3'-GGUAGACCUCACUGCCACGACCUCAAA-5' (SEQ ID NO: 6452)

C5-1329 Target:
5'-CCATCTGGAGTGACGGTGCTGGAGTTT-3' (SEQ ID NO: 8762)

5'-UCUGGAGUGACGGUGCUGGAGUUta-3' (SEQ ID NO: 4143)

3'-GUAGACCUCACUGCCACGACCUCAAAU-5' (SEQ ID NO: 6453)

C5-1330 Target:
5'-CATCTGGAGTGACGGTGCTGGAGTTTA-3' (SEQ ID NO: 8763)

5'-CUGGAGUGACGGUGCUGGAGUUUaa-3' (SEQ ID NO: 4144)

3'-UAGACCUCACUGCCACGACCUCAAAUU-5' (SEQ ID NO: 6454)

C5-1331 Target:
5'-ATCTGGAGTGACGGTGCTGGAGTTTAA-3' (SEQ ID NO: 8764)

5'-UGGAGUGACGGUGCUGGAGUUUAat-3' (SEQ ID NO: 4145)

3'-AGACCUCACUGCCACGACCUCAAAUUA-5' (SEQ ID NO: 6455)

C5-1332 Target:
5'-TCTGGAGTGACGGTGCTGGAGTTTAAT-3' (SEQ ID NO: 8765)

5'-GGAGUGACGGUGCUGGAGUUUAAtg-3' (SEQ ID NO: 4146)

3'-GACCUCACUGCCACGACCUCAAAUUAC-5' (SEQ ID NO: 6456)

C5-1333 Target:
5'-CTGGAGTGACGGTGCTGGAGTTTAATG-3' (SEQ ID NO: 8766)

5'-GAGUGACGGUGCUGGAGUUUAAUgt-3' (SEQ ID NO: 4147)

3'-ACCUCACUGCCACGACCUCAAAUUACA-5' (SEQ ID NO: 6457)

C5-1334 Target:
5'-TGGAGTGACGGTGCTGGAGTTTAATGT-3' (SEQ ID NO: 8767)

5'-AGUGACGGUGCUGGAGUUUAAUGtc-3' (SEQ ID NO: 4148)

3'-CCUCACUGCCACGACCUCAAAUUACAG-5' (SEQ ID NO: 6458)

C5-1335 Target:
5'-GGAGTGACGGTGCTGGAGTTTAATGTC-3' (SEQ ID NO: 8768)

5'-GUGACGGUGCUGGAGUUUAAUGUca-3' (SEQ ID NO: 4149)

3'-CUCACUGCCACGACCUCAAAUUACAGU-5' (SEQ ID NO: 6459)

C5-1336 Target:
5'-GAGTGACGGTGCTGGAGTTTAATGTCA-3' (SEQ ID NO: 8769)

5'-UGACGGUGCUGGAGUUUAAUGUCaa-3' (SEQ ID NO: 4150)

3'-UCACUGCCACGACCUCAAAUUACAGUU-5' (SEQ ID NO: 6460)

TABLE 7-continued

Human Anti-C5 DsiRNAs Predicted to have >50% Knockdown Efficacy (Asymmetrics)

C5-1337 Target:
5'-AGTGACGGTGCTGGAGTTTAATGTCAA-3' (SEQ ID NO: 8770)

5'-GACGGUGCUGGAGUUUAAUGUCAaa-3' (SEQ ID NO: 4151)

3'-CACUGCCACGACCUCAAAUUACAGUUU-5' (SEQ ID NO: 6461)

C5-1338 Target:
5'-GTGACGGTGCTGGAGTTTAATGTCAAA-3' (SEQ ID NO: 8771)

5'-ACGGUGCUGGAGUUUAAUGUCAAaa-3' (SEQ ID NO: 4152)

3'-ACUGCCACGACCUCAAAUUACAGUUUU-5' (SEQ ID NO: 6462)

C5-1339 Target:
5'-TGACGGTGCTGGAGTTTAATGTCAAAA-3' (SEQ ID NO: 8772)

5'-CGGUGCUGGAGUUUAAUGUCAAAac-3' (SEQ ID NO: 4153)

3'-CUGCCACGACCUCAAAUUACAGUUUUG-5' (SEQ ID NO: 6463)

C5-1340 Target:
5'-GACGGTGCTGGAGTTTAATGTCAAAAC-3' (SEQ ID NO: 8773)

5'-GGUGCUGGAGUUUAAUGUCAAAAct-3' (SEQ ID NO: 4154)

3'-UGCCACGACCUCAAAUUACAGUUUUGA-5' (SEQ ID NO: 6464)

C5-1341 Target:
5'-ACGGTGCTGGAGTTTAATGTCAAAACT-3' (SEQ ID NO: 8774)

5'-GUGCUGGAGUUUAAUGUCAAAACtg-3' (SEQ ID NO: 4155)

3'-GCCACGACCUCAAAUUACAGUUUUGAC-5' (SEQ ID NO: 6465)

C5-1342 Target:
5'-CGGTGCTGGAGTTTAATGTCAAAACTG-3' (SEQ ID NO: 8775)

5'-UGCUGGAGUUUAAUGUCAAAACUga-3' (SEQ ID NO: 4156)

3'-CCACGACCUCAAAUUACAGUUUUGACU-5' (SEQ ID NO: 6466)

C5-1343 Target:
5'-GGTGCTGGAGTTTAATGTCAAAACTGA-3' (SEQ ID NO: 8776)

5'-GCUGGAGUUUAAUGUCAAAACUGat-3' (SEQ ID NO: 4157)

3'-CACGACCUCAAAUUACAGUUUUGACUA-5' (SEQ ID NO: 6467)

C5-1344 Target:
5'-GTGCTGGAGTTTAATGTCAAAACTGAT-3' (SEQ ID NO: 8777)

5'-CUGGAGUUUAAUGUCAAAACUGAtg-3' (SEQ ID NO: 4158)

3'-ACGACCUCAAAUUACAGUUUUGACUAC-5' (SEQ ID NO: 6468)

C5-1345 Target:
5'-TGCTGGAGTTTAATGTCAAAACTGATG-3' (SEQ ID NO: 8778)

5'-UGGAGUUUAAUGUCAAAACUGAUgc-3' (SEQ ID NO: 4159)

3'-CGACCUCAAAUUACAGUUUUGACUACG-5' (SEQ ID NO: 6469)

C5-1346 Target:
5'-GCTGGAGTTTAATGTCAAAACTGATGC-3' (SEQ ID NO: 8779)

5'-GGAGUUUAAUGUCAAAACUGAUGct-3' (SEQ ID NO: 4160)

3'-GACCUCAAAUUACAGUUUUGACUACGA-5' (SEQ ID NO: 6470)

C5-1347 Target:
5'-CTGGAGTTTAATGTCAAAACTGATGCT-3' (SEQ ID NO: 8780)

5'-GAGUUUAAUGUCAAAACUGAUGCtc-3' (SEQ ID NO: 4161)

3'-ACCUCAAAUUACAGUUUUGACUACGAG-5' (SEQ ID NO: 6471)

TABLE 7-continued

Human Anti-C5 DsiRNAs Predicted to have >50%
Knockdown Efficacy (Asymmetrics)

C5-1348 Target:
5'-TGGAGTTTAATGTCAAAACTGATGCTC-3' (SEQ ID NO: 8781)

5'-A<u>GUUUAAUGUCAAAAC</u>UG<u>AUGCUCcc</u>-3' (SEQ ID NO: 4162)

3'-<u>CCUCAAAUUACAGUUUUGACUACGAGG</u>-5' (SEQ ID NO: 6472)

C5-1349 Target:
5'-GGAGTTTAATGTCAAAACTGATGCTCC-3' (SEQ ID NO: 8782)

5'-G<u>UUUAAUGUCAAAACUGAUGCUCCca</u>-3' (SEQ ID NO: 4163)

3'-<u>CUCAAAUUACAGUUUUGACUACGAGGU</u>-5' (SEQ ID NO: 6473)

C5-1350 Target:
5'-GAGTTTAATGTCAAAACTGATGCTCCA-3' (SEQ ID NO: 8783)

5'-<u>UUUAAUGUCAAAACUGAUGCUCCag</u>-3' (SEQ ID NO: 4164)

3'-<u>UCAAAUUACAGUUUUGACUACGAGGUC</u>-5' (SEQ ID NO: 6474)

C5-1351 Target:
5'-AGTTTAATGTCAAAACTGATGCTCCAG-3' (SEQ ID NO: 8784)

5'-<u>UUAAUGUCAAAACUGAUGCUCCAga</u>-3' (SEQ ID NO: 4165)

3'-<u>CAAAUUACAGUUUUGACUACGAGGUCU</u>-5' (SEQ ID NO: 6475)

C5-1352 Target:
5'-GTTTAATGTCAAAACTGATGCTCCAGA-3' (SEQ ID NO: 8785)

5'-<u>UAAUGUCAAAACUGAUGCUCCAGat</u>-3' (SEQ ID NO: 4166)

3'-<u>AAAUUACAGUUUUGACUACGAGGUCUA</u>-5' (SEQ ID NO: 6476)

C5-1353 Target:
5'-TTTAATGTCAAAACTGATGCTCCAGAT-3' (SEQ ID NO: 8786)

5'-<u>AAUGUCAAAACUGAUGCUCCAGAtc</u>-3' (SEQ ID NO: 4167)

3'-<u>AAUUACAGUUUUGACUACGAGGUCUAG</u>-5' (SEQ ID NO: 6477)

C5-1354 Target:
5'-TTAATGTCAAAACTGATGCTCCAGATC-3' (SEQ ID NO: 8787)

5'-<u>AUGUCAAAACUGAUGCUCCAGAUct</u>-3' (SEQ ID NO: 4168)

3'-<u>AUUACAGUUUUGACUACGAGGUCUAGA</u>-5' (SEQ ID NO: 6478)

C5-1355 Target:
5'-TAATGTCAAAACTGATGCTCCAGATCT-3' (SEQ ID NO: 8788)

5'-<u>UGUCAAAACUGAUGCUCCAGAUCtt</u>-3' (SEQ ID NO: 4169)

3'-<u>UUACAGUUUUGACUACGAGGUCUAGAA</u>-5' (SEQ ID NO: 6479)

C5-1356 Target:
5'-AATGTCAAAACTGATGCTCCAGATCTT-3' (SEQ ID NO: 8789)

5'-G<u>UCAAAACUGAUGCUCCAGAUCUtc</u>-3' (SEQ ID NO: 4170)

3'-<u>UACAGUUUUGACUACGAGGUCUAGAAG</u>-5' (SEQ ID NO: 6480)

C5-1357 Target:
5'-ATGTCAAAACTGATGCTCCAGATCTTC-3' (SEQ ID NO: 8790)

5'-<u>UCAAAACUGAUGCUCCAGAUCUUcc</u>-3' (SEQ ID NO: 4171)

3'-<u>ACAGUUUUGACUACGAGGUCUAGAAGG</u>-5' (SEQ ID NO: 6481)

C5-1358 Target:
5'-TGTCAAAACTGATGCTCCAGATCTTCC-3' (SEQ ID NO: 8791)

5'-C<u>AAAACUGAUGCUCCAGAUCUUCca</u>-3' (SEQ ID NO: 4172)

3'-<u>CAGUUUUGACUACGAGGUCUAGAAGGU</u>-5' (SEQ ID NO: 6482)

TABLE 7-continued

Human Anti-C5 DsiRNAs Predicted to have >50%
Knockdown Efficacy (Asymmetrics)

C5-1359 Target:
5'-GTCAAAACTGATGCTCCAGATCTTCCA-3' (SEQ ID NO: 8792)

5'-<u>AAAACUGAUGCUCCAGAUCUUCCag</u>-3' (SEQ ID NO: 4173)

3'-<u>AGUUUUGACUACGAGGUCUAGAAGGUC</u>-5' (SEQ ID NO: 6483)

C5-1360 Target:
5'-TCAAAACTGATGCTCCAGATCTTCCAG-3' (SEQ ID NO: 8793)

5'-<u>AAACUGAUGCUCCAGAUCUUCCAga</u>-3' (SEQ ID NO: 4174)

3'-<u>GUUUUGACUACGAGGUCUAGAAGGUCU</u>-5' (SEQ ID NO: 6484)

C5-1361 Target:
5'-CAAAACTGATGCTCCAGATCTTCCAGA-3' (SEQ ID NO: 8794)

5'-<u>AACUGAUGCUCCAGAUCUUCCAGaa</u>-3' (SEQ ID NO: 4175)

3'-<u>UUUUGACUACGAGGUCUAGAAGGUCUU</u>-5' (SEQ ID NO: 6485)

C5-1362 Target:
5'-AAAACTGATGCTCCAGATCTTCCAGAA-3' (SEQ ID NO: 8795)

5'-<u>ACUGAUGCUCCAGAUCUUCCAGAag</u>-3' (SEQ ID NO: 4176)

3'-<u>UUUGACUACGAGGUCUAGAAGGUCUUC</u>-5' (SEQ ID NO: 6486)

C5-1363 Target:
5'-AAACTGATGCTCCAGATCTTCCAGAAG-3' (SEQ ID NO: 8796)

5'-<u>CUGAUGCUCCAGAUCUUCCAGAAga</u>-3' (SEQ ID NO: 4177)

3'-<u>UUGACUACGAGGUCUAGAAGGUCUUCU</u>-5' (SEQ ID NO: 6487)

C5-1364 Target:
5'-AACTGATGCTCCAGATCTTCCAGAAGA-3' (SEQ ID NO: 8797)

5'-<u>UGAUGCUCCAGAUCUUCCAGAAGaa</u>-3' (SEQ ID NO: 4178)

3'-<u>UGACUACGAGGUCUAGAAGGUCUUCUU</u>-5' (SEQ ID NO: 6488)

C5-1365 Target:
5'-ACTGATGCTCCAGATCTTCCAGAAGAA-3' (SEQ ID NO: 8798)

5'-G<u>AUGCUCCAGAUCUUCCAGAAGAaa</u>-3' (SEQ ID NO: 4179)

3'-<u>GACUACGAGGUCUAGAAGGUCUUCUUU</u>-5' (SEQ ID NO: 6489)

C5-1366 Target:
5'-CTGATGCTCCAGATCTTCCAGAAGAAA-3' (SEQ ID NO: 8799)

5'-<u>AUGCUCCAGAUCUUCCAGAAGAAaa</u>-3' (SEQ ID NO: 4180)

3'-<u>ACUACGAGGUCUAGAAGGUCUUCUUUU</u>-5' (SEQ ID NO: 6490)

C5-1367 Target:
5'-TGATGCTCCAGATCTTCCAGAAGAAAA-3' (SEQ ID NO: 8800)

5'-G<u>AAAAUCAGGCCAGGGAAGGUUAcc</u>-3' (SEQ ID NO: 4181)

3'-<u>UUCUUUUAGUCCGGUCCCUUCCAAUGG</u>-5' (SEQ ID NO: 6491)

C5-1387 Target:
5'-AAGAAAATCAGGCCAGGGAAGGTTACC-3' (SEQ ID NO: 8801)

5'-<u>AAAAUCAGGCCAGGGAAGGUUACcg</u>-3' (SEQ ID NO: 4182)

3'-<u>UCUUUUAGUCCGGUCCCUUCCAAUGGC</u>-5' (SEQ ID NO: 6492)

C5-1388 Target:
5'-AGAAAATCAGGCCAGGGAAGGTTACCG-3' (SEQ ID NO: 8802)

5'-<u>AAAUCAGGCCAGGGAAGGUUACCga</u>-3' (SEQ ID NO: 4183)

3'-<u>CUUUUAGUCCGGUCCCUUCCAAUGGCU</u>-5' (SEQ ID NO: 6493)

TABLE 7-continued

Human Anti-C5 DsiRNAs Predicted to have >50%
Knockdown Efficacy (Asymmetrics)

C5-1389 Target:
5'-GAAAATCAGGCCAGGGAAGGTTACCGA-3' (SEQ ID NO: 8803)

5'-A<u>AUC</u>AGGCCAGGGA<u>AGG</u>UUACCGag-3' (SEQ ID NO: 4184)

3'-<u>UUU</u>U<u>A</u>GUCCGGUCCC<u>UU</u>CCAAUGG<u>GCUC</u>-5' (SEQ ID NO: 6494)

C5-1390 Target:
5'-AAAATCAGGCCAGGGAAGGTTACCGAG-3' (SEQ ID NO: 8804)

5'-A<u>UC</u>AGGCCAGGGA<u>AGG</u>UUACCGAgc-3' (SEQ ID NO: 4185)

3'-<u>UUU</u>AGUCCGGUCCC<u>UU</u>CCAAUGG<u>CUCG</u>-5' (SEQ ID NO: 6495)

C5-1391 Target:
5'-AAATCAGGCCAGGGAAGGTTACCGAGC-3' (SEQ ID NO: 8805)

5'-<u>UC</u>AGGCCAGGGAAGG<u>UU</u>ACCGAGca-3' (SEQ ID NO: 4186)

3'-<u>UU</u>AGUCCGGUCCCUU<u>CC</u>AAUGGCUCGU-5' (SEQ ID NO: 6496)

C5-1392 Target:
5'-AATCAGGCCAGGGAAGGTTACCGAGCA-3' (SEQ ID NO: 8806)

5'-<u>C</u>AGGCCAGGGAAGG<u>UU</u>ACCGAGCaa-3' (SEQ ID NO: 4187)

3'-<u>UAGU</u>CCGGUCCCUU<u>CC</u>AAUGGCUCGUU-5' (SEQ ID NO: 6497)

C5-1393 Target:
5'-ATCAGGCCAGGGAAGGTTACCGAGCAA-3' (SEQ ID NO: 8807)

5'-A<u>GG</u>CCAGGGAAGG<u>UU</u>ACCGAGCAat-3' (SEQ ID NO: 4188)

3'-<u>AGU</u>CCGGUCCCUU<u>CC</u>AAUGGCUCGUUA-5' (SEQ ID NO: 6498)

C5-1394 Target:
5'-TCAGGCCAGGGAAGGTTACCGAGCAAT-3' (SEQ ID NO: 8808)

5'-<u>GG</u>CCAGGGAAGG<u>UU</u>A<u>CC</u>GAGCAAta-3' (SEQ ID NO: 4189)

3'-<u>GUCC</u>GGUCCCUU<u>CC</u>AAUGGCUCGUUAU-5' (SEQ ID NO: 6499)

C5-1395 Target:
5'-CAGGCCAGGGAAGGTTACCGAGCAATA-3' (SEQ ID NO: 8809)

5'-G<u>CC</u>AGGGAAGGUU<u>ACC</u>GAGCAA<u>U</u>ag-3' (SEQ ID NO: 4190)

3'-<u>UCC</u>GGUCCCUUCC<u>A</u>AUGGCUCGUU<u>AUC</u>-5' (SEQ ID NO: 6500)

C5-1396 Target:
5'-AGGCCAGGGAAGGTTACCGAGCAATAG-3' (SEQ ID NO: 8810)

5'-<u>CC</u>AGGGAAGGUU<u>ACC</u>GAGCAAU<u>A</u>gc-3' (SEQ ID NO: 4191)

3'-<u>CCG</u>GUCCCUUCCA<u>A</u>UGGCUCGUU<u>AUCG</u>-5' (SEQ ID NO: 6501)

C5-1397 Target:
5'-GGCCAGGGAAGGTTACCGAGCAATAGC-3' (SEQ ID NO: 8811)

5'-C<u>AGG</u>GAAGGUU<u>ACC</u>GAGCAAUAG<u>c</u>a-3' (SEQ ID NO: 4192)

3'-<u>CGG</u>U<u>C</u>CCUUCCAAUGG<u>CUC</u>GUUA<u>U</u>CGU-5' (SEQ ID NO: 6502)

C5-1398 Target:
5'-GCCAGGGAAGGTTACCGAGCAATAGCA-3' (SEQ ID NO: 8812)

5'-A<u>GGG</u>AAGGUUACC<u>G</u>AGCAAUAGCat-3' (SEQ ID NO: 4193)

3'-<u>GGU</u>CCCUUCCAAUGG<u>CUC</u>GUUAUCGUA-5' (SEQ ID NO: 6503)

C5-1399 Target:
5'-CCAGGGAAGGTTACCGAGCAATAGCAT-3' (SEQ ID NO: 8813)

5'-<u>GGG</u>AAGGUUACC<u>G</u>A<u>G</u>CAAUAGCAta-3' (SEQ ID NO: 4194)

3'-<u>GUCC</u>CUUCCAAUGGC<u>UC</u>GUUAUC<u>GUAU</u>-5' (SEQ ID NO: 6504)

TABLE 7-continued

Human Anti-C5 DsiRNAs Predicted to have >50%
Knockdown Efficacy (Asymmetrics)

C5-1400 Target:
5'-CAGGGAAGGTTACCGAGCAATAGCATA-3' (SEQ ID NO: 8814)

5'-<u>GGA</u>AGGUUACCGA<u>GC</u>AAUAGCAUac-3' (SEQ ID NO: 4195)

3'-<u>UCCC</u>UUCCAAUGG<u>CUC</u>GUUAUCGU<u>AUG</u>-5' (SEQ ID NO: 6505)

C5-1401 Target:
5'-AGGGAAGGTTACCGAGCAATAGCATAC-3' (SEQ ID NO: 8815)

5'-<u>GA</u>AGGUUACCGAGC<u>AA</u>UAGCAUAct-3' (SEQ ID NO: 4196)

3'-<u>CCC</u>UUCCAAUGGCUC<u>G</u>UUAUCGU<u>AUGA</u>-5' (SEQ ID NO: 6506)

C5-1402 Target:
5'-GGGAAGGTTACCGAGCAATAGCATACT-3' (SEQ ID NO: 8816)

5'-A<u>AGG</u>UUACCGAGC<u>AA</u>UAGCAUACtc-3' (SEQ ID NO: 4197)

3'-<u>CC</u>UUCCAAUGGCUC<u>G</u>UUAUCGU<u>AUGAG</u>-5' (SEQ ID NO: 6507)

C5-1403 Target:
5'-GGAAGGTTACCGAGCAATAGCATACTC-3' (SEQ ID NO: 8817)

5'-<u>AGG</u>UUACCGAGCA<u>AU</u>AGCAUACUca-3' (SEQ ID NO: 4198)

3'-<u>CUU</u>CCAAUGGCUCGUU<u>A</u>UCGU<u>A</u>UGAGU-5' (SEQ ID NO: 6508)

C5-1404 Target:
5'-GAAGGTTACCGAGCAATAGCATACTCA-3' (SEQ ID NO: 8818)

5'-<u>G</u>UU<u>A</u>CCGAGCAAU<u>AG</u>CAUACUCAtc-3' (SEQ ID NO: 4199)

3'-<u>UCC</u>AAUGGCUCGUU<u>AU</u>CGU<u>A</u>UGAGUAG-5' (SEQ ID NO: 6509)

C5-1406 Target:
5'-AGGTTACCGAGCAATAGCATACTCATC-3' (SEQ ID NO: 8819)

5'-<u>UU</u>ACCGAGCAAUA<u>GC</u>AUACUCAUct-3' (SEQ ID NO: 4200)

3'-<u>CC</u>AAUGGCUCGUUAU<u>CG</u>U<u>A</u>UGAGUAGA-5' (SEQ ID NO: 6510)

C5-1407 Target:
5'-GGTTACCGAGCAATAGCATACTCATCT-3' (SEQ ID NO: 8820)

5'-<u>U</u>ACCGAGCAAUAGC<u>A</u>UACUCAUCtc-3' (SEQ ID NO: 4201)

3'-<u>CA</u>AUGGCUCGUUAU<u>C</u>GU<u>A</u>UGAGU<u>A</u>GAG-5' (SEQ ID NO: 6511)

C5-1408 Target:
5'-GTTACCGAGCAATAGCATACTCATCTC-3' (SEQ ID NO: 8821)

5'-<u>A</u>CCGAGCAAUAGC<u>AU</u>ACUCAUCUct-3' (SEQ ID NO: 4202)

3'-<u>AAU</u>GGCUCGUUAUC<u>GU</u>AUGAGU<u>AGA</u>GA-5' (SEQ ID NO: 6512)

C5-1409 Target:
5'-TTACCGAGCAATAGCATACTCATCTCT-3' (SEQ ID NO: 8822)

5'-<u>CC</u>GAGCAAUAGC<u>AU</u>ACUCAUCUCtc-3' (SEQ ID NO: 4203)

3'-<u>AUG</u>GCUCGUUAUCGU<u>A</u>UGAGU<u>AGA</u>GAG-5' (SEQ ID NO: 6513)

C5-1410 Target:
5'-TACCGAGCAATAGCATACTCATCTCTC-3' (SEQ ID NO: 8823)

5'-<u>C</u>GAGCAAUAGCAU<u>AC</u>UCAUCUCUca-3' (SEQ ID NO: 4204)

3'-<u>U</u>GGCUCGUUAUCGU<u>A</u>UGAGU<u>AGA</u>GAGU-5' (SEQ ID NO: 6514)

C5-1411 Target:
5'-ACCGAGCAATAGCATACTCATCTCTCA-3' (SEQ ID NO: 8824)

5'-<u>G</u>AGCAAUAGCAUA<u>CUC</u>AUCUCUCag-3' (SEQ ID NO: 4205)

3'-<u>GG</u>CUCGUUAUCGUA<u>U</u>GAGU<u>AGA</u>GAGUC-5' (SEQ ID NO: 6515)

TABLE 7-continued

Human Anti-C5 DsiRNAs Predicted to have >50% Knockdown Efficacy (Asymmetrics)

C5-1412 Target:
5'-CCGAGCAATAGCATACTCATCTCTCAG-3' (SEQ ID NO: 8825)

5'-AGCAAUAGCAUACUCAUCUCUCAGc-3' (SEQ ID NO: 4206)

3'-GCUCGUUAUCGUAUGAGUAGAGAGUCG-5' (SEQ ID NO: 6516)

C5-1413 Target:
5'-CGAGCAATAGCATACTCATCTCTCAGC-3' (SEQ ID NO: 8826)

5'-GCAAUAGCAUACUCAUCUCUCAGcc-3' (SEQ ID NO: 4207)

3'-CUCGUUAUCGUAUGAGUAGAGAGUCGG-5' (SEQ ID NO: 6517)

C5-1414 Target:
5'-GAGCAATAGCATACTCATCTCTCAGCC-3' (SEQ ID NO: 8827)

5'-CAAUAGCAUACUCAUCUCUCAGCca-3' (SEQ ID NO: 4208)

3'-UCGUUAUCGUAUGAGUAGAGAGUCGGU-5' (SEQ ID NO: 6518)

C5-1415 Target:
5'-AGCAATAGCATACTCATCTCTCAGCCA-3' (SEQ ID NO: 8828)

5'-AAUAGCAUACUCAUCUCUCAGCCaa-3' (SEQ ID NO: 4209)

3'-CGUUAUCGUAUGAGUAGAGAGUCGGUU-5' (SEQ ID NO: 6519)

C5-1416 Target:
5'-GCAATAGCATACTCATCTCTCAGCCAA-3' (SEQ ID NO: 8829)

5'-AUAGCAUACUCAUCUCUCAGCCAaa-3' (SEQ ID NO: 4210)

3'-GUUAUCGUAUGAGUAGAGAGUCGGUUU-5' (SEQ ID NO: 6520)

C5-1417 Target:
5'-CAATAGCATACTCATCTCTCAGCCAAA-3' (SEQ ID NO: 8830)

5'-UAGCAUACUCAUCUCUCAGCCAag-3' (SEQ ID NO: 4211)

3'-UUAUCGUAUGAGUAGAGAGUCGGUUUC-5' (SEQ ID NO: 6521)

C5-1418 Target:
5'-AATAGCATACTCATCTCTCAGCCAAAG-3' (SEQ ID NO: 8831)

5'-AGCAUACUCAUCUCUCAGCCAAAgt-3' (SEQ ID NO: 4212)

3'-UAUCGUAUGAGUAGAGAGUCGGUUUCA-5' (SEQ ID NO: 6522)

C5-1419 Target:
5'-ATAGCATACTCATCTCTCAGCCAAAGT-3' (SEQ ID NO: 8832)

5'-GCAUACUCAUCUCUCAGCCAAAGtt-3' (SEQ ID NO: 4213)

3'-AUCGUAUGAGUAGAGAGUCGGUUUCAA-5' (SEQ ID NO: 6523)

C5-1420 Target:
5'-TAGCATACTCATCTCTCAGCCAAAGTT-3' (SEQ ID NO: 8833)

5'-CAUACUCAUCUCUCAGCCAAAGUta-3' (SEQ ID NO: 4214)

3'-UCGUAUGAGUAGAGAGUCGGUUUCAAU-5' (SEQ ID NO: 6524)

C5-1421 Target:
5'-AGCATACTCATCTCTCAGCCAAAGTTA-3' (SEQ ID NO: 8834)

5'-AUACUCAUCUCUCAGCCAAAGUUac-3' (SEQ ID NO: 4215)

3'-CGUAUGAGUAGAGAGUCGGUUUCAAUG-5' (SEQ ID NO: 6525)

C5-1422 Target:
5'-GCATACTCATCTCTCAGCCAAAGTTAC-3' (SEQ ID NO: 8835)

5'-UACUCAUCUCUCAGCCAAAGUUAcc-3' (SEQ ID NO: 4216)

3'-GUAUGAGUAGAGAGUCGGUUUCAAUGG-5' (SEQ ID NO: 6526)

C5-1423 Target:
5'-CATACTCATCTCTCAGCCAAAGTTACC-3' (SEQ ID NO: 8836)

5'-ACUCAUCUCUCAGCCAAAGUUACct-3' (SEQ ID NO: 4217)

3'-UAUGAGUAGAGAGUCGGUUUCAAUGGA-5' (SEQ ID NO: 6527)

C5-1424 Target:
5'-ATACTCATCTCTCAGCCAAAGTTACCT-3' (SEQ ID NO: 8837)

5'-CUCAUCUCUCAGCCAAAGUUACCtt-3' (SEQ ID NO: 4218)

3'-AUGAGUAGAGAGUCGGUUUCAAUGGAA-5' (SEQ ID NO: 6528)

C5-1425 Target:
5'-TACTCATCTCTCAGCCAAAGTTACCTT-3' (SEQ ID NO: 8838)

5'-UCAUCUCUCAGCCAAAGUUACCUtt-3' (SEQ ID NO: 4219)

3'-UGAGUAGAGAGUCGGUUUCAAUGGAAA-5' (SEQ ID NO: 6529)

C5-1426 Target:
5'-ACTCATCTCTCAGCCAAAGTTACCTTT-3' (SEQ ID NO: 8839)

5'-CAUCUCUCAGCCAAAGUUACCUUta-3' (SEQ ID NO: 4220)

3'-GAGUAGAGAGUCGGUUUCAAUGGAAAU-5' (SEQ ID NO: 6530)

C5-1427 Target:
5'-CTCATCTCTCAGCCAAAGTTACCTTTA-3' (SEQ ID NO: 8840)

5'-AUCUCUCAGCCAAAGUUACCUUUat-3' (SEQ ID NO: 4221)

3'-AGUAGAGAGUCGGUUUCAAUGGAAAUA-5' (SEQ ID NO: 6531)

C5-1428 Target:
5'-TCATCTCTCAGCCAAAGTTACCTTTAT-3' (SEQ ID NO: 8841)

5'-UCUCUCAGCCAAAGUUACCUUUAta-3' (SEQ ID NO: 4222)

3'-GUAGAGAGUCGGUUUCAAUGGAAAUAU-5' (SEQ ID NO: 6532)

C5-1429 Target:
5'-CATCTCTCAGCCAAAGTTACCTTTATA-3' (SEQ ID NO: 8842)

5'-CUCUCAGCCAAAGUUACCUUUAUat-3' (SEQ ID NO: 4223)

3'-UAGAGAGUCGGUUUCAAUGGAAAUAUA-5' (SEQ ID NO: 6533)

C5-1430 Target:
5'-ATCTCTCAGCCAAAGTTACCTTTATAT-3' (SEQ ID NO: 8843)

5'-UCUCAGCCAAAGUUACCUUUAUAtt-3' (SEQ ID NO: 4224)

3'-AGAGAGUCGGUUUCAAUGGAAAUAUAA-5' (SEQ ID NO: 6534)

C5-1431 Target:
5'-TCTCTCAGCCAAAGTTACCTTTATATT-3' (SEQ ID NO: 8844)

5'-CUCAGCCAAAGUUACCUUUAUAUtg-3' (SEQ ID NO: 4225)

3'-GAGAGUCGGUUUCAAUGGAAAUAUAAC-5' (SEQ ID NO: 6535)

C5-1432 Target:
5'-CTCTCAGCCAAAGTTACCTTTATATTG-3' (SEQ ID NO: 8845)

5'-AAGGCUUUGCUAGUGGGAGAACAtc-3' (SEQ ID NO: 4226)

3'-UAUUCCGAAACGAUCACCCUCUUGUAG-5' (SEQ ID NO: 6536)

C5-1474 Target:
5'-ATAAGGCTTTGCTAGTGGGAGAACATC-3' (SEQ ID NO: 8846)

5'-AGGCUUUGCUAGUGGGAGAACAUct-3' (SEQ ID NO: 4227)

3'-AUUCCGAAACGAUCACCCUCUUGUAGA-5' (SEQ ID NO: 6537)

TABLE 7-continued

Human Anti-C5 DsiRNAs Predicted to have >50% Knockdown Efficacy (Asymmetrics)

C5-1475 Target:
5'-TAAGGCTTTGCTAGTGGGAGAACATCT-3' (SEQ ID NO: 8847)

5'-GGCUUUGCUAGUGGGAGAACAUCtg-3' (SEQ ID NO: 4228)

3'-UUCCGAAACGAUCACCCUCUUGUAGAC-5' (SEQ ID NO: 6538)

C5-1476 Target:
5'-AAGGCTTTGCTAGTGGGAGAACATCTG-3' (SEQ ID NO: 8848)

5'-CCAAAAGCCCAUAUAUUGACAAAAat-3' (SEQ ID NO: 4229)

3'-GGGGUUUUCGGGUAUAUAACUGUUUUA-5' (SEQ ID NO: 6539)

C5-1517 Target:
5'-CCCCAAAAGCCCATATATTGACAAAAT-3' (SEQ ID NO: 8849)

5'-CAAAAGCCCAUAUAUUGACAAAAta-3' (SEQ ID NO: 4230)

3'-GGGUUUUCGGGUAUAUAACUGUUUUAU-5' (SEQ ID NO: 6540)

C5-1518 Target:
5'-CCCAAAAGCCCATATATTGACAAAATA-3' (SEQ ID NO: 8850)

5'-AAAGCCCAUAUAUUGACAAAAUAac-3' (SEQ ID NO: 4231)

3'-GUUUUCGGGUAUAUAACUGUUUUAUUG-5' (SEQ ID NO: 6541)

C5-1520 Target:
5'-CAAAAGCCCATATATTGACAAAATAAC-3' (SEQ ID NO: 8851)

5'-AAGCCCAUAUAUUGACAAAAUAAct-3' (SEQ ID NO: 4232)

3'-UUUUCGGGUAUAUAACUGUUUUAUUGA-5' (SEQ ID NO: 6542)

C5-1521 Target:
5'-AAAAGCCCATATATTGACAAAATAACT-3' (SEQ ID NO: 8852)

5'-AGCCCAUAUAUUGACAAAAUAACtc-3' (SEQ ID NO: 4233)

3'-UUUCGGGUAUAUAACUGUUUUAUUGAG-5' (SEQ ID NO: 6543)

C5-1522 Target:
5'-AAAGCCCATATATTGACAAAATAACTC-3' (SEQ ID NO: 8853)

5'-CCAUAUAUUGACAAAAUAACUCAct-3' (SEQ ID NO: 4234)

3'-CGGGUAUAUAACUGUUUUAUUGAGUGA-5' (SEQ ID NO: 6544)

C5-1525 Target:
5'-GCCCATATATTGACAAAATAACTCACT-3' (SEQ ID NO: 8854)

5'-AUAUUGACAAAAUAACUCACUAUaa-3' (SEQ ID NO: 4235)

3'-UAUAUAACUGUUUUAUUGAGUGAUAUU-5' (SEQ ID NO: 6545)

C5-1529 Target:
5'-ATATATTGACAAAATAACTCACTATAA-3' (SEQ ID NO: 8855)

5'-UAUUGACAAAAUAACUCACUAUAat-3' (SEQ ID NO: 4236)

3'-AUAUAACUGUUUUAUUGAGUGAUAUUA-5' (SEQ ID NO: 6546)

C5-1530 Target:
5'-TATATTGACAAAATAACTCACTATAAT-3' (SEQ ID NO: 8856)

5'-UUGACAAAAUAACUCACUAUAAUta-3' (SEQ ID NO: 4237)

3'-AUAACUGUUUUAUUGAGUGAUAUUAAU-5' (SEQ ID NO: 6547)

C5-1532 Target:
5'-TATTGACAAAATAACTCACTATAATTA-3' (SEQ ID NO: 8857)

5'-UACUUGAUUUUAUCCAAGGGCAAaa-3' (SEQ ID NO: 4238)

3'-UAAUGAACUAAAAUAGGUUCCCGUUUU-5' (SEQ ID NO: 6548)

C5-1555 Target:
5'-ATTACTTGATTTTATCCAAGGGCAAAA-3' (SEQ ID NO: 8858)

5'-ACUUGAUUUUAUCCAAGGGCAAAat-3' (SEQ ID NO: 4239)

3'-AAUGAACUAAAAUAGGUUCCCGUUUUA-5' (SEQ ID NO: 6549)

C5-1556 Target:
5'-TTACTTGATTTTATCCAAGGGCAAAAT-3' (SEQ ID NO: 8859)

5'-CUUGAUUUUAUCCAAGGGCAAAAtt-3' (SEQ ID NO: 4240)

3'-AUGAACUAAAAUAGGUUCCCGUUUUAA-5' (SEQ ID NO: 6550)

C5-1557 Target:
5'-TACTTGATTTTATCCAAGGGCAAAATT-3' (SEQ ID NO: 8860)

5'-UUGAUUUUAUCCAAGGGCAAAAUta-3' (SEQ ID NO: 4241)

3'-UGAACUAAAAUAGGUUCCCGUUUUAAU-5' (SEQ ID NO: 6551)

C5-1558 Target:
5'-ACTTGATTTTATCCAAGGGCAAAATTA-3' (SEQ ID NO: 8861)

5'-UGAUUUUAUCCAAGGGCAAAAUUat-3' (SEQ ID NO: 4242)

3'-GAACUAAAAUAGGUUCCCGUUUUAAUA-5' (SEQ ID NO: 6552)

C5-1559 Target:
5'-CTTGATTTTATCCAAGGGCAAAATTAT-3' (SEQ ID NO: 8862)

5'-GAUUUUAUCCAAGGGCAAAAUUAtc-3' (SEQ ID NO: 4243)

3'-AACUAAAAUAGGUUCCCGUUUUAAUAG-5' (SEQ ID NO: 6553)

C5-1560 Target:
5'-TTGATTTTATCCAAGGGCAAAATTATC-3' (SEQ ID NO: 8863)

5'-AUUUUAUCCAAGGGCAAAAUUAUcc-3' (SEQ ID NO: 4244)

3'-ACUAAAAUAGGUUCCCGUUUUAAUAGG-5' (SEQ ID NO: 6554)

C5-1561 Target:
5'-TGATTTTATCCAAGGGCAAAATTATCC-3' (SEQ ID NO: 8864)

5'-UUUUAUCCAAGGGCAAAAUUAUCca-3' (SEQ ID NO: 4245)

3'-CUAAAAUAGGUUCCCGUUUUAAUAGGU-5' (SEQ ID NO: 6555)

C5-1562 Target:
5'-GATTTTATCCAAGGGCAAAATTATCCA-3' (SEQ ID NO: 8865)

5'-UUUAUCCAAGGGCAAAAUUAUCCac-3' (SEQ ID NO: 4246)

3'-UAAAAUAGGUUCCCGUUUUAAUAGGUG-5' (SEQ ID NO: 6556)

C5-1563 Target:
5'-ATTTTATCCAAGGGCAAAATTATCCAC-3' (SEQ ID NO: 8866)

5'-UUAUCCAAGGGCAAAAUUAUCCAct-3' (SEQ ID NO: 4247)

3'-AAAAUAGGUUCCCGUUUUAAUAGGUGA-5' (SEQ ID NO: 6557)

C5-1564 Target:
5'-TTTTATCCAAGGGCAAAATTATCCACT-3' (SEQ ID NO: 8867)

5'-UAUCCAAGGGCAAAAUUAUCCACtt-3' (SEQ ID NO: 4248)

3'-AAAUAGGUUCCCGUUUUAAUAGGUGAA-5' (SEQ ID NO: 6558)

C5-1565 Target:
5'-TTTATCCAAGGGCAAAATTATCCACTT-3' (SEQ ID NO: 8868)

5'-AUCCAAGGGCAAAAUUAUCCACUtt-3' (SEQ ID NO: 4249)

3'-AAUAGGUUCCCGUUUUAAUAGGUGAAA-5' (SEQ ID NO: 6559)

TABLE 7-continued

Human Anti-C5 DsiRNAs Predicted to have >50% Knockdown Efficacy (Asymmetrics)

C5-1566 Target:
5'-TTATCCAAGGGCAAAATTATCCACTTT-3' (SEQ ID NO: 8869)

5'-U<u>CC</u>AAGGGCAAAAU<u>U</u>A<u>U</u>CCACUUtg-3' (SEQ ID NO: 4250)

3'-<u>AUAG</u>GUUCCCGUUUU<u>A</u>AUAGGUG<u>AAAC</u>-5' (SEQ ID NO: 6560)

C5-1567 Target:
5'-TATCCAAGGGCAAAATTATCCACTTTG-3' (SEQ ID NO: 8870)

5'-C<u>CA</u>AGGGCAAAAUU<u>A</u>U<u>CC</u>ACUUUgg-3' (SEQ ID NO: 4251)

3'-<u>UAG</u>GUUCCCGUUUU<u>A</u>AUAGGUGA<u>AACC</u>-5' (SEQ ID NO: 6561)

C5-1568 Target:
5'-ATCCAAGGGCAAAATTATCCACTTTGG-3' (SEQ ID NO: 8871)

5'-C<u>AA</u>GGGCAAAAUU<u>A</u>U<u>CC</u>ACUUUGgc-3' (SEQ ID NO: 4252)

3'-<u>AGG</u>UUCCCGUUUU<u>A</u>AUAGGUGAA<u>ACCG</u>-5' (SEQ ID NO: 6562)

C5-1569 Target:
5'-TCCAAGGGCAAAATTATCCACTTTGGC-3' (SEQ ID NO: 8872)

5'-A<u>AGG</u>GCAAAAUUA<u>U</u>CCACUUUGGca-3' (SEQ ID NO: 4253)

3'-<u>GGU</u>UCCCGUUUUAAUAGGUGAAAC<u>CGU</u>-5' (SEQ ID NO: 6563)

C5-1570 Target:
5'-CCAAGGGCAAAATTATCCACTTTGGCA-3' (SEQ ID NO: 8873)

5'-A<u>GGG</u>CAAAAUUAU<u>CC</u>ACUUUGGCac-3' (SEQ ID NO: 4254)

3'-<u>GUU</u>CCCGUUUUAAUAGGUGAAAC<u>CGUG</u>-5' (SEQ ID NO: 6564)

C5-1571 Target:
5'-CAAGGGCAAAATTATCCACTTTGGCAC-3' (SEQ ID NO: 8874)

5'-G<u>GG</u>CAAAAUUAUCC<u>AC</u>UUUGGCAcg-3' (SEQ ID NO: 4255)

3'-<u>UUCCC</u>GUUUUAAUAGGUGAAACC<u>GUGC</u>-5' (SEQ ID NO: 6565)

C5-1572 Target:
5'-AAGGGCAAAATTATCCACTTTGGCACG-3' (SEQ ID NO: 8875)

5'-G<u>GC</u>AAAAUUAUCC<u>AC</u>UUUGGCACga-3' (SEQ ID NO: 4256)

3'-<u>UCCC</u>GUUUUAAUAGGU<u>GA</u>AACCGU<u>GCU</u>-5' (SEQ ID NO: 6566)

C5-1573 Target:
5'-AGGGCAAAATTATCCACTTTGGCACGA-3' (SEQ ID NO: 8876)

5'-G<u>CA</u>AAAUUAUCC<u>AC</u>UUUGGCACGag-3' (SEQ ID NO: 4257)

3'-<u>CCC</u>GUUUUAAUAGG<u>UG</u>AAACCGU<u>GCUC</u>-5' (SEQ ID NO: 6567)

C5-1574 Target:
5'-GGGCAAAATTATCCACTTTGGCACGAG-3' (SEQ ID NO: 8877)

5'-C<u>AAA</u>AUUAUCCAC<u>UU</u>UGGCACGAgg-3' (SEQ ID NO: 4258)

3'-<u>CCG</u>UUUUAAUAGGUG<u>AAAC</u>CGUG<u>CUCC</u>-5' (SEQ ID NO: 6568)

C5-1575 Target:
5'-GGCAAAATTATCCACTTTGGCACGAGG-3' (SEQ ID NO: 8878)

5'-A<u>AAA</u>UUAUCCAC<u>UU</u>UGGCACGAGg-3' (SEQ ID NO: 4259)

3'-<u>CGU</u>UUUAAUAGGUG<u>AAAC</u>CGUGC<u>UCCC</u>-5' (SEQ ID NO: 6569)

C5-1576 Target:
5'-GCAAAATTATCCACTTTGGCACGAGGG-3' (SEQ ID NO: 8879)

5'-A<u>AAA</u>UUAUCCACUUUGGCACGAGGga-3' (SEQ ID NO: 4260)

3'-<u>GUUUU</u>AAUAGGUG<u>AA</u>ACCGUGCU<u>CCCU</u>-5' (SEQ ID NO: 6570)

TABLE 7-continued

Human Anti-C5 DsiRNAs Predicted to have >50% Knockdown Efficacy (Asymmetrics)

C5-1577 Target:
5'-CAAAATTATCCACTTTGGCACGAGGGA-3' (SEQ ID NO: 8880)

5'-U<u>UU</u>CAGAUGCAUC<u>UU</u>A<u>U</u>CAAAGUat-3' (SEQ ID NO: 4261)

3'-<u>UAAAA</u>GUCUACGUAG<u>A</u>AUAGUUUC<u>AUA</u>-5' (SEQ ID NO: 6571)

C5-1607 Target:
5'-ATTTTCAGATGCATCTTATCAAAGTAT-3' (SEQ ID NO: 8881)

5'-U<u>UC</u>AGAUGCAUCU<u>UA</u>U<u>C</u>AAAGUAta-3' (SEQ ID NO: 4262)

3'-<u>AAAA</u>GUCUACGUAG<u>A</u>AUAGUUUC<u>AUAU</u>-5' (SEQ ID NO: 6572)

C5-1608 Target:
5'-TTTTCAGATGCATCTTATCAAAGTATA-3' (SEQ ID NO: 8882)

5'-U<u>CA</u>GAUGCAUCUU<u>A</u>U<u>C</u>AAAGUAUaa-3' (SEQ ID NO: 4263)

3'-<u>AAAG</u>UCUACGUAGA<u>A</u>UAGUUUC<u>AUAUU</u>-5' (SEQ ID NO: 6573)

C5-1609 Target:
5'-TTTCAGATGCATCTTATCAAAGTATAA-3' (SEQ ID NO: 8883)

5'-C<u>AG</u>AUGCAUCUUA<u>U</u>C<u>A</u>AAGUAUAaa-3' (SEQ ID NO: 4264)

3'-<u>AAG</u>UCUACGUAGAA<u>U</u>AGUUUCAU<u>AUUU</u>-5' (SEQ ID NO: 6574)

C5-1610 Target:
5'-TTCAGATGCATCTTATCAAAGTATAAA-3' (SEQ ID NO: 8884)

5'-A<u>GA</u>UGCAUCUUAU<u>C</u>A<u>A</u>AGUAUAAac-3' (SEQ ID NO: 4265)

3'-<u>AGU</u>CUACGUAGAAU<u>A</u>GUUUCAUAU<u>UUG</u>-5' (SEQ ID NO: 6575)

C5-1611 Target:
5'-TCAGATGCATCTTATCAAAGTATAAAC-3' (SEQ ID NO: 8885)

5'-G<u>AU</u>GCAUCUUAUC<u>A</u>A<u>A</u>GUAUAAAca-3' (SEQ ID NO: 4266)

3'-<u>GUCU</u>ACGUAGAAUA<u>G</u>UUUCAUAUU<u>UGU</u>-5' (SEQ ID NO: 6576)

C5-1612 Target:
5'-CAGATGCATCTTATCAAAGTATAAACA-3' (SEQ ID NO: 8886)

5'-A<u>UG</u>CAUCUUAUCA<u>A</u>A<u>G</u>UAUAAACat-3' (SEQ ID NO: 4267)

3'-<u>UCU</u>ACGUAGAAUAG<u>U</u>UUCAUAUUU<u>GUA</u>-5' (SEQ ID NO: 6577)

C5-1613 Target:
5'-AGATGCATCTTATCAAAGTATAAACAT-3' (SEQ ID NO: 8887)

5'-U<u>GC</u>AUCUUAUCAA<u>A</u>G<u>U</u>AUAAACAtt-3' (SEQ ID NO: 4268)

3'-<u>CUAC</u>GUAGAAUAGUU<u>U</u>CAUAUUUG<u>UAA</u>-5' (SEQ ID NO: 6578)

C5-1614 Target:
5'-GATGCATCTTATCAAAGTATAAACATT-3' (SEQ ID NO: 8888)

5'-G<u>CA</u>UCUUAUCAAA<u>GU</u>AUAAACAUtc-3' (SEQ ID NO: 4269)

3'-<u>UAC</u>GUAGAAUAGUUU<u>C</u>AUAUUUGU<u>AAG</u>-5' (SEQ ID NO: 6579)

C5-1615 Target:
5'-ATGCATCTTATCAAAGTATAAACATTC-3' (SEQ ID NO: 8889)

5'-C<u>AU</u>CUUAUCAAAGU<u>A</u>U<u>A</u>AACAUUcc-3' (SEQ ID NO: 4270)

3'-<u>ACG</u>UAGAAUAGUUUC<u>A</u>UAUUUGU<u>AAGG</u>-5' (SEQ ID NO: 6580)

C5-1616 Target:
5'-TGCATCTTATCAAAGTATAAACATTCC-3' (SEQ ID NO: 8890)

5'-A<u>UC</u>UUAUCAAAGU<u>AUA</u>AACAUUCca-3' (SEQ ID NO: 4271)

3'-<u>CGU</u>AGAAUAGUUUC<u>AU</u>AUUUGUA<u>AGGU</u>-5' (SEQ ID NO: 6581)

TABLE 7-continued

Human Anti-C5 DsiRNAs Predicted to have >50% Knockdown Efficacy (Asymmetrics)

C5-1617 Target:
5'-GCATCTTATCAAAGTATAAACATTCCA-3' (SEQ ID NO: 8891)

5'-UCUUAUCAAAGUAUAAACAUUCCAg-3' (SEQ ID NO: 4272)

3'-GUAGAAUAGUUUCAUAUUUGUAAGGUC-5' (SEQ ID NO: 6582)

C5-1618 Target:
5'-CATCTTATCAAAGTATAAACATTCCAG-3' (SEQ ID NO: 8892)

5'-CUUAUCAAAGUAUAAACAUUCCAgt-3' (SEQ ID NO: 4273)

3'-UAGAAUAGUUUCAUAUUUGUAAGGUCA-5' (SEQ ID NO: 6583)

C5-1619 Target:
5'-ATCTTATCAAAGTATAAACATTCCAGT-3' (SEQ ID NO: 8893)

5'-UUAUCAAAGUAUAAACAUUCCAGta-3' (SEQ ID NO: 4274)

3'-AGAAUAGUUUCAUAUUUGUAAGGUCAU-5' (SEQ ID NO: 6584)

C5-1620 Target:
5'-TCTTATCAAAGTATAAACATTCCAGTA-3' (SEQ ID NO: 8894)

5'-UAUCAAAGUAUAAACAUUCCAGUaa-3' (SEQ ID NO: 4275)

3'-GAAUAGUUUCAUAUUUGUAAGGUCAUU-5' (SEQ ID NO: 6585)

C5-1621 Target:
5'-CTTATCAAAGTATAAACATTCCAGTAA-3' (SEQ ID NO: 8895)

5'-AUCAAAGUAUAAACAUUCCAGUAac-3' (SEQ ID NO: 4276)

3'-AAUAGUUUCAUAUUUGUAAGGUCAUUG-5' (SEQ ID NO: 6586)

C5-1622 Target:
5'-TTATCAAAGTATAAACATTCCAGTAAC-3' (SEQ ID NO: 8896)

5'-UCAAAGUAUAAACAUUCCAGUAAca-3' (SEQ ID NO: 4277)

3'-AUAGUUUCAUAUUUGUAAGGUCAUUGU-5' (SEQ ID NO: 6587)

C5-1623 Target:
5'-TATCAAAGTATAAACATTCCAGTAACA-3' (SEQ ID NO: 8897)

5'-CAAAGUAUAAACAUUCCAGUAACac-3' (SEQ ID NO: 4278)

3'-UAGUUUCAUAUUUGUAAGGUCAUUGUG-5' (SEQ ID NO: 6588)

C5-1624 Target:
5'-ATCAAAGTATAAACATTCCAGTAACAC-3' (SEQ ID NO: 8898)

5'-CAGAACAUGGUUCCUUCAUCCCGac-3' (SEQ ID NO: 4279)

3'-GUGUCUUGUACCAAGGAAGUAGGGCUG-5' (SEQ ID NO: 6589)

C5-1648 Target:
5'-CACAGAACATGGTTCCTTCATCCCGAC-3' (SEQ ID NO: 8899)

5'-AGAACAUGGUUCCUUCAUCCCGAct-3' (SEQ ID NO: 4280)

3'-UGUCUUGUACCAAGGAAGUAGGGCUGA-5' (SEQ ID NO: 6590)

C5-1649 Target:
5'-ACAGAACATGGTTCCTTCATCCCGACT-3' (SEQ ID NO: 8900)

5'-GAACAUGGUUCCUUCAUCCCGACtt-3' (SEQ ID NO: 4281)

3'-GUCUUGUACCAAGGAAGUAGGGCUGAA-5' (SEQ ID NO: 6591)

C5-1650 Target:
5'-CAGAACATGGTTCCTTCATCCCGACTT-3' (SEQ ID NO: 8901)

5'-AACAUGGUUCCUUCAUCCCGACUtc-3' (SEQ ID NO: 4282)

3'-UCUUGUACCAAGGAAGUAGGGCUGAAG-5' (SEQ ID NO: 6592)

C5-1651 Target:
5'-AGAACATGGTTCCTTCATCCCGACTTC-3' (SEQ ID NO: 8902)

5'-ACAUGGUUCCUUCAUCCCGACUUct-3' (SEQ ID NO: 4283)

3'-CUUGUACCAAGGAAGUAGGGCUGAAGA-5' (SEQ ID NO: 6593)

C5-1652 Target:
5'-GAACATGGTTCCTTCATCCCGACTTCT-3' (SEQ ID NO: 8903)

5'-CAUGGUUCCUUCAUCCCGACUUCtg-3' (SEQ ID NO: 4284)

3'-UUGUACCAAGGAAGUAGGGCUGAAGAC-5' (SEQ ID NO: 6594)

C5-1653 Target:
5'-AACATGGTTCCTTCATCCCGACTTCTG-3' (SEQ ID NO: 8904)

5'-AUGGUUCCUUCAUCCCGACUUCUgg-3' (SEQ ID NO: 4285)

3'-UGUACCAAGGAAGUAGGGCUGAAGACC-5' (SEQ ID NO: 6595)

C5-1654 Target:
5'-ACATGGTTCCTTCATCCCGACTTCTGG-3' (SEQ ID NO: 8905)

5'-UGGUUCCUUCAUCCCGACUUCUGgt-3' (SEQ ID NO: 4286)

3'-GUACCAAGGAAGUAGGGCUGAAGACCA-5' (SEQ ID NO: 6596)

C5-1655 Target:
5'-CATGGTTCCTTCATCCCGACTTCTGGT-3' (SEQ ID NO: 8906)

5'-CUGGUCUAUUACAUCGUCACAGGAg-3' (SEQ ID NO: 4287)

3'-AAGACCAGAUAAUGUAGCAGUGUCCUC-5' (SEQ ID NO: 6597)

C5-1675 Target:
5'-TTCTGGTCTATTACATCGTCACAGGAG-3' (SEQ ID NO: 8907)

5'-UGGUCUAUUACAUCGUCACAGGAga-3' (SEQ ID NO: 4288)

3'-AGACCAGAUAAUGUAGCAGUGUCCUCU-5' (SEQ ID NO: 6598)

C5-1676 Target:
5'-TCTGGTCTATTACATCGTCACAGGAGA-3' (SEQ ID NO: 8908)

5'-GGUCUAUUACAUCGUCACAGGAGaa-3' (SEQ ID NO: 4289)

3'-GACCAGAUAAUGUAGCAGUGUCCUCUU-5' (SEQ ID NO: 6599)

C5-1677 Target:
5'-CTGGTCTATTACATCGTCACAGGAGAA-3' (SEQ ID NO: 8909)

5'-GUCUAUUACAUCGUCACAGGAGAac-3' (SEQ ID NO: 4290)

3'-ACCAGAUAAUGUAGCAGUGUCCUCUUG-5' (SEQ ID NO: 6600)

C5-1678 Target:
5'-TGGTCTATTACATCGTCACAGGAGAAC-3' (SEQ ID NO: 8910)

5'-UCUAUUACAUCGUCACAGGAGAAca-3' (SEQ ID NO: 4291)

3'-CCAGAUAAUGUAGCAGUGUCCUCUUGU-5' (SEQ ID NO: 6601)

C5-1679 Target:
5'-GGTCTATTACATCGTCACAGGAGAACA-3' (SEQ ID NO: 8911)

5'-CUAUUACAUCGUCACAGGAGAACag-3' (SEQ ID NO: 4292)

3'-CAGAUAAUGUAGCAGUGUCCUCUUGUC-5' (SEQ ID NO: 6602)

C5-1680 Target:
5'-GTCTATTACATCGTCACAGGAGAACAG-3' (SEQ ID NO: 8912)

5'-UAUUACAUCGUCACAGGAGAACAga-3' (SEQ ID NO: 4293)

3'-AGAUAAUGUAGCAGUGUCCUCUUGUCU-5' (SEQ ID NO: 6603)

TABLE 7-continued

Human Anti-C5 DsiRNAs Predicted to have >50% Knockdown Efficacy (Asymmetrics)

C5-1681 Target:
5'-TCTATTACATCGTCACAGGAGAACAGA-3' (SEQ ID NO: 8913)

5'-AUUACAUCGUCACAGGAGAACAGac-3' (SEQ ID NO: 4294)

3'-GAUAAUGUAGCAGUGUCCUCUUGUCUG-5' (SEQ ID NO: 6604)

C5-1682 Target:
5'-CTATTACATCGTCACAGGAGAACAGAC-3' (SEQ ID NO: 8914)

5'-CAGACAGCAGAAUUAGUGUCUGAtt-3' (SEQ ID NO: 4295)

3'-UUGUCUGUCGUCUUAAUCACAGACUAA-5' (SEQ ID NO: 6605)

C5-1702 Target:
5'-AACAGACAGCAGAATTAGTGTCTGATT-3' (SEQ ID NO: 8915)

5'-AGACAGCAGAAUUAGUGUCUGAUtc-3' (SEQ ID NO: 4296)

3'-UGUCUGUCGUCUUAAUCACAGACUAAG-5' (SEQ ID NO: 6606)

C5-1703 Target:
5'-ACAGACAGCAGAATTAGTGTCTGATTC-3' (SEQ ID NO: 8916)

5'-GACAGCAGAAUUAGUGUCUGAUUca-3' (SEQ ID NO: 4297)

3'-GUCUGUCGUCUUAAUCACAGACUAAGU-5' (SEQ ID NO: 6607)

C5-1704 Target:
5'-CAGACAGCAGAATTAGTGTCTGATTCA-3' (SEQ ID NO: 8917)

5'-ACAGCAGAAUUAGUGUCUGAUUCag-3' (SEQ ID NO: 4298)

3'-UCUGUCGUCUUAAUCACAGACUAAGUC-5' (SEQ ID NO: 6608)

C5-1705 Target:
5'-AGACAGCAGAATTAGTGTCTGATTCAG-3' (SEQ ID NO: 8918)

5'-CAGCAGAAUUAGUGUCUGAUUCAgt-3' (SEQ ID NO: 4299)

3'-CUGUCGUCUUAAUCACAGACUAAGUCA-5' (SEQ ID NO: 6609)

C5-1706 Target:
5'-GACAGCAGAATTAGTGTCTGATTCAGT-3' (SEQ ID NO: 8919)

5'-AGCAGAAUUAGUGUCUGAUUCAGtc-3' (SEQ ID NO: 4300)

3'-UGUCGUCUUAAUCACAGACUAAGUCAG-5' (SEQ ID NO: 6610)

C5-1707 Target:
5'-ACAGCAGAATTAGTGTCTGATTCAGTC-3' (SEQ ID NO: 8920)

5'-GCAGAAUUAGUGUCUGAUUCAGUct-3' (SEQ ID NO: 4301)

3'-GUCGUCUUAAUCACAGACUAAGUCAGA-5' (SEQ ID NO: 6611)

C5-1708 Target:
5'-CAGCAGAATTAGTGTCTGATTCAGTCT-3' (SEQ ID NO: 8921)

5'-CAGAAUUAGUGUCUGAUUCAGUCtg-3' (SEQ ID NO: 4302)

3'-UCGUCUUAAUCACAGACUAAGUCAGAC-5' (SEQ ID NO: 6612)

C5-1709 Target:
5'-AGCAGAATTAGTGTCTGATTCAGTCTG-3' (SEQ ID NO: 8922)

5'-AGAAUUAGUGUCUGAUUCAGUCUgg-3' (SEQ ID NO: 4303)

3'-CGUCUUAAUCACAGACUAAGUCAGACC-5' (SEQ ID NO: 6613)

C5-1710 Target:
5'-GCAGAATTAGTGTCTGATTCAGTCTGG-3' (SEQ ID NO: 8923)

5'-GAAUUAGUGUCUGAUUCAGUCUGgt-3' (SEQ ID NO: 4304)

3'-GUCUUAAUCACAGACUAAGUCAGACCA-5' (SEQ ID NO: 6614)

TABLE 7-continued

Human Anti-C5 DsiRNAs Predicted to have >50% Knockdown Efficacy (Asymmetrics)

C5-1711 Target:
5'-CAGAATTAGTGTCTGATTCAGTCTGGT-3' (SEQ ID NO: 8924)

5'-AAUUAGUGUCUGAUUCAGUCUGGtt-3' (SEQ ID NO: 4305)

3'-UCUUAAUCACAGACUAAGUCAGACCAA-5' (SEQ ID NO: 6615)

C5-1712 Target:
5'-AGAATTAGTGTCTGATTCAGTCTGGTT-3' (SEQ ID NO: 8925)

5'-AUUAGUGUCUGAUUCAGUCUGGUta-3' (SEQ ID NO: 4306)

3'-CUUAAUCACAGACUAAGUCAGACCAAU-5' (SEQ ID NO: 6616)

C5-1713 Target:
5'-GAATTAGTGTCTGATTCAGTCTGGTTA-3' (SEQ ID NO: 8926)

5'-UUAGUGUCUGAUUCAGUCUGGUUaa-3' (SEQ ID NO: 4307)

3'-UUAAUCACAGACUAAGUCAGACCAAUU-5' (SEQ ID NO: 6617)

C5-1714 Target:
5'-AATTAGTGTCTGATTCAGTCTGGTTAA-3' (SEQ ID NO: 8927)

5'-UAGUGUCUGAUUCAGUCUGGUUAaa-3' (SEQ ID NO: 4308)

3'-UAAUCACAGACUAAGUCAGACCAAUUU-5' (SEQ ID NO: 6618)

C5-1715 Target:
5'-ATTAGTGTCTGATTCAGTCTGGTTAAA-3' (SEQ ID NO: 8928)

5'-AGUGUCUGAUUCAGUCUGGUUAAat-3' (SEQ ID NO: 4309)

3'-AAUCACAGACUAAGUCAGACCAAUUUA-5' (SEQ ID NO: 6619)

C5-1716 Target:
5'-TTAGTGTCTGATTCAGTCTGGTTAAAT-3' (SEQ ID NO: 8929)

5'-GUGUCUGAUUCAGUCUGGUUAAAta-3' (SEQ ID NO: 4310)

3'-AUCACAGACUAAGUCAGACCAAUUUAU-5' (SEQ ID NO: 6620)

C5-1717 Target:
5'-TAGTGTCTGATTCAGTCTGGTTAAATA-3' (SEQ ID NO: 8930)

5'-UGUCUGAUUCAGUCUGGUUAAAUat-3' (SEQ ID NO: 4311)

3'-UCACAGACUAAGUCAGACCAAUUUAUA-5' (SEQ ID NO: 6621)

C5-1718 Target:
5'-AGTGTCTGATTCAGTCTGGTTAAATAT-3' (SEQ ID NO: 8931)

5'-UCUGAUUCAGUCUGGUUAAAUAUtg-3' (SEQ ID NO: 4312)

3'-ACAGACUAAGUCAGACCAAUUUAUAAC-5' (SEQ ID NO: 6622)

C5-1720 Target:
5'-TGTCTGATTCAGTCTGGTTAAATATTG-3' (SEQ ID NO: 8932)

5'-UUCAGUCUGGUUAAAUAUUGAAgaa-3' (SEQ ID NO: 4313)

3'-CUAAGUCAGACCAAUUUAUAACUUCUU-5' (SEQ ID NO: 6623)

C5-1725 Target:
5'-GATTCAGTCTGGTTAAATATTGAAGAA-3' (SEQ ID NO: 8933)

5'-GUUAAAUAUUGAAGAAAAUGUGgc-3' (SEQ ID NO: 4314)

3'-ACCAAUUUAUAACUUCUUUUUACACCG-5' (SEQ ID NO: 6624)

C5-1734 Target:
5'-TGGTTAAATATTGAAGAAAAATGTGGC-3' (SEQ ID NO: 8934)

5'-UUAAAUAUUGAAGAAAAAUGUGGca-3' (SEQ ID NO: 4315)

3'-CCAAUUUAUAACUUCUUUUUACACCGU-5' (SEQ ID NO: 6625)

TABLE 7-continued

Human Anti-C5 DsiRNAs Predicted to have >50% Knockdown Efficacy (Asymmetrics)

C5-1735 Target:
5'-GGTTAAATATTGAAGAAAAATGTGGCA-3' (SEQ ID NO: 8935)

5'-U<u>AA</u>AUAUUGAAGA<u>AAAA</u>UGUGGCaa-3' (SEQ ID NO: 4316)

3'-<u>CAA</u>UUUAUAACUUC<u>UUUUU</u>ACAC<u>C</u>GUU-5' (SEQ ID NO: 6626)

C5-1736 Target:
5'-GTTAAATATTGAAGAAAAATGTGGCAA-3' (SEQ ID NO: 8936)

5'-A<u>AA</u>UAUUGAAGA<u>AAAA</u>UGUGGCAac-3' (SEQ ID NO: 4317)

3'-<u>AA</u>UUUAUAACUUC<u>UUUUU</u>ACACC<u>G</u>UUG-5' (SEQ ID NO: 6627)

C5-1737 Target:
5'-TTAAATATTGAAGAAAAATGTGGCAAC-3' (SEQ ID NO: 8937)

5'-A<u>AU</u>AUUGAAGAAA<u>AA</u>UGUGGCAAcc-3' (SEQ ID NO: 4318)

3'-<u>AU</u>UUAUAACUUC<u>UUUUU</u>ACACCGUUGG-5' (SEQ ID NO: 6628)

C5-1738 Target:
5'-TAAATATTGAAGAAAAATGTGGCAACC-3' (SEQ ID NO: 8938)

5'-<u>A</u>UAUUGAAGAAAA<u>A</u>UGUGGCAACca-3' (SEQ ID NO: 4319)

3'-<u>U</u>UUUAUAACUUC<u>UUUUU</u>A<u>C</u>ACCGUUGGU-5' (SEQ ID NO: 6629)

C5-1739 Target:
5'-AAATATTGAAGAAAAATGTGGCAACCA-3' (SEQ ID NO: 8939)

5'-U<u>AU</u>UGAAGAAAAA<u>U</u>GUGGCAACCag-3' (SEQ ID NO: 4320)

3'-<u>UU</u>AUAACUUCUUUUU<u>A</u>CACCGUUGGUC-5' (SEQ ID NO: 6630)

C5-1740 Target:
5'-AATATTGAAGAAAAATGTGGCAACCAG-3' (SEQ ID NO: 8940)

5'-<u>AUU</u>GAAGAAAAAU<u>G</u>UGGCAACCAgc-3' (SEQ ID NO: 4321)

3'-<u>UAU</u>AACUUCUUUUUA<u>C</u>ACCGUUGG<u>U</u>CG-5' (SEQ ID NO: 6631)

C5-1741 Target:
5'-ATATTGAAGAAAAATGTGGCAACCAGC-3' (SEQ ID NO: 8941)

5'-<u>UU</u>GAAGAAAAAUG<u>U</u>GGCAACCAGct-3' (SEQ ID NO: 4322)

3'-<u>AUA</u>ACUUCUUUUUA<u>C</u>ACCGUUGG<u>U</u>CGA-5' (SEQ ID NO: 6632)

C5-1742 Target:
5'-TATTGAAGAAAAATGTGGCAACCAGCT-3' (SEQ ID NO: 8942)

5'-U<u>G</u>AAGAAAAAUGU<u>GG</u>CAACCAGCtc-3' (SEQ ID NO: 4323)

3'-<u>UAA</u>CUUCUUUUUA<u>C</u>ACCGUUGGUC<u>GAG</u>-5' (SEQ ID NO: 6633)

C5-1743 Target:
5'-ATTGAAGAAAAATGTGGCAACCAGCTC-3' (SEQ ID NO: 8943)

5'-G<u>AA</u>GAAAAAUGUGG<u>C</u>AACCAGCUcc-3' (SEQ ID NO: 4324)

3'-<u>AA</u>CUUCUUUUUAC<u>A</u>CCGUUGGUC<u>GAGG</u>-5' (SEQ ID NO: 6634)

C5-1744 Target:
5'-TTGAAGAAAAATGTGGCAACCAGCTCC-3' (SEQ ID NO: 8944)

5'-A<u>AG</u>AAAAAUGUGGC<u>AA</u>CCAGCUCca-3' (SEQ ID NO: 4325)

3'-<u>A</u>CUUCUUUUUACAC<u>C</u>GUUGGUCGAGGU-5' (SEQ ID NO: 6635)

C5-1745 Target:
5'-TGAAGAAAAATGTGGCAACCAGCTCCA-3' (SEQ ID NO: 8945)

5'-AG<u>A</u>AAAAUGUGGC<u>AA</u>CCAGCUCCag-3' (SEQ ID NO: 4326)

3'-CUUCU<u>U</u>UUUACACC<u>G</u>UUGGUCGAGG<u>U</u>C-5' (SEQ ID NO: 6636)

C5-1746 Target:
5'-GAAGAAAAATGTGGCAACCAGCTCCAG-3' (SEQ ID NO: 8946)

5'-G<u>A</u>AAAAUGUGGCA<u>AC</u>CAGCUCCAgg-3' (SEQ ID NO: 4327)

3'-<u>UUC</u>UUUUUACACCGUU<u>G</u>GUCGAGG<u>U</u>CC-5' (SEQ ID NO: 6637)

C5-1747 Target:
5'-AAGAAAAATGTGGCAACCAGCTCCAGG-3' (SEQ ID NO: 8947)

5'-A<u>AAAA</u>UGUGGCAAC<u>C</u>AGCUCCAGgt-3' (SEQ ID NO: 4328)

3'-<u>UC</u>UUUUUACACCGUUGGUCGAGG<u>U</u>CCA-5' (SEQ ID NO: 6638)

C5-1748 Target:
5'-AGAAAAATGTGGCAACCAGCTCCAGGT-3' (SEQ ID NO: 8948)

5'-<u>AAA</u>AUGUGGCAACC<u>AG</u>CUCCAGGtt-3' (SEQ ID NO: 4329)

3'-<u>C</u>UUUUUACACCGUUGGUCGAGGU<u>CCAA</u>-5' (SEQ ID NO: 6639)

C5-1749 Target:
5'-GAAAAATGTGGCAACCAGCTCCAGGTT-3' (SEQ ID NO: 8949)

5'-<u>AAA</u>UGUGGCAACC<u>AG</u>C<u>U</u>CCAGGUtc-3' (SEQ ID NO: 4330)

3'-<u>UUUUU</u>ACACCGUUGG<u>U</u>C<u>G</u>AGGUCC<u>AAG</u>-5' (SEQ ID NO: 6640)

C5-1750 Target:
5'-AAAAATGTGGCAACCAGCTCCAGGTTC-3' (SEQ ID NO: 8950)

5'-<u>AA</u>UGUGGCAACC<u>AG</u>CUCCAGGUUca-3' (SEQ ID NO: 4331)

3'-<u>UUUU</u>ACACCGUUGG<u>U</u>C<u>G</u>AGGUCC<u>AAGU</u>-5' (SEQ ID NO: 6641)

C5-1751 Target:
5'-AAAATGTGGCAACCAGCTCCAGGTTCA-3' (SEQ ID NO: 8951)

5'-<u>A</u>UGUGGCAACCAGCU<u>C</u>CAGGUUCat-3' (SEQ ID NO: 4332)

3'-<u>UUU</u>ACACCGUUGGUC<u>G</u>AGGUCC<u>A</u>AGUA-5' (SEQ ID NO: 6642)

C5-1752 Target:
5'-AAATGTGGCAACCAGCTCCAGGTTCAT-3' (SEQ ID NO: 8952)

5'-UGG<u>C</u>AACCAGCUCC<u>A</u>GGUUCAUCtg-3' (SEQ ID NO: 4333)

3'-<u>A</u>CACCGUUGGUCGAGG<u>U</u>CCAAGUAGAC-5' (SEQ ID NO: 6643)

C5-1755 Target:
5'-TGTGGCAACCAGCTCCAGGTTCATCTG-3' (SEQ ID NO: 8953)

5'-GG<u>C</u>AACCAGCUCC<u>AG</u>GUUCAUCUgt-3' (SEQ ID NO: 4334)

3'-<u>C</u>ACCGUUGGUCGAG<u>G</u>U<u>C</u>CAAGUAG<u>ACA</u>-5' (SEQ ID NO: 6644)

C5-1756 Target:
5'-GTGGCAACCAGCTCCAGGTTCATCTGT-3' (SEQ ID NO: 8954)

5'-G<u>CA</u>ACCAGCUCCA<u>GG</u>UUCAUCUGtc-3' (SEQ ID NO: 4335)

3'-<u>ACC</u>GUUGGUCGAGGU<u>CC</u>AAGUAGACAG-5' (SEQ ID NO: 6645)

C5-1757 Target:
5'-TGGCAACCAGCTCCAGGTTCATCTGTC-3' (SEQ ID NO: 8955)

5'-C<u>AA</u>CCAGCUCCAGG<u>UU</u>CAUCUGUct-3' (SEQ ID NO: 4336)

3'-<u>CC</u>GUUGGUCGAGGU<u>CC</u>AAGUAGACAGA-5' (SEQ ID NO: 6646)

C5-1758 Target:
5'-GGCAACCAGCTCCAGGTTCATCTGTCT-3' (SEQ ID NO: 8956)

5'-<u>AA</u>CCAGCUCCAGG<u>UU</u>CAUCUGUCtc-3' (SEQ ID NO: 4337)

3'-<u>C</u>GUUGGUCGAGGU<u>CC</u>AAGUAGAC<u>AGAG</u>-5' (SEQ ID NO: 6647)

TABLE 7-continued

Human Anti-C5 DsiRNAs Predicted to have >50%
Knockdown Efficacy (Asymmetrics)

C5-1759 Target:
5'-GCAACCAGCTCCAGGTTCATCTGTCTC-3' (SEQ ID NO: 8957)

5'-A<u>CC</u>AGCUCCAGGUU<u>C</u>A<u>U</u>CUGUCUCcc-3' (SEQ ID NO: 4338)

3'-<u>GUUGG</u>UCGAGGUCC<u>AAG</u>UAGACA<u>G</u>AGG-5' (SEQ ID NO: 6648)

C5-1760 Target:
5'-CAACCAGCTCCAGGTTCATCTGTCTCC-3' (SEQ ID NO: 8958)

5'-<u>CC</u>AGCUCCAGGUU<u>C</u>A<u>U</u>CUGUCUCct-3' (SEQ ID NO: 4339)

3'-<u>UUGG</u>UCGAGGUCC<u>AAG</u>UAGACAG<u>A</u>GGA-5' (SEQ ID NO: 6649)

C5-1761 Target:
5'-AACCAGCTCCAGGTTCATCTGTCTCCT-3' (SEQ ID NO: 8959)

5'-C<u>AG</u>CUCCAGGUUC<u>AU</u>CUGUCUCCtg-3' (SEQ ID NO: 4340)

3'-<u>UGGU</u>CGAGGUCCAA<u>G</u>UAGACAGAGGAC-5' (SEQ ID NO: 6650)

C5-1762 Target:
5'-ACCAGCTCCAGGTTCATCTGTCTCCTG-3' (SEQ ID NO: 8960)

5'-A<u>GC</u>UCCAGGUUC<u>AU</u>CUGUCUCCga-3' (SEQ ID NO: 4341)

3'-<u>GGUC</u>GAGGUCCAAGUAGACAGAGGACU-5' (SEQ ID NO: 6651)

C5-1763 Target:
5'-CCAGCTCCAGGTTCATCTGTCTCCTGA-3' (SEQ ID NO: 8961)

5'-<u>GC</u>U<u>CC</u>AGGUUC<u>AU</u>CUGUCUCCUGat-3' (SEQ ID NO: 4342)

3'-<u>GUC</u>GAGGUCCAAGU<u>AG</u>ACAGAGG<u>A</u>CUA-5' (SEQ ID NO: 6652)

C5-1764 Target:
5'-CAGCTCCAGGTTCATCTGTCTCCTGAT-3' (SEQ ID NO: 8962)

5'-C<u>U</u>CCAGGUUCAUC<u>U</u>G<u>U</u>CUCCUGAtg-3' (SEQ ID NO: 4343)

3'-<u>UCGA</u>GGUCCAAGUAG<u>A</u>CAGAGG<u>A</u>CUAC-5' (SEQ ID NO: 6653)

C5-1765 Target:
5'-AGCTCCAGGTTCATCTGTCTCCTGATG-3' (SEQ ID NO: 8963)

5'-U<u>CC</u>AGGUUC<u>AU</u>CUG<u>U</u>CUCCUGAUgc-3' (SEQ ID NO: 4344)

3'-<u>CGA</u>GGUCCAAGUAG<u>A</u>CAGAGG<u>A</u>CUACG-5' (SEQ ID NO: 6654)

C5-1766 Target:
5'-GCTCCAGGTTCATCTGTCTCCTGATGC-3' (SEQ ID NO: 8964)

5'-<u>CC</u>AGGUUC<u>AU</u>CUGU<u>C</u>U<u>C</u>CUGAUGca-3' (SEQ ID NO: 4345)

3'-<u>GAGG</u>UCCAAGUAGA<u>C</u>AGAGGACU<u>A</u>CGU-5' (SEQ ID NO: 6655)

C5-1767 Target:
5'-CTCCAGGTTCATCTGTCTCCTGATGCA-3' (SEQ ID NO: 8965)

5'-C<u>AGG</u>UUCAUCUGU<u>C</u>U<u>CC</u>UGAUGCag-3' (SEQ ID NO: 4346)

3'-<u>AGGU</u>CCAAGUAGACAGAGGACU<u>A</u>CGUC-5' (SEQ ID NO: 6656)

C5-1768 Target:
5'-TCCAGGTTCATCTGTCTCCTGATGCAG-3' (SEQ ID NO: 8966)

5'-<u>AG</u>GUUCAUCUGUC<u>U</u>CCUGAUGCAga-3' (SEQ ID NO: 4347)

3'-<u>GGUC</u>CAAGUAGACAGAGGACUACGUCU-5' (SEQ ID NO: 6657)

C5-1769 Target:
5'-CCAGGTTCATCTGTCTCCTGATGCAGA-3' (SEQ ID NO: 8967)

5'-<u>GG</u>UUCAUCUGUC<u>UCC</u>UGAUGCAGat-3' (SEQ ID NO: 4348)

3'-<u>GUCC</u>AAGUAGACAGA<u>G</u>GACUACGUCUA-5' (SEQ ID NO: 6658)

TABLE 7-continued

Human Anti-C5 DsiRNAs Predicted to have >50%
Knockdown Efficacy (Asymmetrics)

C5-1770 Target:
5'-CAGGTTCATCTGTCTCCTGATGCAGAT-3' (SEQ ID NO: 8968)

5'-<u>G</u>UU<u>C</u>AUCUGUCUC<u>C</u>UGAUGCAGAtg-3' (SEQ ID NO: 4349)

3'-<u>UCC</u>AAGUAGACAGAGG<u>A</u>CUACGU<u>C</u>UAC-5' (SEQ ID NO: 6659)

C5-1771 Target:
5'-AGGTTCATCTGTCTCCTGATGCAGATG-3' (SEQ ID NO: 8969)

5'-<u>U</u>UC<u>A</u>UCUGUCUCC<u>U</u>GAUGCAGAUgc-3' (SEQ ID NO: 4350)

3'-<u>CC</u>AAGUAGACAGAGG<u>A</u>CUACGUC<u>U</u>ACG-5' (SEQ ID NO: 6660)

C5-1772 Target:
5'-GGTTCATCTGTCTCCTGATGCAGATGC-3' (SEQ ID NO: 8970)

5'-U<u>C</u>A<u>U</u>CUGUCUCCUG<u>AU</u>GCAGAUGca-3' (SEQ ID NO: 4351)

3'-<u>C</u>AAGUAGACAGAGG<u>A</u>CUACGUCU<u>A</u>CGU-5' (SEQ ID NO: 6661)

C5-1773 Target:
5'-GTTCATCTGTCTCCTGATGCAGATGCA-3' (SEQ ID NO: 8971)

5'-C<u>AU</u>CUGUCUCCUG<u>AU</u>GCAGAUGCat-3' (SEQ ID NO: 4352)

3'-<u>AAG</u>UAGACAGAGGACU<u>A</u>CGUCU<u>A</u>CGUA-5' (SEQ ID NO: 6662)

C5-1774 Target:
5'-TTCATCTGTCTCCTGATGCAGATGCAT-3' (SEQ ID NO: 8972)

5'-<u>AU</u>CUGUCUCCUG<u>AU</u>GCAGAUGCAta-3' (SEQ ID NO: 4353)

3'-<u>AG</u>UAGACAGAGGACU<u>A</u>CGUCUACG<u>U</u>AU-5' (SEQ ID NO: 6663)

C5-1775 Target:
5'-TCATCTGTCTCCTGATGCAGATGCATA-3' (SEQ ID NO: 8973)

5'-<u>U</u>CUGUCUCCUGAU<u>G</u>C<u>A</u>GAUGCAUat-3' (SEQ ID NO: 4354)

3'-<u>GUAG</u>ACAGAGGACU<u>A</u>CGUCUACG<u>U</u>AUA-5' (SEQ ID NO: 6664)

C5-1776 Target:
5'-CATCTGTCTCCTGATGCAGATGCATAT-3' (SEQ ID NO: 8974)

5'-<u>A</u>UGGAUUCCUGGGUGG<u>C</u>AUUAGCag-3' (SEQ ID NO: 4355)

3'-<u>C</u>UUACCUAAGGACCC<u>A</u>CCGUAAUCGUC-5' (SEQ ID NO: 6665)

C5-1840 Target:
5'-GAATGGATTCCTGGGTGGCATTAGCAG-3' (SEQ ID NO: 8975)

5'-U<u>GG</u>AUUCCUGGGUGG<u>C</u>AUUAGCAgc-3' (SEQ ID NO: 4356)

3'-<u>UU</u>ACCUAAGGACCC<u>A</u>CCGUAAUC<u>G</u>UCG-5' (SEQ ID NO: 6666)

C5-1841 Target:
5'-AATGGATTCCTGGGTGGCATTAGCAGC-3' (SEQ ID NO: 8976)

5'-<u>GG</u>AUUCCUGGGUGG<u>C</u>AUUAGCAGca-3' (SEQ ID NO: 4357)

3'-<u>U</u>ACCUAAGGACCC<u>A</u>CCGUAAUC<u>G</u>UCGU-5' (SEQ ID NO: 6667)

C5-1842 Target:
5'-ATGGATTCCTGGGTGGCATTAGCAGCA-3' (SEQ ID NO: 8977)

5'-<u>G</u>AGCCAAAAAGCC<u>C</u>UUGGAAAGAgt-3' (SEQ ID NO: 4358)

3'-<u>UCC</u>UCGGUUUUUCGGG<u>A</u>ACCUUUC<u>U</u>CA-5' (SEQ ID NO: 6668)

C5-1898 Target:
5'-AGGAGCCAAAAAGCCCTTGGAAAGAGT-3' (SEQ ID NO: 8978)

5'-A<u>G</u>CCAAAAAGCCC<u>U</u>UGGAAAGAGta-3' (SEQ ID NO: 4359)

3'-<u>CC</u>UCGGUUUUUCGGG<u>A</u>ACCUUUCU<u>C</u>AU-5' (SEQ ID NO: 6669)

TABLE 7-continued

Human Anti-C5 DsiRNAs Predicted to have >50% Knockdown Efficacy (Asymmetrics)

C5-1899 Target:
5'-GGAGCCAAAAAGCCCTTGGAAAGAGTA-3' (SEQ ID NO: 8979)

5'-GCCAAAAAGCCCUUGGAAAGAGUat-3' (SEQ ID NO: 4360)

3'-CUCGGUUUUUCGGGAACCUUUCUCAUA-5' (SEQ ID NO: 6670)

C5-1900 Target:
5'-GAGCCAAAAAGCCCTTGGAAAGAGTAT-3' (SEQ ID NO: 8980)

5'-CCAAAAAGCCCUUGGAAAGAGUAtt-3' (SEQ ID NO: 4361)

3'-UCGGUUUUUCGGGAACCUUUCUCAUAA-5' (SEQ ID NO: 6671)

C5-1901 Target:
5'-AGCCAAAAAGCCCTTGGAAAGAGTATT-3' (SEQ ID NO: 8981)

5'-CAAAAAGCCCUUGGAAAGAGUAUtt-3' (SEQ ID NO: 4362)

3'-CGGUUUUUCGGGAACCUUUCUCAUAAA-5' (SEQ ID NO: 6672)

C5-1902 Target:
5'-GCCAAAAAGCCCTTGGAAAGAGTATTT-3' (SEQ ID NO: 8982)

5'-AAAAAGCCCUUGGAAAGAGUAUUtc-3' (SEQ ID NO: 4363)

3'-GGUUUUUCGGGAACCUUUCUCAUAAAG-5' (SEQ ID NO: 6673)

C5-1903 Target:
5'-CCAAAAAGCCCTTGGAAAGAGTATTTC-3' (SEQ ID NO: 8983)

5'-AAAAGCCCUUGGAAAGAGUAUUUca-3' (SEQ ID NO: 4364)

3'-GUUUUUCGGGAACCUUUCUCAUAAAGU-5' (SEQ ID NO: 6674)

C5-1904 Target:
5'-CAAAAAGCCCTTGGAAAGAGTATTTCA-3' (SEQ ID NO: 8984)

5'-AAAGCCCUUGGAAAGAGUAUUUCaa-3' (SEQ ID NO: 4365)

3'-UUUUUCGGGAACCUUUCUCAUAAAGUU-5' (SEQ ID NO: 6675)

C5-1905 Target:
5'-AAAAAGCCCTTGGAAAGAGTATTTCAA-3' (SEQ ID NO: 8985)

5'-AAGCCCUUGGAAAGAGUAUUUCAat-3' (SEQ ID NO: 4366)

3'-UUUUCGGGAACCUUUCUCAUAAAGUUA-5' (SEQ ID NO: 6676)

C5-1906 Target:
5'-AAAAGCCCTTGGAAAGAGTATTTCAAT-3' (SEQ ID NO: 8986)

5'-AGCCCUUGGAAAGAGUAUUUCAtt-3' (SEQ ID NO: 4367)

3'-UUUCGGGAACCUUUCUCAUAAAGUUAA-5' (SEQ ID NO: 6677)

C5-1907 Target:
5'-AAAGCCCTTGGAAAGAGTATTTCAATT-3' (SEQ ID NO: 8987)

5'-GCCCUUGGAAAGAGUAUUUCAAUtc-3' (SEQ ID NO: 4368)

3'-UUCGGGAACCUUUCUCAUAAAGUUAAG-5' (SEQ ID NO: 6678)

C5-1908 Target:
5'-AAGCCCTTGGAAAGAGTATTTCAATTC-3' (SEQ ID NO: 8988)

5'-CCCUUGGAAAGAGUAUUUCAAUUct-3' (SEQ ID NO: 4369)

3'-UCGGGAACCUUUCUCAUAAAGUUAAGA-5' (SEQ ID NO: 6679)

C5-1909 Target:
5'-AGCCCTTGGAAAGAGTATTTCAATTCT-3' (SEQ ID NO: 8989)

5'-CCUUGGAAAGAGUAUUUCAAUUCtt-3' (SEQ ID NO: 4370)

3'-CGGGAACCUUUCUCAUAAAGUUAAGAA-5' (SEQ ID NO: 6680)

C5-1910 Target:
5'-GCCCTTGGAAAGAGTATTTCAATTCTT-3' (SEQ ID NO: 8990)

5'-CUUGGAAAGAGUAUUUCAAUUCUta-3' (SEQ ID NO: 4371)

3'-GGGAACCUUUCUCAUAAAGUUAAGAAU-5' (SEQ ID NO: 6681)

C5-1911 Target:
5'-CCCTTGGAAAGAGTATTTCAATTCTTA-3' (SEQ ID NO: 8991)

5'-UUGGAAAGAGUAUUUCAAUUCUUag-3' (SEQ ID NO: 4372)

3'-GGAACCUUUCUCAUAAAGUUAAGAAUC-5' (SEQ ID NO: 6682)

C5-1912 Target:
5'-CCTTGGAAAGAGTATTTCAATTCTTAG-3' (SEQ ID NO: 8992)

5'-UGGAAAGAGUAUUUCAAUUCUUAga-3' (SEQ ID NO: 4373)

3'-GAACCUUUCUCAUAAAGUUAAGAAUCU-5' (SEQ ID NO: 6683)

C5-1913 Target:
5'-CTTGGAAAGAGTATTTCAATTCTTAGA-3' (SEQ ID NO: 8993)

5'-GGAAAGAGUAUUUCAAUUCUUAGag-3' (SEQ ID NO: 4374)

3'-AACCUUUCUCAUAAAGUUAAGAAUCUC-5' (SEQ ID NO: 6684)

C5-1914 Target:
5'-TTGGAAAGAGTATTTCAATTCTTAGAG-3' (SEQ ID NO: 8994)

5'-GAAAGAGUAUUUCAAUUCUUAGAga-3' (SEQ ID NO: 4375)

3'-ACCUUUCUCAUAAAGUUAAGAAUCUCU-5' (SEQ ID NO: 6685)

C5-1915 Target:
5'-TGGAAAGAGTATTTCAATTCTTAGAGA-3' (SEQ ID NO: 8995)

5'-AAAGAGUAUUUCAAUUCUUAGAGaa-3' (SEQ ID NO: 4376)

3'-CCUUUCUCAUAAAGUUAAGAAUCUCUU-5' (SEQ ID NO: 6686)

C5-1916 Target:
5'-GGAAAGAGTATTTCAATTCTTAGAGAA-3' (SEQ ID NO: 8996)

5'-AAGAGUAUUUCAAUUCUUAGAGAag-3' (SEQ ID NO: 4377)

3'-CUUUCUCAUAAAGUUAAGAAUCUCUUC-5' (SEQ ID NO: 6687)

C5-1917 Target:
5'-GAAAGAGTATTTCAATTCTTAGAGAAG-3' (SEQ ID NO: 8997)

5'-AGAGUAUUUCAAUUCUUAGAGAAga-3' (SEQ ID NO: 4378)

3'-UUUCUCAUAAAGUUAAGAAUCUCUUCU-5' (SEQ ID NO: 6688)

C5-1918 Target:
5'-AAAGAGTATTTCAATTCTTAGAGAAGA-3' (SEQ ID NO: 8998)

5'-GAGUAUUUCAAUUCUUAGAGAAGag-3' (SEQ ID NO: 4379)

3'-UUCUCAUAAAGUUAAGAAUCUCUUCUC-5' (SEQ ID NO: 6689)

C5-1919 Target:
5'-AAGAGTATTTCAATTCTTAGAGAAGAG-3' (SEQ ID NO: 8999)

5'-AGUAUUUCAAUUCUUAGAGAAGAgt-3' (SEQ ID NO: 4380)

3'-UCUCAUAAAGUUAAGAAUCUCUUCUCA-5' (SEQ ID NO: 6690)

C5-1920 Target:
5'-AGAGTATTTCAATTCTTAGAGAAGAGT-3' (SEQ ID NO: 9000)

5'-GUAUUUCAAUUCUUAGAGAAGAGtg-3' (SEQ ID NO: 4381)

3'-CUCAUAAAGUUAAGAAUCUCUUCUCAC-5' (SEQ ID NO: 6691)

TABLE 7-continued

Human Anti-C5 DsiRNAs Predicted to have >50%
Knockdown Efficacy (Asymmetrics)

C5-1921 Target:
5'-GAGTATTTCAATTCTTAGAGAAGAGTG-3' (SEQ ID NO: 9001)

5'-U<u>AUU</u>UCAAUUCUU<u>AGAGAAGAGUG</u>ga-3' (SEQ ID NO: 4382)

3'-<u>UCAU</u>AAAGUUAAGAAUCUCUUCU<u>CACU</u>-5' (SEQ ID NO: 6692)

C5-1922 Target:
5'-AGTATTTCAATTCTTAGAGAAGAGTGA-3' (SEQ ID NO: 9002)

5'-A<u>UUU</u>CAAUUCUUAG<u>AGAAGAGU</u>GAt-3' (SEQ ID NO: 4383)

3'-<u>CAU</u>AAAGUUAAGAAU<u>CU</u>CUUCUC<u>ACUA</u>-5' (SEQ ID NO: 6693)

C5-1923 Target:
5'-GTATTTCAATTCTTAGAGAAGAGTGAT-3' (SEQ ID NO: 9003)

5'-U<u>UUC</u>AAUUCUUAG<u>AG</u>A<u>AGAGU</u>GAtc-3' (SEQ ID NO: 4384)

3'-<u>AUAA</u>AGUUAAGAAUC<u>UC</u>UUCUC<u>AC</u>UAG-5' (SEQ ID NO: 6694)

C5-1924 Target:
5'-TATTTCAATTCTTAGAGAAGAGTGATC-3' (SEQ ID NO: 9004)

5'-U<u>UC</u>AAUUCUUAGAG<u>AA</u>GAGUGA<u>U</u>ct-3' (SEQ ID NO: 4385)

3'-<u>UAA</u>AGUUAAGAAUCUCUUCUC<u>ACU</u>AGA-5' (SEQ ID NO: 6695)

C5-1925 Target:
5'-ATTTCAATTCTTAGAGAAGAGTGATCT-3' (SEQ ID NO: 9005)

5'-U<u>C</u>AAUUCUUAGAG<u>AAG</u>AGUGAUCtg-3' (SEQ ID NO: 4386)

3'-<u>AAA</u>GUUAAGAAUC<u>UC</u>UUCUCACU<u>AGAC</u>-5' (SEQ ID NO: 6696)

C5-1926 Target:
5'-TTTCAATTCTTAGAGAAGAGTGATCTG-3' (SEQ ID NO: 9006)

5'-C<u>A</u>AUUCUUAGAGA<u>AG</u>AGUGAUCUgg-3' (SEQ ID NO: 4387)

3'-<u>AAG</u>UUAAGAAUCUCUUCUCACU<u>AGACC</u>-5' (SEQ ID NO: 6697)

C5-1927 Target:
5'-TTCAATTCTTAGAGAAGAGTGATCTGG-3' (SEQ ID NO: 9007)

5'-A<u>A</u>UUCUUAGAAG<u>AG</u>AGUGAUCUGgg-3' (SEQ ID NO: 4388)

3'-<u>AGU</u>AAGAAUCUCUU<u>CU</u>CACUAGA<u>CCC</u>-5' (SEQ ID NO: 6698)

C5-1928 Target:
5'-TCAATTCTTAGAGAAGAGTGATCTGGG-3' (SEQ ID NO: 9008)

5'-A<u>UU</u>CUUAGAGAAG<u>A</u>GUGAUCUGGgc-3' (SEQ ID NO: 4389)

3'-<u>GUU</u>AAGAAUCUCUU<u>CU</u>CACUAGA<u>CCCG</u>-5' (SEQ ID NO: 6699)

C5-1929 Target:
5'-CAATTCTTAGAGAAGAGTGATCTGGGC-3' (SEQ ID NO: 9009)

5'-U<u>UC</u>UUAGAGAAGAG<u>UG</u>AUCUGGGct-3' (SEQ ID NO: 4390)

3'-<u>UUA</u>AGAAUCUCUUCU<u>C</u>ACUAGA<u>CCCGA</u>-5' (SEQ ID NO: 6700)

C5-1930 Target:
5'-AATTCTTAGAGAAGAGTGATCTGGGCT-3' (SEQ ID NO: 9010)

5'-C<u>UU</u>AGAGAAGAGU<u>GAU</u>CUGGGCUgt-3' (SEQ ID NO: 4391)

3'-<u>AAG</u>AAUCUCUUCUC<u>AC</u>UAGACCCGACA-5' (SEQ ID NO: 6701)

C5-1932 Target:
5'-TTCTTAGAGAAGAGTGATCTGGGCTGT-3' (SEQ ID NO: 9011)

5'-U<u>U</u>AGAGAAGAGUAU<u>C</u>UGGGCUgtg-3' (SEQ ID NO: 4392)

3'-<u>AGA</u>AUCUCUUCUCA<u>CU</u>AGACCCG<u>ACAC</u>-5' (SEQ ID NO: 6702)

C5-1933 Target:
5'-TCTTAGAGAAGAGTGATCTGGGCTGTG-3' (SEQ ID NO: 9012)

5'-A<u>GA</u>GAAGAGUGAU<u>C</u>UGGGCUGUGgg-3' (SEQ ID NO: 4393)

3'-<u>AAU</u>CUCUUCUCACU<u>AGA</u>CCCGAC<u>ACCC</u>-5' (SEQ ID NO: 6703)

C5-1935 Target:
5'-TTAGAGAAGAGTGATCTGGGCTGTGGG-3' (SEQ ID NO: 9013)

5'-U<u>GGGG</u>CAGGUGGU<u>GGC</u>CUCAACAat-3' (SEQ ID NO: 4394)

3'-<u>ACACCCC</u>GUCC<u>ACC</u>ACCGGAGUUG<u>UUA</u>-5' (SEQ ID NO: 6704)

C5-1956 Target:
5'-TGTGGGGCAGGTGGTGGCCTCAACAAT-3' (SEQ ID NO: 9014)

5'-G<u>CA</u>GGUGGUGGCCU<u>C</u>AACAAUGCca-3' (SEQ ID NO: 4395)

3'-<u>CCC</u>GUCCACCACCGG<u>A</u>GUUGUUAC<u>GGU</u>-5' (SEQ ID NO: 6705)

C5-1960 Target:
5'-GGGCAGGTGGTGGCCTCAACAATGCCA-3' (SEQ ID NO: 9015)

5'-C<u>AGG</u>UGGUGGCCUC<u>AA</u>CAAUGCCaa-3' (SEQ ID NO: 4396)

3'-<u>CCG</u>UCCACCACCGGAGUUGUUAC<u>GGUU</u>-5' (SEQ ID NO: 6706)

C5-1961 Target:
5'-GGCAGGTGGTGGCCTCAACAATGCCAA-3' (SEQ ID NO: 9016)

5'-A<u>GG</u>UGGUGGCCUC<u>AAC</u>AAUGCCAat-3' (SEQ ID NO: 4397)

3'-<u>CGU</u>CCACCACCGGAGUUGUUAC<u>GGUUA</u>-5' (SEQ ID NO: 6707)

C5-1962 Target:
5'-GCAGGTGGTGGCCTCAACAATGCCAAT-3' (SEQ ID NO: 9017)

5'-G<u>GU</u>GGUGGCCUCA<u>AC</u>AAUGCCAAtg-3' (SEQ ID NO: 4398)

3'-<u>GUCC</u>ACCACCGGAGUUGUUACGG<u>UUAC</u>-5' (SEQ ID NO: 6708)

C5-1963 Target:
5'-CAGGTGGTGGCCTCAACAATGCCAATG-3' (SEQ ID NO: 9018)

5'-G<u>UGG</u>UGGCCUCAA<u>C</u>A<u>A</u>UGCCAAUgt-3' (SEQ ID NO: 4399)

3'-<u>UCC</u>ACCACCGGAGUUGUUACGGUU<u>ACA</u>-5' (SEQ ID NO: 6709)

C5-1964 Target:
5'-AGGTGGTGGCCTCAACAATGCCAATGT-3' (SEQ ID NO: 9019)

5'-U<u>GG</u>UGGCCUCAAC<u>AA</u>UGCCAAUGtg-3' (SEQ ID NO: 4400)

3'-<u>CCAC</u>CACCGGAGUUG<u>UU</u>ACGGUU<u>ACAC</u>-5' (SEQ ID NO: 6710)

C5-1965 Target:
5'-GGTGGTGGCCTCAACAATGCCAATGTG-3' (SEQ ID NO: 9020)

5'-G<u>UUC</u>CACCUAGCUGG<u>A</u>CUUACCUtc-3' (SEQ ID NO: 4401)

3'-<u>CACAAG</u>GUGGAUCG<u>AC</u>CUGAAUGG<u>AAG</u>-5' (SEQ ID NO: 6711)

C5-1989 Target:
5'-GTGTTCCACCTAGCTGGACTTACCTTC-3' (SEQ ID NO: 9021)

5'-U<u>UCC</u>ACCUAGCUGG<u>AC</u>UUACCUUcc-3' (SEQ ID NO: 4402)

3'-<u>ACAAG</u>GUGGAUCG<u>AC</u>CUGAAUGG<u>AAGG</u>-5' (SEQ ID NO: 6712)

C5-1990 Target:
5'-TGTTCCACCTAGCTGGACTTACCTTCC-3' (SEQ ID NO: 9022)

5'-U<u>CC</u>ACCUAGCUGGA<u>C</u>UUACCUUCct-3' (SEQ ID NO: 4403)

3'-<u>CAAGG</u>UGGAUCGACCUGAAUGG<u>AAGGA</u>-5' (SEQ ID NO: 6713)

TABLE 7-continued

Human Anti-C5 DsiRNAs Predicted to have >50% Knockdown Efficacy (Asymmetrics)

C5-1991 Target:
5'-GTTCCACCTAGCTGGACTTACCTTCCT-3' (SEQ ID NO: 9023)

5'-CCACCUAGCUGGACUUACCUUCCtc-3' (SEQ ID NO: 4404)

3'-AAGGUGGAUCGACCUGAAUGGAAGGAG-5' (SEQ ID NO: 6714)

C5-1992 Target:
5'-TTCCACCTAGCTGGACTTACCTTCCTC-3' (SEQ ID NO: 9024)

5'-CACCUAGCUGGACUUACCUUCCUca-3' (SEQ ID NO: 4405)

3'-AGGUGGAUCGACCUGAAUGGAAGGAGU-5' (SEQ ID NO: 6715)

C5-1993 Target:
5'-TCCACCTAGCTGGACTTACCTTCCTCA-3' (SEQ ID NO: 9025)

5'-ACCUAGCUGGACUUACCUUCCUCac-3' (SEQ ID NO: 4406)

3'-GGUGGAUCGACCUGAAUGGAAGGAGUG-5' (SEQ ID NO: 6716)

C5-1994 Target:
5'-CCACCTAGCTGGACTTACCTTCCTCAC-3' (SEQ ID NO: 9026)

5'-CCUAGCUGGACUUACCUUCCUCAct-3' (SEQ ID NO: 4407)

3'-GUGGAUCGACCUGAAUGGAAGGAGUGA-5' (SEQ ID NO: 6717)

C5-1995 Target:
5'-CACCTAGCTGGACTTACCTTCCTCACT-3' (SEQ ID NO: 9027)

5'-CUAGCUGGACUUACCUUCCUCACta-3' (SEQ ID NO: 4408)

3'-UGGAUCGACCUGAAUGGAAGGAGUGAU-5' (SEQ ID NO: 6718)

C5-1996 Target:
5'-ACCTAGCTGGACTTACCTTCCTCACTA-3' (SEQ ID NO: 9028)

5'-UAGCUGGACUUACCUUCCUCACUaa-3' (SEQ ID NO: 4409)

3'-GGAUCGACCUGAAUGGAAGGAGUGAUU-5' (SEQ ID NO: 6719)

C5-1997 Target:
5'-CCTAGCTGGACTTACCTTCCTCACTAA-3' (SEQ ID NO: 9029)

5'-AGCUGGACUUACCUUCCUCACUAat-3' (SEQ ID NO: 4410)

3'-GAUCGACCUGAAUGGAAGGAGUGAUUA-5' (SEQ ID NO: 6720)

C5-1998 Target:
5'-CTAGCTGGACTTACCTTCCTCACTAAT-3' (SEQ ID NO: 9030)

5'-GCUGGACUUACCUUCCUCACUAAtg-3' (SEQ ID NO: 4411)

3'-AUCGACCUGAAUGGAAGGAGUGAUUAC-5' (SEQ ID NO: 6721)

C5-1999 Target:
5'-TAGCTGGACTTACCTTCCTCACTAATG-3' (SEQ ID NO: 9031)

5'-CUGGACUUACCUUCCUCACUAAUgc-3' (SEQ ID NO: 4412)

3'-UCGACCUGAAUGGAAGGAGUGAUUACG-5' (SEQ ID NO: 6722)

C5-2000 Target:
5'-AGCTGGACTTACCTTCCTCACTAATGC-3' (SEQ ID NO: 9032)

5'-UGGACUUACCUUCCUCACUAAUGca-3' (SEQ ID NO: 4413)

3'-CGACCUGAAUGGAAGGAGUGAUUACGU-5' (SEQ ID NO: 6723)

C5-2001 Target:
5'-GCTGGACTTACCTTCCTCACTAATGCA-3' (SEQ ID NO: 9033)

5'-GGACUUACCUUCCUCACUAAUGCaa-3' (SEQ ID NO: 4414)

3'-GACCUGAAUGGAAGGAGUGAUUACGUU-5' (SEQ ID NO: 6724)

C5-2002 Target:
5'-CTGGACTTACCTTCCTCACTAATGCAA-3' (SEQ ID NO: 9034)

5'-GACUUACCUUCCUCACUAAUGCAaa-3' (SEQ ID NO: 4415)

3'-ACCUGAAUGGAAGGAGUGAUUACGUUU-5' (SEQ ID NO: 6725)

C5-2003 Target:
5'-TGGACTTACCTTCCTCACTAATGCAAA-3' (SEQ ID NO: 9035)

5'-ACUUACCUUCCUCACUAAUGCAAat-3' (SEQ ID NO: 4416)

3'-CCUGAAUGGAAGGAGUGAUUACGUUUA-5' (SEQ ID NO: 6726)

C5-2004 Target:
5'-GGACTTACCTTCCTCACTAATGCAAAT-3' (SEQ ID NO: 9036)

5'-CUUACCUUCCUCACUAAUGCAAAtg-3' (SEQ ID NO: 4417)

3'-CUGAAUGGAAGGAGUGAUUACGUUUAC-5' (SEQ ID NO: 6727)

C5-2005 Target:
5'-GACTTACCTTCCTCACTAATGCAAATG-3' (SEQ ID NO: 9037)

5'-UUACCUUCCUCACUAAUGCAAAUgc-3' (SEQ ID NO: 4418)

3'-UGAAUGGAAGGAGUGAUUACGUUUACG-5' (SEQ ID NO: 6728)

C5-2006 Target:
5'-ACTTACCTTCCTCACTAATGCAAATGC-3' (SEQ ID NO: 9038)

5'-UACCUUCCUCACUAAUGCAAAUGca-3' (SEQ ID NO: 4419)

3'-GAAUGGAAGGAGUGAUUACGUUUACGU-5' (SEQ ID NO: 6729)

C5-2007 Target:
5'-CTTACCTTCCTCACTAATGCAAATGCA-3' (SEQ ID NO: 9039)

5'-ACCUUCCUCACUAAUGCAAAUGCag-3' (SEQ ID NO: 4420)

3'-AAUGGAAGGAGUGAUUACGUUUACGUC-5' (SEQ ID NO: 6730)

C5-2008 Target:
5'-TTACCTTCCTCACTAATGCAAATGCAG-3' (SEQ ID NO: 9040)

5'-CCUUCCUCACUAAUGCAAAUGCAga-3' (SEQ ID NO: 4421)

3'-AUGGAAGGAGUGAUUACGUUUACGUCU-5' (SEQ ID NO: 6731)

C5-2009 Target:
5'-TACCTTCCTCACTAATGCAAATGCAGA-3' (SEQ ID NO: 9041)

5'-CUUCCUCACUAAUGCAAAUGCAGat-3' (SEQ ID NO: 4422)

3'-UGGAAGGAGUGAUUACGUUUACGUCUA-5' (SEQ ID NO: 6732)

C5-2010 Target:
5'-ACCTTCCTCACTAATGCAAATGCAGAT-3' (SEQ ID NO: 9042)

5'-UUCCUCACUAAUGCAAAUGCAGAtg-3' (SEQ ID NO: 4423)

3'-GGAAGGAGUGAUUACGUUUACGUCUAC-5' (SEQ ID NO: 6733)

C5-2011 Target:
5'-CCTTCCTCACTAATGCAAATGCAGATG-3' (SEQ ID NO: 9043)

5'-UCCUCACUAAUGCAAAUGCAGAUga-3' (SEQ ID NO: 4424)

3'-GAAGGAGUGAUUACGUUUACGUCUACU-5' (SEQ ID NO: 6734)

C5-2012 Target:
5'-CTTCCTCACTAATGCAAATGCAGATGA-3' (SEQ ID NO: 9044)

5'-CCUCACUAAUGCAAAUGCAGAUGac-3' (SEQ ID NO: 4425)

3'-AAGGAGUGAUUACGUUUACGUCUACUG-5' (SEQ ID NO: 6735)

TABLE 7-continued

Human Anti-C5 DsiRNAs Predicted to have >50%
Knockdown Efficacy (Asymmetrics)

C5-2013 Target:
5'-TTCCTCACTAATGCAAATGCAGATGAC-3' (SEQ ID NO: 9045)

5'-C<u>U</u>C<u>A</u>CUAAUGCAA<u>AU</u>GCAGAUGAct-3' (SEQ ID NO: 4426)

3'-<u>AGGA</u>GUGAUUACGUU<u>UA</u>CGUCUAC<u>U</u>GA-5' (SEQ ID NO: 6736)

C5-2014 Target:
5'-TCCTCACTAATGCAAATGCAGATGACT-3' (SEQ ID NO: 9046)

5'-U<u>CAC</u>UAAUGCAAA<u>U</u>GCAGAUGActc-3' (SEQ ID NO: 4427)

3'-<u>GGAGU</u>GAUUACGUUU<u>A</u>CGUCUACUGAG-5' (SEQ ID NO: 6737)

C5-2015 Target:
5'-CCTCACTAATGCAAATGCAGATGACTC-3' (SEQ ID NO: 9047)

5'-C<u>A</u>CUAAUGCAAAUG<u>C</u>AGAUGACUcc-3' (SEQ ID NO: 4428)

3'-<u>GAGU</u>GAUUACGUUU<u>A</u>CGUCUACUGAGG-5' (SEQ ID NO: 6738)

C5-2016 Target:
5'-CTCACTAATGCAAATGCAGATGACTCC-3' (SEQ ID NO: 9048)

5'-<u>A</u>CUAAUGCAAAUG<u>C</u>AGAUGACUCcc-3' (SEQ ID NO: 4429)

3'-<u>AGU</u>GAUUACGUUU<u>A</u>CGUCUACUGAGGG-5' (SEQ ID NO: 6739)

C5-2017 Target:
5'-TCACTAATGCAAATGCAGATGACTCCC-3' (SEQ ID NO: 9049)

5'-C<u>U</u>AAUGCAAAUG<u>C</u>AGAUGACUCCca-3' (SEQ ID NO: 4430)

3'-<u>GU</u>GAUUACGUUU<u>A</u>CGUCUACUGAGGGU-5' (SEQ ID NO: 6740)

C5-2018 Target:
5'-CACTAATGCAAATGCAGATGACTCCCA-3' (SEQ ID NO: 9050)

5'-U<u>A</u>AUGCAAAUGCAG<u>A</u>UGACUCCCaa-3' (SEQ ID NO: 4431)

3'-<u>UGA</u>UUACGUUU<u>A</u>CGUCUACUGAGGGUU-5' (SEQ ID NO: 6741)

C5-2019 Target:
5'-ACTAATGCAAATGCAGATGACTCCCAA-3' (SEQ ID NO: 9051)

5'-A<u>A</u>UGCAAAUGCAG<u>A</u>UGACUCCCAag-3' (SEQ ID NO: 4432)

3'-<u>GAU</u>U<u>A</u>CGUUUACGUCUACUGAGGGUUC-5' (SEQ ID NO: 6742)

C5-2020 Target:
5'-CTAATGCAAATGCAGATGACTCCCAAG-3' (SEQ ID NO: 9052)

5'-<u>A</u>UGCAAAUGCAG<u>AU</u>GACUCCCAAga-3' (SEQ ID NO: 4433)

3'-<u>AUUA</u>CGUUUACGUCU<u>A</u>CUGAGGG<u>U</u>UCU-5' (SEQ ID NO: 6743)

C5-2021 Target:
5'-TAATGCAAATGCAGATGACTCCCAAGA-3' (SEQ ID NO: 9053)

5'-UG<u>C</u>AAAUGCAGAUG<u>A</u>CUCCCAAGaa-3' (SEQ ID NO: 4434)

3'-<u>UUAC</u>GUUUACGUCU<u>A</u>CUGAGGGUUCUU-5' (SEQ ID NO: 6744)

C5-2022 Target:
5'-AATGCAAATGCAGATGACTCCCAAGAA-3' (SEQ ID NO: 9054)

5'-GC<u>A</u>AAUGCAGAUG<u>A</u>CUCCCAAGAaa-3' (SEQ ID NO: 4435)

3'-<u>UAC</u>GUUUACGUCUA<u>C</u>UGAGGGUUCUUU-5' (SEQ ID NO: 6745)

C5-2023 Target:
5'-ATGCAAATGCAGATGACTCCCAAGAAA-3' (SEQ ID NO: 9055)

5'-C<u>A</u>AUGCAGAUGAC<u>U</u>CCCAAGAAaa-3' (SEQ ID NO: 4436)

3'-<u>ACG</u>UUUACGUCUACUGAGGGUUC<u>U</u>UUU-5' (SEQ ID NO: 6746)

C5-2024 Target:
5'-TGCAAATGCAGATGACTCCCAAGAAAA-3' (SEQ ID NO: 9056)

5'-<u>A</u>AAUGCAGAUGAC<u>UCC</u>CAAGAAAat-3' (SEQ ID NO: 4437)

3'-<u>CG</u>UUUACGUCUACUGAGGGUUCU<u>UUUA</u>-5' (SEQ ID NO: 6747)

C5-2025 Target:
5'-GCAAATGCAGATGACTCCCAAGAAAAT-3' (SEQ ID NO: 9057)

5'-<u>A</u>AUGCAGAUGACU<u>CCC</u>AAGAAAatg-3' (SEQ ID NO: 4438)

3'-<u>GUUU</u>ACGUCUACUGAGGGUUCU<u>UUUAC</u>-5' (SEQ ID NO: 6748)

C5-2026 Target:
5'-CAAATGCAGATGACTCCCAAGAAAATG-3' (SEQ ID NO: 9058)

5'-<u>A</u>UGCAGAUGACUC<u>CC</u>AAGAAAAUga-3' (SEQ ID NO: 4439)

3'-<u>UUUA</u>CGUCUACUGAGGGUUCUUUU<u>ACU</u>-5' (SEQ ID NO: 6749)

C5-2027 Target:
5'-AAATGCAGATGACTCCCAAGAAAATGA-3' (SEQ ID NO: 9059)

5'-UGC<u>A</u>GAUGACUCCC<u>A</u>AGAAAAUGat-3' (SEQ ID NO: 4440)

3'-<u>UUAC</u>GUCUACUGAGGGUUCUUUU<u>ACUA</u>-5' (SEQ ID NO: 6750)

C5-2028 Target:
5'-AATGCAGATGACTCCCAAGAAAATGAT-3' (SEQ ID NO: 9060)

5'-GC<u>A</u>GAUGACUCCC<u>A</u>AGAAAAUGAtg-3' (SEQ ID NO: 4441)

3'-<u>UACG</u>UCUACUGAGG<u>GU</u>UCUUUU<u>ACUAC</u>-5' (SEQ ID NO: 6751)

C5-2029 Target:
5'-ATGCAGATGACTCCCAAGAAAATGATG-3' (SEQ ID NO: 9061)

5'-C<u>A</u>GAUGACUCCCA<u>A</u>GAAAAUGAUga-3' (SEQ ID NO: 4442)

3'-<u>ACG</u>U<u>C</u>UACUGAGGGUU<u>C</u>UUUUACUACU-5' (SEQ ID NO: 6752)

C5-2030 Target:
5'-TGCAGATGACTCCCAAGAAAATGATGA-3' (SEQ ID NO: 9062)

5'-A<u>GA</u>UGACUCCCAAG<u>A</u>AAAUGAUGaa-3' (SEQ ID NO: 4443)

3'-<u>CG</u>UCUACUGAGGGUU<u>C</u>UUUUACUAC<u>UU</u>-5' (SEQ ID NO: 6753)

C5-2031 Target:
5'-GCAGATGACTCCCAAGAAAATGATGAA-3' (SEQ ID NO: 9063)

5'-G<u>AU</u>GACUCCCAAG<u>AAA</u>AUGAUGAac-3' (SEQ ID NO: 4444)

3'-<u>GUCU</u>ACUGAGGGUU<u>C</u>UUUUACUAC<u>UUG</u>-5' (SEQ ID NO: 6754)

C5-2032 Target:
5'-CAGATGACTCCCAAGAAAATGATGAAC-3' (SEQ ID NO: 9064)

5'-<u>A</u>UGACUCCCAAGA<u>AAA</u>UGAUGAAcc-3' (SEQ ID NO: 4445)

3'-<u>UCUA</u>CUGAGGGUUC<u>U</u>UUUACUAC<u>UUGG</u>-5' (SEQ ID NO: 6755)

C5-2033 Target:
5'-AGATGACTCCCAAGAAAATGATGAACC-3' (SEQ ID NO: 9065)

5'-UG<u>A</u>CUCCCAAGAA<u>A</u>AUGAUGAACct-3' (SEQ ID NO: 4446)

3'-<u>CUAC</u>UGAGGGUUCU<u>U</u>UUACUACUUGGA-5' (SEQ ID NO: 6756)

C5-2034 Target:
5'-GATGACTCCCAAGAAAATGATGAACCT-3' (SEQ ID NO: 9066)

5'-<u>GA</u>CUCCCAAGAAA<u>A</u>UGAUGAACCtt-3' (SEQ ID NO: 4447)

3'-<u>UAC</u>UGAGGGUUCUUUUACUACUUG<u>GAA</u>-5' (SEQ ID NO: 6757)

TABLE 7-continued

Human Anti-C5 DsiRNAs Predicted to have >50% Knockdown Efficacy (Asymmetrics)

C5-2035 Target:
5'-ATGACTCCCAAGAAAATGATGAACCTT-3' (SEQ ID NO: 9067)

5'-A<u>CUC</u>CCAAGAAAA<u>UGAUG</u>AACCU<u>U</u>g-3' (SEQ ID NO: 4448)

3'-<u>ACUG</u>AGGG<u>UUCUUUUA</u>C<u>U</u>ACUUG<u>GAAC</u>-5' (SEQ ID NO: 6758)

C5-2036 Target:
5'-TGACTCCCAAGAAAATGATGAACCTTG-3' (SEQ ID NO: 9068)

5'-C<u>UCC</u>CAAGAAAA<u>UGAUG</u>AACCUU<u>g</u>t-3' (SEQ ID NO: 4449)

3'-<u>CUGAGG</u>GUU<u>CUUUUA</u>C<u>U</u>ACUUGG<u>AACA</u>-5' (SEQ ID NO: 6759)

C5-2037 Target:
5'-GACTCCCAAGAAAATGATGAACCTTGT-3' (SEQ ID NO: 9069)

5'-U<u>CCC</u>AAGAAAA<u>UGAUG</u>AACCUU<u>G</u>ta-3' (SEQ ID NO: 4450)

3'-<u>UGAG</u>GG<u>UUCUUUU</u>A<u>C</u>UACUUGGA<u>ACAU</u>-5' (SEQ ID NO: 6760)

C5-2038 Target:
5'-ACTCCCAAGAAAATGATGAACCTTGTA-3' (SEQ ID NO: 9070)

5'-C<u>CC</u>AAGAAAAU<u>GAUG</u>AACCUUGU<u>a</u>a-3' (SEQ ID NO: 4451)

3'-<u>GAGGG</u>UUC<u>UUUU</u>AC<u>U</u>ACUUGGAAC<u>AUU</u>-5' (SEQ ID NO: 6761)

C5-2039 Target:
5'-CTCCCAAGAAAATGATGAACCTTGTAA-3' (SEQ ID NO: 9071)

5'-C<u>C</u>AAGAAAAU<u>GAUG</u>A<u>A</u>CCUUGU<u>A</u>aa-3' (SEQ ID NO: 4452)

3'-<u>AGGG</u>UU<u>C</u>UU<u>UUAC</u>U<u>A</u>CUUGGAAC<u>AUUU</u>-5' (SEQ ID NO: 6762)

C5-2040 Target:
5'-TCCCAAGAAAATGATGAACCTTGTAAA-3' (SEQ ID NO: 9072)

5'-C<u>A</u>AGAAAAU<u>GAUG</u>AA<u>CC</u>UUGUAA<u>a</u>g-3' (SEQ ID NO: 4453)

3'-<u>GGG</u>UUC<u>UUUU</u>ACUA<u>C</u>UUGGAACA<u>UUUC</u>-5' (SEQ ID NO: 6763)

C5-2041 Target:
5'-CCCAAGAAAATGATGAACCTTGTAAAG-3' (SEQ ID NO: 9073)

5'-A<u>AG</u>AAAAUGAUGA<u>A</u>CC<u>UUGUAAAG</u>a-3' (SEQ ID NO: 4454)

3'-<u>GGUUC</u>UUUUACUAC<u>U</u>UGGAACA<u>UUUCU</u>-5' (SEQ ID NO: 6764)

C5-2042 Target:
5'-CCAAGAAAATGATGAACCTTGTAAAGA-3' (SEQ ID NO: 9074)

5'-G<u>A</u>AAU<u>GAUGAACC</u>UUG<u>UAAAGA</u>aa-3' (SEQ ID NO: 4455)

3'-<u>UUCUU</u>UUACUACUUG<u>G</u>AACAUUUC<u>UUU</u>-5' (SEQ ID NO: 6765)

C5-2044 Target:
5'-AAGAAAATGATGAACCTTGTAAAGAAA-3' (SEQ ID NO: 9075)

5'-A<u>A</u>AAU<u>GAUGAACC</u>UU<u>GUAAAGA</u>at-3' (SEQ ID NO: 4456)

3'-<u>UCUUU</u>UACUACUUGG<u>A</u>ACAUUUC<u>UUUA</u>-5' (SEQ ID NO: 6766)

C5-2045 Target:
5'-AGAAAATGATGAACCTTGTAAAGAAAT-3' (SEQ ID NO: 9076)

5'-A<u>A</u>AU<u>GAUGAACCUU</u>G<u>UAAAGAAA</u>tt-3' (SEQ ID NO: 4457)

3'-<u>CUUUU</u>ACUACUUGG<u>A</u>ACAUUUCUU<u>UAA</u>-5' (SEQ ID NO: 6767)

C5-2046 Target:
5'-GAAAATGATGAACCTTGTAAAGAAATT-3' (SEQ ID NO: 9077)

5'-A<u>A</u>U<u>GAUGAACCUUG</u>U<u>AAAGAAA</u>Uc-3' (SEQ ID NO: 4458)

3'-<u>UUUUA</u>CUACUUGG<u>AAC</u>AUUUCUU<u>UAAG</u>-5' (SEQ ID NO: 6768)

C5-2047 Target:
5'-AAAATGATGAACCTTGTAAAGAAATTC-3' (SEQ ID NO: 9078)

5'-U<u>GAU</u>GAACCUGU<u>AA</u>AGAAAUUCtc-3' (SEQ ID NO: 4459)

3'-<u>UUAC</u>UACUUGGAAC<u>A</u>UUUCUUUA<u>AGAG</u>-5' (SEQ ID NO: 6769)

C5-2049 Target:
5'-AATGATGAACCTTGTAAAGAAATTCTC-3' (SEQ ID NO: 9079)

5'-U<u>GA</u>ACCUUGUAAAG<u>AA</u>AUUCUCAgg-3' (SEQ ID NO: 4460)

3'-<u>CUA</u>CUUGGAACAUUU<u>C</u>UUUAAGAG<u>UCC</u>-5' (SEQ ID NO: 6770)

C5-2052 Target:
5'-GATGAACCTTGTAAAGAAATTCTCAGG-3' (SEQ ID NO: 9080)

5'-A<u>GA</u>AGAUGAAGAAA<u>U</u>AGCUGCUaa-3' (SEQ ID NO: 4461)

3'-<u>UUU</u>CUUCUAUCUUC<u>U</u>UUAUCGAC<u>GAUU</u>-5' (SEQ ID NO: 6771)

C5-2096 Target:
5'-AAAGAAGATAGAAGAAATAGCTGCTAA-3' (SEQ ID NO: 9081)

5'-G<u>AAG</u>AUAGAAGAAA<u>U</u>AGCUGCU<u>A</u>aa-3' (SEQ ID NO: 4462)

3'-<u>UUC</u>UUCUAUCUUCU<u>U</u>UAUCGACG<u>AUUU</u>-5' (SEQ ID NO: 6772)

C5-2097 Target:
5'-AAGAAGATAGAAGAAATAGCTGCTAAA-3' (SEQ ID NO: 9082)

5'-A<u>AG</u>AUAGAAGAAA<u>U</u>AGCUGCU<u>AA</u>at-3' (SEQ ID NO: 4463)

3'-<u>UCUU</u>CUAUCUUCUU<u>U</u>AUCGACGA<u>UUUA</u>-5' (SEQ ID NO: 6773)

C5-2098 Target:
5'-AGAAGATAGAAGAAATAGCTGCTAAAT-3' (SEQ ID NO: 9083)

5'-A<u>G</u>AUAGAAGAAAU<u>AG</u>CUGCUAAA<u>t</u>a-3' (SEQ ID NO: 4464)

3'-<u>CUUC</u>UAUCUUCUUU<u>A</u>UCGACGAUU<u>UAU</u>-5' (SEQ ID NO: 6774)

C5-2099 Target:
5'-GAAGATAGAAGAAATAGCTGCTAAATA-3' (SEQ ID NO: 9084)

5'-G<u>AU</u>AGAAGAAAU<u>AGC</u>UGCUAAAU<u>a</u>t-3' (SEQ ID NO: 4465)

3'-<u>UUCU</u>AUCUUCUUUAU<u>C</u>GACGAUUU<u>AUA</u>-5' (SEQ ID NO: 6775)

C5-2100 Target:
5'-AAGATAGAAGAAATAGCTGCTAAATAT-3' (SEQ ID NO: 9085)

5'-A<u>UA</u>GAAGAAAUAGC<u>U</u>GCUAAAU<u>A</u>ta-3' (SEQ ID NO: 4466)

3'-<u>UCUAU</u>CUUCUUUAUC<u>G</u>ACGAUUU<u>AUAU</u>-5' (SEQ ID NO: 6776)

C5-2101 Target:
5'-AGATAGAAGAAATAGCTGCTAAATATA-3' (SEQ ID NO: 9086)

5'-U<u>AG</u>AAGAAAUAGCU<u>G</u>CUAAAU<u>AUA</u>a-3' (SEQ ID NO: 4467)

3'-<u>CUAU</u>CUUCUUUAUC<u>G</u>ACGAUUUAU<u>AUU</u>-5' (SEQ ID NO: 6777)

C5-2102 Target:
5'-GATAGAAGAAATAGCTGCTAAATATAA-3' (SEQ ID NO: 9087)

5'-A<u>GA</u>AGAAAUAGCUG<u>C</u>UAAAU<u>AUA</u>aa-3' (SEQ ID NO: 4468)

3'-<u>UAUC</u>UUCUUUAUCGA<u>C</u>GAUUUAU<u>AUUU</u>-5' (SEQ ID NO: 6778)

C5-2103 Target:
5'-ATAGAAGAAATAGCTGCTAAATATAAA-3' (SEQ ID NO: 9088)

5'-G<u>AA</u>GAAAUAGCUGC<u>U</u>AAAU<u>AUAA</u>ac-3' (SEQ ID NO: 4469)

3'-<u>AUCU</u>UCUUUAUCGAC<u>G</u>AUUUAU<u>AUUUG</u>-5' (SEQ ID NO: 6779)

TABLE 7-continued

Human Anti-C5 DsiRNAs Predicted to have >50% Knockdown Efficacy (Asymmetrics)

C5-2104 Target:
5'-TAGAAGAAATAGCTGCTAAATATAAAC-3' (SEQ ID NO: 9089)

5'-A<u>AG</u>AAAUAGCUGC<u>U</u>AA<u>A</u>UAUAAAca-3' (SEQ ID NO: 4470)

3'-<u>UCUUC</u>UUUAUCGACG<u>A</u>UUUAUAUUUGU-5' (SEQ ID NO: 6780)

C5-2105 Target:
5'-AGAAGAAATAGCTGCTAAATATAAACA-3' (SEQ ID NO: 9090)

5'-A<u>G</u>AAAUAGCUGCU<u>A</u>AA<u>U</u>AUAAACat-3' (SEQ ID NO: 4471)

3'-<u>CUUC</u>UUUAUCGACG<u>A</u>UUUAUAUUUGUA-5' (SEQ ID NO: 6781)

C5-2106 Target:
5'-GAAGAAATAGCTGCTAAATATAAACAT-3' (SEQ ID NO: 9091)

5'-G<u>A</u>AAUAGCUGCUAA<u>A</u>U<u>A</u>UAAACAtt-3' (SEQ ID NO: 4472)

3'-<u>UUC</u>UUUAUCGACGAUUU<u>A</u>UAUUUGUAA-5' (SEQ ID NO: 6782)

C5-2107 Target:
5'-AAGAAATAGCTGCTAAATATAAACATT-3' (SEQ ID NO: 9092)

5'-A<u>A</u>AUAGCUGCUAAA<u>U</u>A<u>U</u>AAACAUtc-3' (SEQ ID NO: 4473)

3'-<u>UC</u>UUUAUCGACGAUUU<u>A</u>UAUUUGUAAG-5' (SEQ ID NO: 6783)

C5-2108 Target:
5'-AGAAATAGCTGCTAAATATAAACATTC-3' (SEQ ID NO: 9093)

5'-A<u>A</u>UAGCUGCUAAAU<u>A</u>U<u>A</u>AACAUUca-3' (SEQ ID NO: 4474)

3'-<u>C</u>UUUAUCGACGAUUU<u>A</u>UAUUUGUAAGU-5' (SEQ ID NO: 6784)

C5-2109 Target:
5'-GAAATAGCTGCTAAATATAAACATTCA-3' (SEQ ID NO: 9094)

5'-A<u>UA</u>GCUGCUAAAUA<u>U</u>AAACAUUCag-3' (SEQ ID NO: 4475)

3'-<u>UUUA</u>UCGACGAUUUA<u>U</u>AUUUGUAAGUC-5' (SEQ ID NO: 6785)

C5-2110 Target:
5'-AAATAGCTGCTAAATATAAACATTCAG-3' (SEQ ID NO: 9095)

5'-U<u>AG</u>CUGCUAAAUAU<u>A</u>AACAUUCAgt-3' (SEQ ID NO: 4476)

3'-<u>UUA</u>UCGACGAUUUA<u>U</u>AUUUGUAAGUCA-5' (SEQ ID NO: 6786)

C5-2111 Target:
5'-AATAGCTGCTAAATATAAACATTCAGT-3' (SEQ ID NO: 9096)

5'-A<u>GC</u>UGCUAAAUAUA<u>A</u>ACAUUCAGta-3' (SEQ ID NO: 4477)

3'-<u>UAUC</u>GACGAUUUAU<u>A</u>UUUGUAAGUCAU-5' (SEQ ID NO: 6787)

C5-2112 Target:
5'-ATAGCTGCTAAATATAAACATTCAGTA-3' (SEQ ID NO: 9097)

5'-G<u>C</u>UGCUAAAUAUAA<u>A</u>CAUUCAGUag-3' (SEQ ID NO: 4478)

3'-<u>AUC</u>GACGAUUUAUA<u>U</u>UUGUAAGUCAUC-5' (SEQ ID NO: 6788)

C5-2113 Target:
5'-TAGCTGCTAAATATAAACATTCAGTAG-3' (SEQ ID NO: 9098)

5'-U<u>AG</u>UGAAGAAAUGU<u>U</u>GUUACGAUgg-3' (SEQ ID NO: 4479)

3'-<u>UCAUC</u>ACUUCUUUA<u>C</u>AACAAUGCUACC-5' (SEQ ID NO: 6789)

C5-2135 Target:
5'-AGTAGTGAAGAAATGTTGTTACGATGG-3' (SEQ ID NO: 9099)

5'-A<u>G</u>UGAAGAAAUGUU<u>G</u>UUACGAUGga-3' (SEQ ID NO: 4480)

3'-<u>CAUCA</u>CUUCUUUAC<u>A</u>ACAAUGCU<u>ACCU</u>-5' (SEQ ID NO: 6790)

C5-2136 Target:
5'-GTAGTGAAGAAATGTTGTTACGATGGA-3' (SEQ ID NO: 9100)

5'-G<u>UG</u>AAGAAAUGUUG<u>U</u>UACGAUGGag-3' (SEQ ID NO: 4481)

3'-<u>AUCAC</u>UUCUUUACA<u>A</u>CAAUGCUA<u>CCUC</u>-5' (SEQ ID NO: 6791)

C5-2137 Target:
5'-TAGTGAAGAAATGTTGTTACGATGGAG-3' (SEQ ID NO: 9101)

5'-U<u>G</u>AAGAAAUGUUG<u>UU</u>ACGAUGGAgc-3' (SEQ ID NO: 4482)

3'-<u>UCAC</u>UUCUUUACAAC<u>A</u>AUGCUACCUCG-5' (SEQ ID NO: 6792)

C5-2138 Target:
5'-AGTGAAGAAATGTTGTTACGATGGAGC-3' (SEQ ID NO: 9102)

5'-G<u>A</u>AGAAAUGUUGUU<u>A</u>CGAUGGAGcc-3' (SEQ ID NO: 4483)

3'-<u>CAC</u>UUCUUUACAACA<u>A</u>UGCUACCUCGG-5' (SEQ ID NO: 6793)

C5-2139 Target:
5'-GTGAAGAAATGTTGTTACGATGGAGCC-3' (SEQ ID NO: 9103)

5'-A<u>AG</u>AAAUGUUGUUA<u>C</u>G<u>A</u>UGGAGCct-3' (SEQ ID NO: 4484)

3'-<u>ACUUC</u>UUUACAACA<u>A</u>UGCUACCUCGGA-5' (SEQ ID NO: 6794)

C5-2140 Target:
5'-TGAAGAAATGTTGTTACGATGGAGCCT-3' (SEQ ID NO: 9104)

5'-A<u>G</u>AAAUGUUGUUA<u>C</u>G<u>A</u>UGGAGCCtg-3' (SEQ ID NO: 4485)

3'-<u>CUUC</u>UUUACAACAAUGCUACCUC<u>GGAC</u>-5' (SEQ ID NO: 6795)

C5-2141 Target:
5'-GAAGAAATGTTGTTACGATGGAGCCTG-3' (SEQ ID NO: 9105)

5'-G<u>A</u>AAUGUUGUUACG<u>A</u>UGGAGCCUgc-3' (SEQ ID NO: 4486)

3'-<u>UUC</u>UUUACAACAAUGCUACCUCG<u>GACG</u>-5' (SEQ ID NO: 6796)

C5-2142 Target:
5'-AAGAAATGTTGTTACGATGGAGCCTGC-3' (SEQ ID NO: 9106)

5'-A<u>A</u>AUGUUGUUACG<u>A</u>UGGAGCCUGcg-3' (SEQ ID NO: 4487)

3'-<u>UC</u>UUUACAACAAUGCU<u>A</u>CCUCGG<u>ACGC</u>-5' (SEQ ID NO: 6797)

C5-2143 Target:
5'-AGAAATGTTGTTACGATGGAGCCTGCG-3' (SEQ ID NO: 9107)

5'-A<u>UG</u>AUGAAACCUG<u>U</u>G<u>A</u>GCAGCGAgc-3' (SEQ ID NO: 4488)

3'-<u>AUUA</u>CUACUUUGGAC<u>A</u>C<u>U</u>CGUCGCUCG-5' (SEQ ID NO: 6798)

C5-2174 Target:
5'-TAATGATGAAACCTGTGAGCAGCGAGC-3' (SEQ ID NO: 9108)

5'-U<u>G</u>AUGAAACCUGUG<u>A</u>GCAGCGAGct-3' (SEQ ID NO: 4489)

3'-<u>UUA</u>CUACUUUGGAC<u>A</u>C<u>U</u>CGUCGCUCGA-5' (SEQ ID NO: 6799)

C5-2175 Target:
5'-AATGATGAAACCTGTGAGCAGCGAGCT-3' (SEQ ID NO: 9109)

5'-G<u>A</u>UGAAACCUGUG<u>A</u>G<u>C</u>AGCGAGCtg-3' (SEQ ID NO: 4490)

3'-<u>UAC</u>UACUUUGGACA<u>C</u>UCGUCGCUCGAC-5' (SEQ ID NO: 6800)

C5-2176 Target:
5'-ATGATGAAACCTGTGAGCAGCGAGCTG-3' (SEQ ID NO: 9110)

5'-A<u>UG</u>AAACCUGUGAG<u>CA</u>GCGAGCUgc-3' (SEQ ID NO: 4491)

3'-<u>ACUAC</u>UUUGGACACUC<u>G</u>UCGCUCG<u>ACG</u>-5' (SEQ ID NO: 6801)

TABLE 7-continued

Human Anti-C5 DsiRNAs Predicted to have >50% Knockdown Efficacy (Asymmetrics)

C5-2177 Target:
5'-TGATGAAACCTGTGAGCAGCGAGCTGC-3' (SEQ ID NO: 9111)

5'-UGAAACCUGUGAGCAGCGAGCUGca-3' (SEQ ID NO: 4492)

3'-CUACUUUGGACACUCGUCGCUCGACGU-5' (SEQ ID NO: 6802)

C5-2178 Target:
5'-GATGAAACCTGTGAGCAGCGAGCTGCA-3' (SEQ ID NO: 9112)

5'-GAAACCUGUGAGCAGCGAGCUGCac-3' (SEQ ID NO: 4493)

3'-UACUUUGGACACUCGUCGCUCGACGUG-5' (SEQ ID NO: 6803)

C5-2179 Target:
5'-ATGAAACCTGTGAGCAGCGAGCTGCAC-3' (SEQ ID NO: 9113)

5'-AAACCUGUGAGCAGCGAGCUGCAcg-3' (SEQ ID NO: 4494)

3'-ACUUUGGACACUCGUCGCUCGACGUGC-5' (SEQ ID NO: 6804)

C5-2180 Target:
5'-TGAAACCTGTGAGCAGCGAGCTGCACG-3' (SEQ ID NO: 9114)

5'-CCUGUGAGCAGCGAGCUGCACGgat-3' (SEQ ID NO: 4495)

3'-UUGGACACUCGUCGCUCGACGUGCCUA-5' (SEQ ID NO: 6805)

C5-2183 Target:
5'-AACCTGTGAGCAGCGAGCTGCACGGAT-3' (SEQ ID NO: 9115)

5'-CUGUGAGCAGCGAGCUGCACGGAtt-3' (SEQ ID NO: 4496)

3'-UGGACACUCGUCGCUCGACGUGCCUAA-5' (SEQ ID NO: 6806)

C5-2184 Target:
5'-ACCTGTGAGCAGCGAGCTGCACGGATT-3' (SEQ ID NO: 9116)

5'-UGUGAGCAGCGAGCUGCACGGAUta-3' (SEQ ID NO: 4497)

3'-GGACACUCGUCGCUCGACGUGCCUAAU-5' (SEQ ID NO: 6807)

C5-2185 Target:
5'-CCTGTGAGCAGCGAGCTGCACGGATTA-3' (SEQ ID NO: 9117)

5'-GUGAGCAGCGAGCUGCACGGAUUag-3' (SEQ ID NO: 4498)

3'-GACACUCGUCGCUCGACGUGCCUAAUC-5' (SEQ ID NO: 6808)

C5-2186 Target:
5'-CTGTGAGCAGCGAGCTGCACGGATTAG-3' (SEQ ID NO: 9118)

5'-UGAGCAGCGAGCUGCACGGAUUAgt-3' (SEQ ID NO: 4499)

3'-ACACUCGUCGCUCGACGUGCCUAAUCA-5' (SEQ ID NO: 6809)

C5-2187 Target:
5'-TGTGAGCAGCGAGCTGCACGGATTAGT-3' (SEQ ID NO: 9119)

5'-GAGCAGCGAGCUGCACGGAUUAGtt-3' (SEQ ID NO: 4500)

3'-CACUCGUCGCUCGACGUGCCUAAUCAA-5' (SEQ ID NO: 6810)

C5-2188 Target:
5'-GTGAGCAGCGAGCTGCACGGATTAGTT-3' (SEQ ID NO: 9120)

5'-AGCAGCGAGCUGCACGGAUUAGUtt-3' (SEQ ID NO: 4501)

3'-ACUCGUCGCUCGACGUGCCUAAUCAAA-5' (SEQ ID NO: 6811)

C5-2189 Target:
5'-TGAGCAGCGAGCTGCACGGATTAGTTT-3' (SEQ ID NO: 9121)

5'-GCAGCGAGCUGCACGGAUUAGUUta-3' (SEQ ID NO: 4502)

3'-CUCGUCGCUCGACGUGCCUAAUCAAAU-5' (SEQ ID NO: 6812)

C5-2190 Target:
5'-GAGCAGCGAGCTGCACGGATTAGTTTA-3' (SEQ ID NO: 9122)

5'-CAGCGAGCUGCACGGAUUAGUUUag-3' (SEQ ID NO: 4503)

3'-UCGUCGCUCGACGUGCCUAAUCAAAUC-5' (SEQ ID NO: 6813)

C5-2191 Target:
5'-AGCAGCGAGCTGCACGGATTAGTTTAG-3' (SEQ ID NO: 9123)

5'-AGCGAGCUGCACGGAUUAGUUUAgg-3' (SEQ ID NO: 4504)

3'-CGUCGCUCGACGUGCCUAAUCAAAUCC-5' (SEQ ID NO: 6814)

C5-2192 Target:
5'-GCAGCGAGCTGCACGGATTAGTTTAGG-3' (SEQ ID NO: 9124)

5'-GCGAGCUGCACGGAUUAGUUUAGgg-3' (SEQ ID NO: 4505)

3'-GUCGCUCGACGUGCCUAAUCAAAUCCC-5' (SEQ ID NO: 6815)

C5-2193 Target:
5'-CAGCGAGCTGCACGGATTAGTTTAGGG-3' (SEQ ID NO: 9125)

5'-GUCGUCGCAAGCCAGCUCCGUGCta-3' (SEQ ID NO: 4506)

3'-CACAGCAGCGUUCGGUCGAGGCACGAU-5' (SEQ ID NO: 6816)

C5-2251 Target:
5'-GTGTCGTCGCAAGCCAGCTCCGTGCTA-3' (SEQ ID NO: 9126)

5'-UCGUCGCAAGCCAGCUCCGUGCUaa-3' (SEQ ID NO: 4507)

3'-ACAGCAGCGUUCGGUCGAGGCACGAUU-5' (SEQ ID NO: 6817)

C5-2252 Target:
5'-TGTCGTCGCAAGCCAGCTCCGTGCTAA-3' (SEQ ID NO: 9127)

5'-CGUCGCAAGCCAGCUCCGUGCUAat-3' (SEQ ID NO: 4508)

3'-CAGCAGCGUUCGGUCGAGGCACGAUUA-5' (SEQ ID NO: 6818)

C5-2253 Target:
5'-GTCGTCGCAAGCCAGCTCCGTGCTAAT-3' (SEQ ID NO: 9128)

5'-GUCGCAAGCCAGCUCCGUGCUAAta-3' (SEQ ID NO: 4509)

3'-AGCAGCGUUCGGUCGAGGCACGAUUAU-5' (SEQ ID NO: 6819)

C5-2254 Target:
5'-TCGTCGCAAGCCAGCTCCGTGCTAATA-3' (SEQ ID NO: 9129)

5'-UCGCAAGCCAGCUCCGUGCUAAUat-3' (SEQ ID NO: 4510)

3'-GCAGCGUUCGGUCGAGGCACGAUUAUA-5' (SEQ ID NO: 6820)

C5-2255 Target:
5'-CGTCGCAAGCCAGCTCCGTGCTAATAT-3' (SEQ ID NO: 9130)

5'-CGCAAGCCAGCUCCGUGCUAAUAtc-3' (SEQ ID NO: 4511)

3'-CAGCGUUCGGUCGAGGCACGAUUAUAG-5' (SEQ ID NO: 6821)

C5-2256 Target:
5'-GTCGCAAGCCAGCTCCGTGCTAATATC-3' (SEQ ID NO: 9131)

5'-GCAAGCCAGCUCCGUGCUAAUAUct-3' (SEQ ID NO: 4512)

3'-AGCGUUCGGUCGAGGCACGAUUAUAGA-5' (SEQ ID NO: 6822)

C5-2257 Target:
5'-TCGCAAGCCAGCTCCGTGCTAATATCT-3' (SEQ ID NO: 9132)

5'-CAAGCCAGCUCCGUGCUAAUAUCtc-3' (SEQ ID NO: 4513)

3'-GCGUUCGGUCGAGGCACGAUUAUAGAG-5' (SEQ ID NO: 6823)

TABLE 7-continued

Human Anti-C5 DsiRNAs Predicted to have >50% Knockdown Efficacy (Asymmetrics)

C5-2258 Target:
5'-CGCAAGCCAGCTCCGTGCTAATATCTC-3' (SEQ ID NO: 9133)

5'-A<u>AG</u>CCAGCUCC<u>GUGC</u>UAAUAUCUct-3' (SEQ ID NO: 4514)

3'-<u>CGUUCGGU</u>CGAGGC<u>AC</u>GAUUAUA<u>GAGA</u>-5' (SEQ ID NO: 6824)

C5-2259 Target:
5'-GCAAGCCAGCTCCGTGCTAATATCTCT-3' (SEQ ID NO: 9134)

5'-A<u>GCC</u>AGCUCCGUGC<u>U</u>A<u>A</u>UAUCUCtc-3' (SEQ ID NO: 4515)

3'-<u>GUUCGGU</u>CGAGGCAC<u>G</u>AUUAUA<u>GAGAG</u>-5' (SEQ ID NO: 6825)

C5-2260 Target:
5'-CAAGCCAGCTCCGTGCTAATATCTCTC-3' (SEQ ID NO: 9135)

5'-C<u>AUGAAG</u>ACCCUG<u>UU</u>ACCAGUAAGc-3' (SEQ ID NO: 4516)

3'-<u>GUGUA</u>CUUCUGGGA<u>CA</u>AUGGUCA<u>UUCG</u>-5' (SEQ ID NO: 6826)

C5-2313 Target:
5'-CACATGAAGACCCTGTTACCAGTAAGC-3' (SEQ ID NO: 9136)

5'-A<u>UG</u>AAGACCCUGUU<u>AC</u>CAGUAAGca-3' (SEQ ID NO: 4517)

3'-<u>UGUA</u>CUUCUGGGAC<u>AA</u>UGGUCAU<u>UCGU</u>-5' (SEQ ID NO: 6827)

C5-2314 Target:
5'-ACATGAAGACCCTGTTACCAGTAAGCA-3' (SEQ ID NO: 9137)

5'-U<u>GA</u>AGACCCUGUU<u>ACC</u>AGUAAGCaa-3' (SEQ ID NO: 4518)

3'-<u>GUA</u>CUUCUGGGACA<u>AU</u>GGUCAUU<u>CGUU</u>-5' (SEQ ID NO: 6828)

C5-2315 Target:
5'-CATGAAGACCCTGTTACCAGTAAGCAA-3' (SEQ ID NO: 9138)

5'-A<u>AG</u>ACCCUGUUACC<u>AG</u>UAAGCAAgc-3' (SEQ ID NO: 4519)

3'-<u>ACUU</u>CUGGGACAAU<u>GG</u>UCAUUCG<u>UUCG</u>-5' (SEQ ID NO: 6829)

C5-2317 Target:
5'-TGAAGACCCTGTTACCAGTAAGCAAGC-3' (SEQ ID NO: 9139)

5'-A<u>GA</u>CCCUGUUACC<u>AG</u>UAAGCAAgcc-3' (SEQ ID NO: 4520)

3'-<u>CUUC</u>UGGGACAAUG<u>GU</u>CAUUCGU<u>UCGG</u>-5' (SEQ ID NO: 6830)

C5-2318 Target:
5'-GAAGACCCTGTTACCAGTAAGCAAGCC-3' (SEQ ID NO: 9140)

5'-G<u>AC</u>CCUGUUACCAG<u>UA</u>AGCAAGCca-3' (SEQ ID NO: 4521)

3'-<u>UUC</u>UGGGACAAUGG<u>UC</u>AUUCGUU<u>CGGU</u>-5' (SEQ ID NO: 6831)

C5-2319 Target:
5'-AAGACCCTGTTACCAGTAAGCAAGCCA-3' (SEQ ID NO: 9141)

5'-A<u>CCC</u>UGUUACCAGU<u>AA</u>GCAAGCCag-3' (SEQ ID NO: 4522)

3'-<u>UCU</u>GGGACAAUGGU<u>CA</u>UUCGUUC<u>GGUC</u>-5' (SEQ ID NO: 6832)

C5-2320 Target:
5'-AGACCCTGTTACCAGTAAGCAAGCCAG-3' (SEQ ID NO: 9142)

5'-C<u>CC</u>UGUUACCAGUA<u>AG</u>CAAGCCAga-3' (SEQ ID NO: 4523)

3'-<u>CUG</u>GGACAAUGGUC<u>AU</u>UCGUUCG<u>GUCU</u>-5' (SEQ ID NO: 6833)

C5-2321 Target:
5'-GACCCTGTTACCAGTAAGCAAGCCAGA-3' (SEQ ID NO: 9143)

5'-C<u>CU</u>GUUACCAGUA<u>AG</u>CAAGCCAGaa-3' (SEQ ID NO: 4524)

3'-<u>UGGGA</u>CAAUGGUCA<u>UU</u>CGUUCGG<u>UCUU</u>-5' (SEQ ID NO: 6834)

TABLE 7-continued

Human Anti-C5 DsiRNAs Predicted to have >50% Knockdown Efficacy (Asymmetrics)

C5-2322 Target:
5'-ACCCTGTTACCAGTAAGCAAGCCAGAA-3' (SEQ ID NO: 9144)

5'-C<u>UG</u>UUACCAGUAAG<u>C</u>AAGCCAGAaa-3' (SEQ ID NO: 4525)

3'-<u>GGGA</u>CAAUGGUCAU<u>UC</u>GUUCGGU<u>CUUU</u>-5' (SEQ ID NO: 6835)

C5-2323 Target:
5'-CCCTGTTACCAGTAAGCAAGCCAGAAA-3' (SEQ ID NO: 9145)

5'-U<u>GUU</u>ACCAGUAAGC<u>AA</u>GCCAGAAat-3' (SEQ ID NO: 4526)

3'-<u>GGA</u>CAAUGGUCAUU<u>CG</u>UUCGGUC<u>UUUA</u>-5' (SEQ ID NO: 6836)

C5-2324 Target:
5'-CCTGTTACCAGTAAGCAAGCCAGAAAT-3' (SEQ ID NO: 9146)

5'-G<u>UUA</u>CCAGUAAGC<u>AA</u>GCCAGAAAtt-3' (SEQ ID NO: 4527)

3'-<u>GACA</u>AUGGUCAUUC<u>GU</u>UCGGUCU<u>UUAA</u>-5' (SEQ ID NO: 6837)

C5-2325 Target:
5'-CTGTTACCAGTAAGCAAGCCAGAAATT-3' (SEQ ID NO: 9147)

5'-U<u>UA</u>CCAGUAAGCA<u>AGC</u>CAGAAAUtc-3' (SEQ ID NO: 4528)

3'-<u>ACA</u>AUGGUCAUUCG<u>UU</u>CGGUCUU<u>UAAG</u>-5' (SEQ ID NO: 6838)

C5-2326 Target:
5'-TGTTACCAGTAAGCAAGCCAGAAATTC-3' (SEQ ID NO: 9148)

5'-U<u>A</u>CCAGUAAGCAAG<u>CC</u>AGAAAUUcg-3' (SEQ ID NO: 4529)

3'-<u>CAA</u>UGGUCAUUCGU<u>UC</u>GGUCUUU<u>AAGC</u>-5' (SEQ ID NO: 6839)

C5-2327 Target:
5'-GTTACCAGTAAGCAAGCCAGAAATTCG-3' (SEQ ID NO: 9149)

5'-A<u>CC</u>AGUAAGCAAGC<u>C</u>A<u>G</u>AAAUUCgg-3' (SEQ ID NO: 4530)

3'-<u>AAU</u>GGUCAUUCGUU<u>CG</u>GUCUUUA<u>AGCC</u>-5' (SEQ ID NO: 6840)

C5-2328 Target:
5'-TTACCAGTAAGCAAGCCAGAAATTCGG-3' (SEQ ID NO: 9150)

5'-C<u>CA</u>GUAAGCAAGC<u>CA</u>GAAAUUCGga-3' (SEQ ID NO: 4531)

3'-<u>AUGG</u>UCAUUCGUUC<u>GG</u>UCUUUAA<u>GCCU</u>-5' (SEQ ID NO: 6841)

C5-2329 Target:
5'-TACCAGTAAGCAAGCCAGAAATTCGGA-3' (SEQ ID NO: 9151)

5'-C<u>AG</u>UAAGCAAGCC<u>AG</u>AAAUUCGGag-3' (SEQ ID NO: 4532)

3'-<u>UGGU</u>CAUUCGUUCG<u>GU</u>CUUUAAG<u>CCUC</u>-5' (SEQ ID NO: 6842)

C5-2330 Target:
5'-ACCAGTAAGCAAGCCAGAAATTCGGAG-3' (SEQ ID NO: 9152)

5'-A<u>GU</u>AAGCAAGCCAG<u>AAA</u>UUCGGAgt-3' (SEQ ID NO: 4533)

3'-<u>GGUC</u>AUUCGUUCGG<u>UC</u>UUUAAGC<u>CUCA</u>-5' (SEQ ID NO: 6843)

C5-2331 Target:
5'-CCAGTAAGCAAGCCAGAAATTCGGAGT-3' (SEQ ID NO: 9153)

5'-G<u>UA</u>AGCAAGCCAG<u>AAA</u>UUCGGAGtt-3' (SEQ ID NO: 4534)

3'-<u>GUC</u>AUUCGUUCGGU<u>CU</u>UUAAGCC<u>UCAA</u>-5' (SEQ ID NO: 6844)

C5-2332 Target:
5'-CAGTAAGCAAGCCAGAAATTCGGAGTT-3' (SEQ ID NO: 9154)

5'-U<u>AAG</u>CAAGCCAGA<u>AAU</u>UCGGAGUta-3' (SEQ ID NO: 4535)

3'-<u>UCA</u>UUCGUUCGGUC<u>UU</u>UAAGCCU<u>CAAU</u>-5' (SEQ ID NO: 6845)

TABLE 7-continued

Human Anti-C5 DsiRNAs Predicted to have >50% Knockdown Efficacy (Asymmetrics)

C5-2333 Target:
5'-AGTAAGCAAGCCAGAAATTCGGAGTTA-3' (SEQ ID NO: 9155)

5'-A<u>AGC</u>AAGCCAGAAA<u>UU</u>CGGAGUUat-3' (SEQ ID NO: 4536)

3'-<u>CAUUCGUUCGGUCUUUAAGCCUCAAUA</u>-5' (SEQ ID NO: 6846)

C5-2334 Target:
5'-GTAAGCAAGCCAGAAATTCGGAGTTAT-3' (SEQ ID NO: 9156)

5'-A<u>GC</u>AAGCCAGAAA<u>UU</u>CGGAGUUAtt-3' (SEQ ID NO: 4537)

3'-<u>AUUCGUUCGGUCUUUAAGCCUCAAUAA</u>-5' (SEQ ID NO: 6847)

C5-2335 Target:
5'-TAAGCAAGCCAGAAATTCGGAGTTATT-3' (SEQ ID NO: 9157)

5'-<u>GCA</u>AGCCAGAAA<u>UUC</u>GGAGUUAUtt-3' (SEQ ID NO: 4538)

3'-<u>UUCGUUCGGUCUUUAAGCCUCAAUAAA</u>-5' (SEQ ID NO: 6848)

C5-2336 Target:
5'-AAGCAAGCCAGAAATTCGGAGTTATTT-3' (SEQ ID NO: 9158)

5'-A<u>AGC</u>CAGAAAUUC<u>GG</u>AGUUAUUUtc-3' (SEQ ID NO: 4539)

3'-<u>CGUUCGGUCUUUAAGCCUCAAUAAAAG</u>-5' (SEQ ID NO: 6849)

C5-2338 Target:
5'-GCAAGCCAGAAATTCGGAGTTATTTTC-3' (SEQ ID NO: 9159)

5'-A<u>GCC</u>AGAAAUUC<u>GGA</u>GUUAUUUUcc-3' (SEQ ID NO: 4540)

3'-<u>GUUCGGUCUUUAAGCCUCAAUAAAAGG</u>-5' (SEQ ID NO: 6850)

C5-2339 Target:
5'-CAAGCCAGAAATTCGGAGTTATTTTCC-3' (SEQ ID NO: 9160)

5'-<u>GCC</u>AGAAAUUCGG<u>AG</u>UUAUUUUCca-3' (SEQ ID NO: 4541)

3'-<u>UUCGGUCUUUAAGCCUCAAUAAAAGGU</u>-5' (SEQ ID NO: 6851)

C5-2340 Target:
5'-AAGCCAGAAATTCGGAGTTATTTTCCA-3' (SEQ ID NO: 9161)

5'-C<u>C</u>AGAAAUUCGGA<u>G</u>UUAUUUUCCag-3' (SEQ ID NO: 4542)

3'-<u>UCGGUCUUUAAGCCUCAAUAAAAGGUC</u>-5' (SEQ ID NO: 6852)

C5-2341 Target:
5'-AGCCAGAAATTCGGAGTTATTTTCCAG-3' (SEQ ID NO: 9162)

5'-C<u>AGAAAUUCGGAGUUA</u>UUUUCCAga-3' (SEQ ID NO: 4543)

3'-<u>CGGUCUUUAAGCCUCAAUAAAAGGUCU</u>-5' (SEQ ID NO: 6853)

C5-2342 Target:
5'-GCCAGAAATTCGGAGTTATTTTCCAGA-3' (SEQ ID NO: 9163)

5'-A<u>GAAA</u>UUCGGAGUU<u>A</u>UUUUCCAGaa-3' (SEQ ID NO: 4544)

3'-<u>GGUCUUUAAGCCUCAAUAAAAGGUCUU</u>-5' (SEQ ID NO: 6854)

C5-2343 Target:
5'-CCAGAAATTCGGAGTTATTTTCCAGAA-3' (SEQ ID NO: 9164)

5'-G<u>AAA</u>UUCGGAGUU<u>AUUUU</u>CCAGAaa-3' (SEQ ID NO: 4545)

3'-<u>GUCUUUAAGCCUCAAUAAAAGGUCUUU</u>-5' (SEQ ID NO: 6855)

C5-2344 Target:
5'-CAGAAATTCGGAGTTATTTTCCAGAAA-3' (SEQ ID NO: 9165)

5'-<u>AAA</u>UUCGGAGUUA<u>UUUU</u>CCAGAAag-3' (SEQ ID NO: 4546)

3'-<u>UCUUUAAGCCUCAAUAAAAGGUCUUUC</u>-5' (SEQ ID NO: 6856)

C5-2345 Target:
5'-AGAAATTCGGAGTTATTTTCCAGAAAG-3' (SEQ ID NO: 9166)

5'-<u>AA</u>UUCGGAGUUAU<u>UUU</u>CCAGAAAgc-3' (SEQ ID NO: 4547)

3'-<u>CUUUAAGCCUCAAUAAAAGGUCUUUCG</u>-5' (SEQ ID NO: 6857)

C5-2346 Target:
5'-GAAATTCGGAGTTATTTTCCAGAAAGC-3' (SEQ ID NO: 9167)

5'-<u>A</u>UUCGGAGUUAUU<u>UU</u>CCAGAAAGct-3' (SEQ ID NO: 4548)

3'-<u>UUUAAGCCUCAAUAAAAGGUCUUUCGA</u>-5' (SEQ ID NO: 6858)

C5-2347 Target:
5'-AAATTCGGAGTTATTTTCCAGAAAGCT-3' (SEQ ID NO: 9168)

5'-<u>UU</u>CGGAGUUAUUUU<u>CC</u>AGAAAGCtg-3' (SEQ ID NO: 4549)

3'-<u>UUAAGCCUCAAUAAAAGGUCUUUCGAC</u>-5' (SEQ ID NO: 6859)

C5-2348 Target:
5'-AATTCGGAGTTATTTTCCAGAAAGCTG-3' (SEQ ID NO: 9169)

5'-<u>U</u>CGGAGUUAUUUU<u>CC</u>AGAAAGCUgg-3' (SEQ ID NO: 4550)

3'-<u>UAAGCCUCAAUAAAAGGUCUUUCGACC</u>-5' (SEQ ID NO: 6860)

C5-2349 Target:
5'-ATTCGGAGTTATTTTCCAGAAAGCTGG-3' (SEQ ID NO: 9170)

5'-<u>C</u>GGAGUUAUUUUCC<u>A</u>GAAAGCUGgt-3' (SEQ ID NO: 4551)

3'-<u>AAGCCUCAAUAAAAGGUCUUUCGACCA</u>-5' (SEQ ID NO: 6861)

C5-2350 Target:
5'-TTCGGAGTTATTTTCCAGAAAGCTGGT-3' (SEQ ID NO: 9171)

5'-<u>GG</u>AGUUAUUUUCC<u>AG</u>AAAGCUGGtt-3' (SEQ ID NO: 4552)

3'-<u>AGCCUCAAUAAAAGGUCUUUCGACCAA</u>-5' (SEQ ID NO: 6862)

C5-2351 Target:
5'-TCGGAGTTATTTTCCAGAAAGCTGGTT-3' (SEQ ID NO: 9172)

5'-<u>GA</u>GUUAUUUUCCAG<u>A</u>AAGCUGGUtg-3' (SEQ ID NO: 4553)

3'-<u>GCCUCAAUAAAAGGUCUUUCGACCAAC</u>-5' (SEQ ID NO: 6863)

C5-2352 Target:
5'-CGGAGTTATTTTCCAGAAAGCTGGTTG-3' (SEQ ID NO: 9173)

5'-A<u>GU</u>UAUUUUCCAG<u>AAA</u>GCUGGUUgt-3' (SEQ ID NO: 4554)

3'-<u>CCUCAAUAAAAGGUCUUUCGACCAACA</u>-5' (SEQ ID NO: 6864)

C5-2353 Target:
5'-GGAGTTATTTTCCAGAAAGCTGGTTGT-3' (SEQ ID NO: 9174)

5'-<u>GUU</u>AUUUUCCAGA<u>AAG</u>CUGGUUGtg-3' (SEQ ID NO: 4555)

3'-<u>CUCAAUAAAAGGUCUUUCGACCAACAC</u>-5' (SEQ ID NO: 6865)

C5-2354 Target:
5'-GAGTTATTTTCCAGAAAGCTGGTTGTG-3' (SEQ ID NO: 9175)

5'-<u>UUA</u>UUUUCCAGAAA<u>G</u>CUGGUUGUgg-3' (SEQ ID NO: 4556)

3'-<u>UCAAUAAAAGGUCUUUCGACCAACACC</u>-5' (SEQ ID NO: 6866)

C5-2355 Target:
5'-AGTTATTTTCCAGAAAGCTGGTTGTGG-3' (SEQ ID NO: 9176)

5'-<u>U</u>AUUUUCCAGAAA<u>GCU</u>GGUUGUGgg-3' (SEQ ID NO: 4557)

3'-<u>CAAUAAAAGGUCUUUCGACCAACACCC</u>-5' (SEQ ID NO: 6867)

TABLE 7-continued

Human Anti-C5 DsiRNAs Predicted to have >50% Knockdown Efficacy (Asymmetrics)

C5-2356 Target:
5'-GTTATTTTCCAGAAAGCTGGTTGTGGG-3' (SEQ ID NO: 9177)

5'-A<u>UUU</u>UCCAGAAAG<u>C</u>UGGUUGUGGga-3' (SEQ ID NO: 4558)

3'-<u>AAUAAA</u>AGGUCUUU<u>C</u>GACCAACA<u>CCCU</u>-5' (SEQ ID NO: 6868)

C5-2357 Target:
5'-TTATTTTCCAGAAAGCTGGTTGTGGGA-3' (SEQ ID NO: 9178)

5'-U<u>GGG</u>AAGUUCAUC<u>U</u>UGUUCCCAGAa-3' (SEQ ID NO: 4559)

3'-<u>ACACCC</u>UUCAAGUA<u>GA</u>ACAAGGG<u>U</u>CUU-5' (SEQ ID NO: 6869)

C5-2377 Target:
5'-TGTGGGAAGTTCATCTTGTTCCCAGAA-3' (SEQ ID NO: 9179)

5'-<u>GGG</u>AAGUUCAUCUU<u>G</u>UUCCCAGAag-3' (SEQ ID NO: 4560)

3'-<u>CACCC</u>UUCAAGUAG<u>AA</u>CAAGGGU<u>CUU</u>C-5' (SEQ ID NO: 6870)

C5-2378 Target:
5'-GTGGGAAGTTCATCTTGTTCCCAGAAG-3' (SEQ ID NO: 9180)

5'-<u>GG</u>A<u>A</u>GUUCAUCUUG<u>U</u>UCCCAGAAga-3' (SEQ ID NO: 4561)

3'-<u>ACCC</u>UUCAAGUAGA<u>AC</u>AAGGGUC<u>UUCU</u>-5' (SEQ ID NO: 6871)

C5-2379 Target:
5'-TGGGAAGTTCATCTTGTTCCCAGAAGA-3' (SEQ ID NO: 9181)

5'-<u>G</u>A<u>AG</u>UUCAUCUUGU<u>U</u>CCCAGAAGaa-3' (SEQ ID NO: 4562)

3'-<u>CCC</u>UUCAAGUAGAAC<u>A</u>AGGGUCUUC<u>UU</u>-5' (SEQ ID NO: 6872)

C5-2380 Target:
5'-GGGAAGTTCATCTTGTTCCCAGAAGAA-3' (SEQ ID NO: 9182)

5'-<u>A</u>AGUUCAUCUUGU<u>UCC</u>CAGAAGAaa-3' (SEQ ID NO: 4563)

3'-<u>CCU</u>UCAAGUAGAAC<u>A</u>AGGGUCUUC<u>UUU</u>-5' (SEQ ID NO: 6873)

C5-2381 Target:
5'-GGAAGTTCATCTTGTTCCCAGAAGAAA-3' (SEQ ID NO: 9183)

5'-A<u>GU</u>UCAUCUUGUU<u>CCC</u>AGAAGAAaa-3' (SEQ ID NO: 4564)

3'-<u>CUU</u>CAAGUAGAACA<u>AG</u>GGUCUUCU<u>UUU</u>-5' (SEQ ID NO: 6874)

C5-2382 Target:
5'-GAAGTTCATCTTGTTCCCAGAAGAAAA-3' (SEQ ID NO: 9184)

5'-G<u>UU</u>CAUCUUGUUCC<u>C</u>AGAAGAAAac-3' (SEQ ID NO: 4565)

3'-<u>UUC</u>AAGUAGAACAA<u>GGG</u>UCUUCU<u>UUUG</u>-5' (SEQ ID NO: 6875)

C5-2383 Target:
5'-AAGTTCATCTTGTTCCCAGAAGAAAAC-3' (SEQ ID NO: 9185)

5'-<u>UU</u>C<u>A</u>UCUUGUUCCC<u>A</u>GAAGAAAAca-3' (SEQ ID NO: 4566)

3'-<u>UCA</u>AGUAGAACAAG<u>GG</u>UCUUCU<u>UUUGU</u>-5' (SEQ ID NO: 6876)

C5-2384 Target:
5'-AGTTCATCTTGTTCCCAGAAGAAAACA-3' (SEQ ID NO: 9186)

5'-U<u>CA</u>UCUUGUUCCC<u>AGA</u>AGAAAACag-3' (SEQ ID NO: 4567)

3'-<u>CAA</u>GUAGAACAAGGG<u>U</u>CUUCUUUUGUC-5' (SEQ ID NO: 6877)

C5-2385 Target:
5'-GTTCATCTTGTTCCCAGAAGAAAACAG-3' (SEQ ID NO: 9187)

5'-C<u>AU</u>CUUGUUCCCAG<u>A</u>AGAAAACAgt-3' (SEQ ID NO: 4568)

3'-<u>AAG</u>UAGAACAAGGGUCUUCUUUUG<u>UCA</u>-5' (SEQ ID NO: 6878)

C5-2386 Target:
5'-TTCATCTTGTTCCCAGAAGAAAACAGT-3' (SEQ ID NO: 9188)

5'-A<u>UC</u>UUGUUCCCAG<u>AA</u>GAAAACAGtt-3' (SEQ ID NO: 4569)

3'-<u>AGUA</u>GAACAAGGGUC<u>U</u>UCUUUUGUCAA-5' (SEQ ID NO: 6879)

C5-2387 Target:
5'-TCATCTTGTTCCCAGAAGAAAACAGTT-3' (SEQ ID NO: 9189)

5'-U<u>C</u>UUGUUCCCAGA<u>AG</u>AAAACAGUtg-3' (SEQ ID NO: 4570)

3'-<u>GUAG</u>AACAAGGGUC<u>UUC</u>UUUUGUCAAC-5' (SEQ ID NO: 6880)

C5-2388 Target:
5'-CATCTTGTTCCCAGAAGAAAACAGTTG-3' (SEQ ID NO: 9190)

5'-C<u>UU</u>GUUCCCAGAAG<u>AAA</u>ACAGUUgc-3' (SEQ ID NO: 4571)

3'-<u>UAG</u>AACAAGGGUCUU<u>C</u>UUUUGUCAACG-5' (SEQ ID NO: 6881)

C5-2389 Target:
5'-ATCTTGTTCCCAGAAGAAAACAGTTGC-3' (SEQ ID NO: 9191)

5'-<u>UU</u>GUUCCCAGAAG<u>AAA</u>ACAGUUGca-3' (SEQ ID NO: 4572)

3'-<u>AGA</u>ACAAGGGUCUUC<u>U</u>UUUGUCAACGU-5' (SEQ ID NO: 6882)

C5-2390 Target:
5'-TCTTGTTCCCAGAAGAAAACAGTTGCA-3' (SEQ ID NO: 9192)

5'-U<u>G</u>UUCCCAGAAG<u>AAA</u>ACAGUUGCag-3' (SEQ ID NO: 4573)

3'-<u>GAA</u>CAAGGGUCUUC<u>UUU</u>UGUCAA<u>CGUC</u>-5' (SEQ ID NO: 6883)

C5-2391 Target:
5'-CTTGTTCCCAGAAGAAAACAGTTGCAG-3' (SEQ ID NO: 9193)

5'-G<u>UU</u>CCCAGAAGAAA<u>C</u>AGUUGCAgt-3' (SEQ ID NO: 4574)

3'-<u>AAC</u>AAGGGUCUUC<u>UUU</u>UGUCAACGUCA-5' (SEQ ID NO: 6884)

C5-2392 Target:
5'-TTGTTCCCAGAAGAAAACAGTTGCAGT-3' (SEQ ID NO: 9194)

5'-<u>UU</u>CCCAGAAGAAA<u>C</u>AGUUGCAGtt-3' (SEQ ID NO: 4575)

3'-<u>ACA</u>AGGGUCUUCUUUUGUCAACGUCAA-5' (SEQ ID NO: 6885)

C5-2393 Target:
5'-TGTTCCCAGAAGAAAACAGTTGCAGTT-3' (SEQ ID NO: 9195)

5'-U<u>CC</u>CAGAAGAAAA<u>C</u>AGUUGCAGUtt-3' (SEQ ID NO: 4576)

3'-<u>CAA</u>GGGUCUUCUUUUGUCAACGUC<u>AAA</u>-5' (SEQ ID NO: 6886)

C5-2394 Target:
5'-GTTCCCAGAAGAAAACAGTTGCAGTTT-3' (SEQ ID NO: 9196)

5'-<u>CCC</u>AGAAGAAAAC<u>A</u>GUUGCAGUUtg-3' (SEQ ID NO: 4577)

3'-<u>AAGG</u>GUCUUCUUUUG<u>U</u>CAACGUC<u>AAAC</u>-5' (SEQ ID NO: 6887)

C5-2395 Target:
5'-TTCCCAGAAGAAAACAGTTGCAGTTTG-3' (SEQ ID NO: 9197)

5'-C<u>CA</u>GAAGAAAACAG<u>U</u>UGCAGUUUgc-3' (SEQ ID NO: 4578)

3'-<u>AGGG</u>UCUUCUUUUGU<u>C</u>AACGUC<u>AAACG</u>-5' (SEQ ID NO: 6888)

C5-2396 Target:
5'-TCCCAGAAGAAAACAGTTGCAGTTTGC-3' (SEQ ID NO: 9198)

5'-C<u>AG</u>AAGAAAACAG<u>UU</u>GCAGUUUGcc-3' (SEQ ID NO: 4579)

3'-<u>GGG</u>UCUUCUUUUGU<u>CAA</u>CGUCAA<u>ACGG</u>-5' (SEQ ID NO: 6889)

TABLE 7-continued

Human Anti-C5 DsiRNAs Predicted to have >50% Knockdown Efficacy (Asymmetrics)

C5-2397 Target:
5'-CCCAGAAGAAAACAGTTGCAGTTTGCC-3' (SEQ ID NO: 9199)

5'-A<u>GA</u>AGAAAACAGU<u>UGC</u>AGUUUGCcc-3' (SEQ ID NO: 4580)

3'-<u>GGUC</u>UUCUUUUGUC<u>AA</u>CGUCAAAC<u>GGG</u>-5' (SEQ ID NO: 6890)

C5-2398 Target:
5'-CCAGAAGAAAACAGTTGCAGTTTGCCC-3' (SEQ ID NO: 9200)

5'-G<u>AA</u>GAAAACAGUUG<u>C</u>AGUUUGCCct-3' (SEQ ID NO: 4581)

3'-<u>GUC</u>UUCUUUUGUC<u>AA</u>CGUCAAAC<u>GGGA</u>-5' (SEQ ID NO: 6891)

C5-2399 Target:
5'-CAGAAGAAAACAGTTGCAGTTTGCCCT-3' (SEQ ID NO: 9201)

5'-A<u>AG</u>AAAACAGUUGC<u>A</u>GUUUGCCCta-3' (SEQ ID NO: 4582)

3'-<u>UCUU</u>CUUUUGUCAACGUCAAACGGAU-5' (SEQ ID NO: 6892)

C5-2400 Target:
5'-AGAAGAAAACAGTTGCAGTTTGCCCTA-3' (SEQ ID NO: 9202)

5'-A<u>GA</u>AAACAGUUGC<u>A</u>GUUUGCCCUac-3' (SEQ ID NO: 4583)

3'-<u>CUUC</u>UUUUGUCAACGU<u>C</u>AAACGGGAUG-5' (SEQ ID NO: 6893)

C5-2401 Target:
5'-GAAGAAAACAGTTGCAGTTTGCCCTAC-3' (SEQ ID NO: 9203)

5'-G<u>A</u>AAACAGUUGC<u>A</u>GUUUGCCCAcc-3' (SEQ ID NO: 4584)

3'-<u>UUC</u>UUUUGUCAACGU<u>C</u>AAACGGGAUGG-5' (SEQ ID NO: 6894)

C5-2402 Target:
5'-AAGAAAACAGTTGCAGTTTGCCCTACC-3' (SEQ ID NO: 9204)

5'-A<u>AA</u>ACAGUUGCAGU<u>UUG</u>CCCUACct-3' (SEQ ID NO: 4585)

3'-<u>UCUU</u>UUGUCAACGU<u>C</u>AAACGGGAUGGA-5' (SEQ ID NO: 6895)

C5-2403 Target:
5'-AGAAAACAGTTGCAGTTTGCCCTACCT-3' (SEQ ID NO: 9205)

5'-A<u>AA</u>CAGUUGCAGU<u>UUG</u>CCCUACCtg-3' (SEQ ID NO: 4586)

3'-<u>CUUU</u>UGUCAACGUC<u>AA</u>ACGGGAU<u>GGA</u>C-5' (SEQ ID NO: 6896)

C5-2404 Target:
5'-GAAAACAGTTGCAGTTTGCCCTACCTG-3' (SEQ ID NO: 9206)

5'-A<u>AC</u>AGUUGCAGUUU<u>GC</u>CCUACCUga-3' (SEQ ID NO: 4587)

3'-<u>UUUU</u>GUCAACGUCA<u>AA</u>CGGGAUGG<u>ACU</u>-5' (SEQ ID NO: 6897)

C5-2405 Target:
5'-AAAACAGTTGCAGTTTGCCCTACCTGA-3' (SEQ ID NO: 9207)

5'-A<u>C</u>AGUUGCAGUUUG<u>CC</u>CUACCUGat-3' (SEQ ID NO: 4588)

3'-<u>UUUG</u>UCAACGUCAAACGGGAUGG<u>ACUA</u>-5' (SEQ ID NO: 6898)

C5-2406 Target:
5'-AAACAGTTGCAGTTTGCCCTACCTGAT-3' (SEQ ID NO: 9208)

5'-C<u>AG</u>UUGCAGUUUG<u>CCC</u>UACCUGAtt-3' (SEQ ID NO: 4589)

3'-<u>UUGU</u>CAACGUCAAA<u>C</u>GGGAUGG<u>ACUAA</u>-5' (SEQ ID NO: 6899)

C5-2407 Target:
5'-AACAGTTGCAGTTTGCCCTACCTGATT-3' (SEQ ID NO: 9209)

5'-A<u>GU</u>UGCAGUUUGC<u>CCC</u>UACCUGAUtc-3' (SEQ ID NO: 4590)

3'-<u>UGUC</u>AACGUCAAAC<u>GGG</u>AUGGACU<u>AAG</u>-5' (SEQ ID NO: 6900)

TABLE 7-continued

Human Anti-C5 DsiRNAs Predicted to have >50% Knockdown Efficacy (Asymmetrics)

C5-2408 Target:
5'-ACAGTTGCAGTTTGCCCTACCTGATTC-3' (SEQ ID NO: 9210)

5'-G<u>UU</u>GCAGUUUGCC<u>CUA</u>CCUGAUUct-3' (SEQ ID NO: 4591)

3'-<u>GUC</u>AACGUCAAACGGG<u>A</u>UGGACU<u>AAGA</u>-5' (SEQ ID NO: 6901)

C5-2409 Target:
5'-CAGTTGCAGTTTGCCCTACCTGATTCT-3' (SEQ ID NO: 9211)

5'-<u>UUG</u>CAGUUUGCCC<u>UA</u>CCUGAUUCtc-3' (SEQ ID NO: 4592)

3'-<u>UCAA</u>CGUCAAACGGG<u>A</u>UGGACU<u>AAGAG</u>-5' (SEQ ID NO: 6902)

C5-2410 Target:
5'-AGTTGCAGTTTGCCCTACCTGATTCTC-3' (SEQ ID NO: 9212)

5'-<u>UGC</u>AGUUUGCCCUA<u>CC</u>UGAUUCUct-3' (SEQ ID NO: 4593)

3'-<u>CAAC</u>GUCAAACGGG<u>AU</u>GGACUAA<u>GAGA</u>-5' (SEQ ID NO: 6903)

C5-2411 Target:
5'-GTTGCAGTTTGCCCTACCTGATTCTCT-3' (SEQ ID NO: 9213)

5'-G<u>CA</u>GUUUGCCCUA<u>CC</u>UGAUUCUCta-3' (SEQ ID NO: 4594)

3'-<u>AACG</u>UCAAACGGGAU<u>G</u>GACUAAG<u>AGAU</u>-5' (SEQ ID NO: 6904)

C5-2412 Target:
5'-TTGCAGTTTGCCCTACCTGATTCTCTA-3' (SEQ ID NO: 9214)

5'-<u>CA</u>GUUUGCCCUAC<u>CUG</u>AUUCUCUaa-3' (SEQ ID NO: 4595)

3'-<u>ACGU</u>CAAACGGGAU<u>GGA</u>CUAAGAG<u>AUU</u>-5' (SEQ ID NO: 6905)

C5-2413 Target:
5'-TGCAGTTTGCCCTACCTGATTCTCTAA-3' (SEQ ID NO: 9215)

5'-<u>A</u>GUUUGCCCUACC<u>UG</u>AUUCUCUAac-3' (SEQ ID NO: 4596)

3'-<u>CGUC</u>AAACGGGAUG<u>GA</u>CUAAGAGAUUG-5' (SEQ ID NO: 6906)

C5-2414 Target:
5'-GCAGTTTGCCCTACCTGATTCTCTAAC-3' (SEQ ID NO: 9216)

5'-G<u>UU</u>UGCCCUACCUG<u>AU</u>UCUCUAAcc-3' (SEQ ID NO: 4597)

3'-<u>GUC</u>AAACGGGAUGG<u>AC</u>UAAGAGAU<u>UGG</u>-5' (SEQ ID NO: 6907)

C5-2415 Target:
5'-CAGTTTGCCCTACCTGATTCTCTAACC-3' (SEQ ID NO: 9217)

5'-GG<u>C</u>AAAGGUGUUC<u>AAA</u>GAUGUCUtc-3' (SEQ ID NO: 4598)

3'-<u>UUCC</u>GUUUCCACAAG<u>UUU</u>CUACA<u>GAAG</u>-5' (SEQ ID NO: 6908)

C5-2502 Target:
5'-AAGGCAAAGGTGTTCAAAGATGTCTTC-3' (SEQ ID NO: 9218)

5'-G<u>CA</u>AAGGUGUUCA<u>AAG</u>AUGUCUUcc-3' (SEQ ID NO: 4599)

3'-<u>UCCG</u>UUUCCACAAGUUU<u>C</u>UACAGAAGG-5' (SEQ ID NO: 6909)

C5-2503 Target:
5'-AGGCAAAGGTGTTCAAAGATGTCTTCC-3' (SEQ ID NO: 9219)

5'-C<u>AA</u>AGGUGUUCAA<u>AG</u>AUGUCUUCct-3' (SEQ ID NO: 4600)

3'-<u>CCGU</u>UUCCACAAGUUU<u>C</u>UACAGAAGGA-5' (SEQ ID NO: 6910)

C5-2504 Target:
5'-GGCAAAGGTGTTCAAAGATGTCTTCCT-3' (SEQ ID NO: 9220)

5'-A<u>AA</u>GGUGUUCAAAG<u>AU</u>GUCUUCCtg-3' (SEQ ID NO: 4601)

3'-<u>CGUU</u>UCCACAAGUUU<u>CU</u>ACAGAAG<u>GAC</u>-5' (SEQ ID NO: 6911)

TABLE 7-continued

Human Anti-C5 DsiRNAs Predicted to have >50% Knockdown Efficacy (Asymmetrics)

```
C5-2505 Target:
5'-GCAAAGGTGTTCAAAGATGTCTTCCTG-3' (SEQ ID NO: 9221)

5'-AAGGUGUUCAAAGAUGUCUUCCUGgg-3' (SEQ ID NO: 4602)

3'-GUUUCCACAAGUUUCUACAGAAGGACC-5' (SEQ ID NO: 6912)

C5-2506 Target:
5'-CAAAGGTGTTCAAAGATGTCTTCCTGG-3' (SEQ ID NO: 9222)

5'-AGGUGUUCAAAGAUGUCUUCCUGGa-3' (SEQ ID NO: 4603)

3'-UUUCCACAAGUUUCUACAGAAGGACCU-5' (SEQ ID NO: 6913)

C5-2507 Target:
5'-AAAGGTGTTCAAAGATGTCTTCCTGGA-3' (SEQ ID NO: 9223)

5'-GGUGUUCAAAGAUGUCUUCCUGGaa-3' (SEQ ID NO: 4604)

3'-UUCCACAAGUUUCUACAGAAGGACCUU-5' (SEQ ID NO: 6914)

C5-2508 Target:
5'-AAGGTGTTCAAAGATGTCTTCCTGGAA-3' (SEQ ID NO: 9224)

5'-GUGUUCAAAGAUGUCUUCCUGGAaa-3' (SEQ ID NO: 4605)

3'-UCCACAAGUUUCUACAGAAGGACCUUU-5' (SEQ ID NO: 6915)

C5-2509 Target:
5'-AGGTGTTCAAAGATGTCTTCCTGGAAA-3' (SEQ ID NO: 9225)

5'-UGUUCAAAGAUGUCUUCCUGGAaat-3' (SEQ ID NO: 4606)

3'-CCACAAGUUUCUACAGAAGGACCUUUA-5' (SEQ ID NO: 6916)

C5-2510 Target:
5'-GGTGTTCAAAGATGTCTTCCTGGAAAT-3' (SEQ ID NO: 9226)

5'-GUUCAAAGAUGUCUUCCUGGAAAtg-3' (SEQ ID NO: 4607)

3'-CACAAGUUUCUACAGAAGGACCUUUAC-5' (SEQ ID NO: 6917)

C5-2511 Target:
5'-GTGTTCAAAGATGTCTTCCTGGAAATG-3' (SEQ ID NO: 9227)

5'-UUCAAAGAUGUCUUCCUGGAAAUga-3' (SEQ ID NO: 4608)

3'-ACAAGUUUCUACAGAAGGACCUUUACU-5' (SEQ ID NO: 6918)

C5-2512 Target:
5'-TGTTCAAAGATGTCTTCCTGGAAATGA-3' (SEQ ID NO: 9228)

5'-UCAAAGAUGUCUUCCUGGAAAUGaa-3' (SEQ ID NO: 4609)

3'-CAAGUUUCUACAGAAGGACCUUUACUU-5' (SEQ ID NO: 6919)

C5-2513 Target:
5'-GTTCAAAGATGTCTTCCTGGAAATGAA-3' (SEQ ID NO: 9229)

5'-CAAAGAUGUCUUCCUGGAAAUGAat-3' (SEQ ID NO: 4610)

3'-AAGUUUCUACAGAAGGACCUUUACUUA-5' (SEQ ID NO: 6920)

C5-2514 Target:
5'-TTCAAAGATGTCTTCCTGGAAATGAAT-3' (SEQ ID NO: 9230)

5'-AAAGAUGUCUUCCUGGAAAUGAAta-3' (SEQ ID NO: 4611)

3'-AGUUUCUACAGAAGGACCUUUACUUAU-5' (SEQ ID NO: 6921)

C5-2515 Target:
5'-TCAAAGATGTCTTCCTGGAAATGAATA-3' (SEQ ID NO: 9231)

5'-AAGAUGUCUUCCUGGAAAUGAAUat-3' (SEQ ID NO: 4612)

3'-GUUUCUACAGAAGGACCUUUACUUAUA-5' (SEQ ID NO: 6922)

C5-2516 Target:
5'-CAAAGATGTCTTCCTGGAAATGAATAT-3' (SEQ ID NO: 9232)

5'-AGAUGUCUUCCUGGAAAUGAAUAta-3' (SEQ ID NO: 4613)

3'-UUUCUACAGAAGGACCUUUACUUAUAU-5' (SEQ ID NO: 6923)

C5-2517 Target:
5'-AAAGATGTCTTCCTGGAAATGAATATA-3' (SEQ ID NO: 9233)

5'-AUGUCUUCCUGGAAAUGAAUAUAcc-3' (SEQ ID NO: 4614)

3'-UCUACAGAAGGACCUUUACUUAUAUGG-5' (SEQ ID NO: 6924)

C5-2519 Target:
5'-AGATGTCTTCCTGGAAATGAATATACC-3' (SEQ ID NO: 9234)

5'-UGUCUUCCUGGAAAUGAAUAUACca-3' (SEQ ID NO: 4615)

3'-CUACAGAAGGACCUUUACUUAUAUGGU-5' (SEQ ID NO: 6925)

C5-2520 Target:
5'-GATGTCTTCCTGGAAATGAATATACCA-3' (SEQ ID NO: 9235)

5'-GUCUUCCUGGAAAUGAAUAUACCat-3' (SEQ ID NO: 4616)

3'-UACAGAAGGACCUUUACUUAUAUGGUA-5' (SEQ ID NO: 6926)

C5-2521 Target:
5'-ATGTCTTCCTGGAAATGAATATACCAT-3' (SEQ ID NO: 9236)

5'-UCUUCCUGGAAAUGAAUAUACCAta-3' (SEQ ID NO: 4617)

3'-ACAGAAGGACCUUUACUUAUAUGGUAU-5' (SEQ ID NO: 6927)

C5-2522 Target:
5'-TGTCTTCCTGGAAATGAATATACCATA-3' (SEQ ID NO: 9237)

5'-CUUCCUGGAAAUGAAUAUACCAUat-3' (SEQ ID NO: 4618)

3'-CAGAAGGACCUUUACUUAUAUGGUAUA-5' (SEQ ID NO: 6928)

C5-2523 Target:
5'-GTCTTCCTGGAAATGAATATACCATAT-3' (SEQ ID NO: 9238)

5'-UUCCUGGAAAUGAAUAUACCAUAtt-3' (SEQ ID NO: 4619)

3'-AGAAGGACCUUUACUUAUAUGGUAUAA-5' (SEQ ID NO: 6929)

C5-2524 Target:
5'-TCTTCCTGGAAATGAATATACCATATT-3' (SEQ ID NO: 9239)

5'-UCCUGGAAAUGAAUAUACCAUAUtc-3' (SEQ ID NO: 4620)

3'-GAAGGACCUUUACUUAUAUGGUAUAAG-5' (SEQ ID NO: 6930)

C5-2525 Target:
5'-CTTCCTGGAAATGAATATACCATATTC-3' (SEQ ID NO: 9240)

5'-CCUGGAAAUGAAUAUACCAUAUUct-3' (SEQ ID NO: 4621)

3'-AAGGACCUUUACUUAUAUGGUAUAAGA-5' (SEQ ID NO: 6931)

C5-2526 Target:
5'-TTCCTGGAAATGAATATACCATATTCT-3' (SEQ ID NO: 9241)

5'-UAUACCAUAUUCUGUUGUACGAGga-3' (SEQ ID NO: 4622)

3'-UUAUAUGGUAUAAGACAACAUGCUCCU-5' (SEQ ID NO: 6932)

C5-2538 Target:
5'-AATATACCATATTCTGTTGTACGAGGA-3' (SEQ ID NO: 9242)

5'-AUACCAUAUUCUGUUGUACGAGGag-3' (SEQ ID NO: 4623)

3'-UAUAUGGUAUAAGACAACAUGCUCCUC-5' (SEQ ID NO: 6933)
```

TABLE 7-continued

Human Anti-C5 DsiRNAs Predicted to have >50% Knockdown Efficacy (Asymmetrics)

```
C5-2539 Target:
5'-ATATACCATATTCTGTTGTACGAGGAG-3' (SEQ ID NO: 9243)

5'-UACCAUAUUCUGUUGUACGAGGAga-3' (SEQ ID NO: 4624)

3'-AUAUGGUAUAAGACAACAUGCUCCUCU-5' (SEQ ID NO: 6934)

C5-2540 Target:
5'-TATACCATATTCTGTTGTACGAGGAGA-3' (SEQ ID NO: 9244)

5'-ACCAUAUUCUGUUGUACGAGGAGAaa-3' (SEQ ID NO: 4625)

3'-UAUGGUAUAAGACAACAUGCUCCUCUU-5' (SEQ ID NO: 6935)

C5-2541 Target:
5'-ATACCATATTCTGTTGTACGAGGAGAA-3' (SEQ ID NO: 9245)

5'-CCAUAUUCUGUUGUACGAGGAGAac-3' (SEQ ID NO: 4626)

3'-AUGGUAUAAGACAACAUGCUCCUCUUG-5' (SEQ ID NO: 6936)

C5-2542 Target:
5'-TACCATATTCTGTTGTACGAGGAGAAC-3' (SEQ ID NO: 9246)

5'-CAUAUUCUGUUGUACGAGGAGAAca-3' (SEQ ID NO: 4627)

3'-UGGUAUAAGACAACAUGCUCCUCUUGU-5' (SEQ ID NO: 6937)

C5-2543 Target:
5'-ACCATATTCTGTTGTACGAGGAGAACA-3' (SEQ ID NO: 9247)

5'-AUAUUCUGUUGUACGAGGAGAACag-3' (SEQ ID NO: 4628)

3'-GGUAUAAGACAACAUGCUCCUCUUGUC-5' (SEQ ID NO: 6938)

C5-2544 Target:
5'-CCATATTCTGTTGTACGAGGAGAACAG-3' (SEQ ID NO: 9248)

5'-UAUUCUGUUGUACGAGGAGAACAga-3' (SEQ ID NO: 4629)

3'-GUAUAAGACAACAUGCUCCUCUUGUCU-5' (SEQ ID NO: 6939)

C5-2545 Target:
5'-CATATTCTGTTGTACGAGGAGAACAGA-3' (SEQ ID NO: 9249)

5'-AUUCUGUUGUACGAGGAGAACAGat-3' (SEQ ID NO: 4630)

3'-UAUAAGACAACAUGCUCCUCUUGUCUA-5' (SEQ ID NO: 6940)

C5-2546 Target:
5'-ATATTCTGTTGTACGAGGAGAACAGAT-3' (SEQ ID NO: 9250)

5'-UUCUGUUGUACGAGGAGAACAGAtc-3' (SEQ ID NO: 4631)

3'-AUAAGACAACAUGCUCCUCUUGUCUAG-5' (SEQ ID NO: 6941)

C5-2547 Target:
5'-TATTCTGTTGTACGAGGAGAACAGATC-3' (SEQ ID NO: 9251)

5'-UCUGUUGUACGAGGAGAACAGAUcc-3' (SEQ ID NO: 4632)

3'-UAAGACAACAUGCUCCUCUUGUCUAGG-5' (SEQ ID NO: 6942)

C5-2548 Target:
5'-ATTCTGTTGTACGAGGAGAACAGATCC-3' (SEQ ID NO: 9252)

5'-CUGUUGUACGAGGAGAACAGAUCca-3' (SEQ ID NO: 4633)

3'-AAGACAACAUGCUCCUCUUGUCUAGGU-5' (SEQ ID NO: 6943)

C5-2549 Target:
5'-TTCTGTTGTACGAGGAGAACAGATCCA-3' (SEQ ID NO: 9253)

5'-UGUUGUACGAGGAGAACAGAUCCaa-3' (SEQ ID NO: 4634)

3'-AGACAACAUGCUCCUCUUGUCUAGGUU-5' (SEQ ID NO: 6944)

C5-2550 Target:
5'-TCTGTTGTACGAGGAGAACAGATCCAA-3' (SEQ ID NO: 9254)

5'-GAACUGUUUACAACUAUAGGACUtc-3' (SEQ ID NO: 4635)

3'-UCCUUGACAAAUGUUGAUAUCCUGAAG-5' (SEQ ID NO: 6945)

C5-2582 Target:
5'-AGGAACTGTTTACAACTATAGGACTTC-3' (SEQ ID NO: 9255)

5'-AACUGUUUACAACUAUAGGACUUct-3' (SEQ ID NO: 4636)

3'-CCUUGACAAAUGUUGAUAUCCUGAAGA-5' (SEQ ID NO: 6946)

C5-2583 Target:
5'-GGAACTGTTTACAACTATAGGACTTCT-3' (SEQ ID NO: 9256)

5'-ACUGUUUACAACUAUAGGACUUCtg-3' (SEQ ID NO: 4637)

3'-CUUGACAAAUGUUGAUAUCCUGAAGAC-5' (SEQ ID NO: 6947)

C5-2584 Target:
5'-GAACTGTTTACAACTATAGGACTTCTG-3' (SEQ ID NO: 9257)

5'-CUGUUUACAACUAUAGGACUUCUgg-3' (SEQ ID NO: 4638)

3'-UUGACAAAUGUUGAUAUCCUGAAGACC-5' (SEQ ID NO: 6948)

C5-2585 Target:
5'-AACTGTTTACAACTATAGGACTTCTGG-3' (SEQ ID NO: 9258)

5'-UGUUUACAACUAUAGGACUUCUGgg-3' (SEQ ID NO: 4639)

3'-UGACAAAUGUUGAUAUCCUGAAGACCC-5' (SEQ ID NO: 6949)

C5-2586 Target:
5'-ACTGTTTACAACTATAGGACTTCTGGG-3' (SEQ ID NO: 9259)

5'-GUUUACAACUAUAGGACUUCUGGga-3' (SEQ ID NO: 4640)

3'-GACAAAUGUUGAUAUCCUGAAGACCCU-5' (SEQ ID NO: 6950)

C5-2587 Target:
5'-CTGTTTACAACTATAGGACTTCTGGGA-3' (SEQ ID NO: 9260)

5'-UUUACAACUAUAGGACUUCUGGGat-3' (SEQ ID NO: 4641)

3'-ACAAAUGUUGAUAUCCUGAAGACCCUA-5' (SEQ ID NO: 6951)

C5-2588 Target:
5'-TGTTTACAACTATAGGACTTCTGGGAT-3' (SEQ ID NO: 9261)

5'-UUACAACUAUAGGACUUCUGGGAtg-3' (SEQ ID NO: 4642)

3'-CAAAUGUUGAUAUCCUGAAGACCCUAC-5' (SEQ ID NO: 6952)

C5-2589 Target:
5'-GTTTACAACTATAGGACTTCTGGGATG-3' (SEQ ID NO: 9262)

5'-UACAACUAUAGGACUUCUGGGAUgc-3' (SEQ ID NO: 4643)

3'-AAAUGUUGAUAUCCUGAAGACCCUACG-5' (SEQ ID NO: 6953)

C5-2590 Target:
5'-TTTACAACTATAGGACTTCTGGGATGC-3' (SEQ ID NO: 9263)

5'-ACAACUAUAGGACUUCUGGGAUGca-3' (SEQ ID NO: 4644)

3'-AAUGUUGAUAUCCUGAAGACCCUACGU-5' (SEQ ID NO: 6954)

C5-2591 Target:
5'-TTACAACTATAGGACTTCTGGGATGCA-3' (SEQ ID NO: 9264)

5'-CAACUAUAGGACUUCUGGGAUGCag-3' (SEQ ID NO: 4645)

3'-AUGUUGAUAUCCUGAAGACCCUACGUC-5' (SEQ ID NO: 6955)
```

TABLE 7-continued

Human Anti-C5 DsiRNAs Predicted to have >50% Knockdown Efficacy (Asymmetrics)

C5-2592 Target:
5'-TACAACTATAGGACTTCTGGGATGCAG-3' (SEQ ID NO: 9265)

5'-A<u>ACUAUAGGACUUCUGGGAUGCAgt</u>-3' (SEQ ID NO: 4646)

3'-<u>UGUUGAUAUCCUGAAGACCCUACGUCA</u>-5' (SEQ ID NO: 6956)

C5-2593 Target:
5'-ACAACTATAGGACTTCTGGGATGCAGT-3' (SEQ ID NO: 9266)

5'-A<u>CUAUAGGACUUCUGGGAUGCAGtt</u>-3' (SEQ ID NO: 4647)

3'-<u>GUUGAUAUCCUGAAGACCCUACGUCAA</u>-5' (SEQ ID NO: 6957)

C5-2594 Target:
5'-CAACTATAGGACTTCTGGGATGCAGTT-3' (SEQ ID NO: 9267)

5'-<u>CUAUAGGACUUCUGGGAUGCAGUtc</u>-3' (SEQ ID NO: 4648)

3'-<u>UUGAUAUCCUGAAGACCCUACGUCAAG</u>-5' (SEQ ID NO: 6958)

C5-2595 Target:
5'-AACTATAGGACTTCTGGGATGCAGTTC-3' (SEQ ID NO: 9268)

5'-<u>UAUAGGACUUCUGGGAUGCAGUUct</u>-3' (SEQ ID NO: 4649)

3'-<u>UGAUAUCCUGAAGACCCUACGUCAAGA</u>-5' (SEQ ID NO: 6959)

C5-2596 Target:
5'-ACTATAGGACTTCTGGGATGCAGTTCT-3' (SEQ ID NO: 9269)

5'-A<u>UAGGACUUCUGGGAUGCAGUUCtg</u>-3' (SEQ ID NO: 4650)

3'-<u>GAUAUCCUGAAGACCCUACGUCAAGAC</u>-5' (SEQ ID NO: 6960)

C5-2597 Target:
5'-CTATAGGACTTCTGGGATGCAGTTCTG-3' (SEQ ID NO: 9270)

5'-<u>UAGGACUUCUGGGAUGCAGUUCUgt</u>-3' (SEQ ID NO: 4651)

3'-<u>AUAUCCUGAAGACCCUACGUCAAGACA</u>-5' (SEQ ID NO: 6961)

C5-2598 Target:
5'-TATAGGACTTCTGGGATGCAGTTCTGT-3' (SEQ ID NO: 9271)

5'-A<u>GGACUUCUGGGAUGCAGUUCUGtg</u>-3' (SEQ ID NO: 4652)

3'-<u>UAUCCUGAAGACCCUACGUCAAGACAC</u>-5' (SEQ ID NO: 6962)

C5-2599 Target:
5'-ATAGGACTTCTGGGATGCAGTTCTGTG-3' (SEQ ID NO: 9272)

5'-A<u>AUGUCUGCUGUGGAGGGAAUCUgc</u>-3' (SEQ ID NO: 4653)

3'-<u>UUUUACAGACGACACCUCCCUUAGACG</u>-5' (SEQ ID NO: 6963)

C5-2628 Target:
5'-AAAATGTCTGCTGTGGAGGGAATCTGC-3' (SEQ ID NO: 9273)

5'-A<u>UGUCUGCUGUGGAGGGAAUCUGca</u>-3' (SEQ ID NO: 4654)

3'-<u>UUUACAGACGACACCUCCCUUAGACGU</u>-5' (SEQ ID NO: 6964)

C5-2629 Target:
5'-AAATGTCTGCTGTGGAGGGAATCTGCA-3' (SEQ ID NO: 9274)

5'-<u>UGUCUGCUGUGGAGGGAAUCUGCac</u>-3' (SEQ ID NO: 4655)

3'-<u>UUACAGACGACACCUCCCUUAGACGUG</u>-5' (SEQ ID NO: 6965)

C5-2630 Target:
5'-AATGTCTGCTGTGGAGGGAATCTGCAC-3' (SEQ ID NO: 9275)

5'-<u>GUCUGCUGUGGAGGGAAUCUGCAct</u>-3' (SEQ ID NO: 4656)

3'-<u>UACAGACGACACCUCCCUUAGACGUGA</u>-5' (SEQ ID NO: 6966)

C5-2631 Target:
5'-ATGTCTGCTGTGGAGGGAATCTGCACT-3' (SEQ ID NO: 9276)

5'-<u>UCUGCUGUGGAGGGAAUCUGCACtt</u>-3' (SEQ ID NO: 4657)

3'-<u>ACAGACGACACCUCCCUUAGACGUGAA</u>-5' (SEQ ID NO: 6967)

C5-2632 Target:
5'-TGTCTGCTGTGGAGGGAATCTGCACTT-3' (SEQ ID NO: 9277)

5'-<u>CUGCUGUGGAGGGAAUCUGCACUtc</u>-3' (SEQ ID NO: 4658)

3'-<u>CAGACGACACCUCCCUUAGACGUGAAG</u>-5' (SEQ ID NO: 6968)

C5-2633 Target:
5'-GTCTGCTGTGGAGGGAATCTGCACTTC-3' (SEQ ID NO: 9278)

5'-<u>UGCUGUGGAGGGAAUCUGCACUUcg</u>-3' (SEQ ID NO: 4659)

3'-<u>AGACGACACCUCCCUUAGACGUGAAGC</u>-5' (SEQ ID NO: 6969)

C5-2634 Target:
5'-TCTGCTGTGGAGGGAATCTGCACTTCG-3' (SEQ ID NO: 9279)

5'-<u>GCUGUGGAGGGAAUCUGCACUUCgg</u>-3' (SEQ ID NO: 4660)

3'-<u>GACGACACCUCCCUUAGACGUGAAGCC</u>-5' (SEQ ID NO: 6970)

C5-2635 Target:
5'-CTGCTGTGGAGGGAATCTGCACTTCGG-3' (SEQ ID NO: 9280)

5'-<u>CUGUGGAGGGAAUCUGCACUUCGga</u>-3' (SEQ ID NO: 4661)

3'-<u>ACGACACCUCCCUUAGACGUGAAGCCU</u>-5' (SEQ ID NO: 6971)

C5-2636 Target:
5'-TGCTGTGGAGGGAATCTGCACTTCGGA-3' (SEQ ID NO: 9281)

5'-<u>UGUGGAGGGAAUCUGCACUUCGGaa</u>-3' (SEQ ID NO: 4662)

3'-<u>CGACACCUCCCUUAGACGUGAAGCCUU</u>-5' (SEQ ID NO: 6972)

C5-2637 Target:
5'-GCTGTGGAGGGAATCTGCACTTCGGAA-3' (SEQ ID NO: 9282)

5'-<u>GUGGAGGGAAUCUGCACUUCGGAaa</u>-3' (SEQ ID NO: 4663)

3'-<u>GACACCUCCCUUAGACGUGAAGCCUUU</u>-5' (SEQ ID NO: 6973)

C5-2638 Target:
5'-CTGTGGAGGGAATCTGCACTTCGGAAA-3' (SEQ ID NO: 9283)

5'-<u>UGGAGGGAAUCUGCACUUCGGAAag</u>-3' (SEQ ID NO: 4664)

3'-<u>ACACCUCCCUUAGACGUGAAGCCUUUC</u>-5' (SEQ ID NO: 6974)

C5-2639 Target:
5'-TGTGGAGGGAATCTGCACTTCGGAAAG-3' (SEQ ID NO: 9284)

5'-<u>GAAAGCCCAGUCAUUGAUCAUCAgg</u>-3' (SEQ ID NO: 4665)

3'-<u>GCCUUUCGGGUCAGUAACUAGUAGUCC</u>-5' (SEQ ID NO: 6975)

C5-2659 Target:
5'-CGGAAAGCCCAGTCATTGATCATCAGG-3' (SEQ ID NO: 9285)

5'-<u>AAAGCCCAGUCAUUGAUCAUCAGgg</u>-3' (SEQ ID NO: 4666)

3'-<u>CCUUUCGGGUCAGUAACUAGUAGUCCC</u>-5' (SEQ ID NO: 6976)

C5-2660 Target:
5'-GGAAAGCCCAGTCATTGATCATCAGGG-3' (SEQ ID NO: 9286)

5'-<u>AAGCCCAGUCAUUGAUCAUCAGGgc</u>-3' (SEQ ID NO: 4667)

3'-<u>CUUUCGGGUCAGUAACUAGUAGUCCCG</u>-5' (SEQ ID NO: 6977)

TABLE 7-continued

Human Anti-C5 DsiRNAs Predicted to have >50% Knockdown Efficacy (Asymmetrics)

C5-2661 Target:
5'-GAAAGCCCAGTCATTGATCATCAGGGC-3' (SEQ ID NO: 9287)

5'-AGCCCAGUCAUUGAUCAUCAGGGCa-3' (SEQ ID NO: 4668)

3'-UUUCGGGUCAGUAACUAGUAGUCCCGU-5' (SEQ ID NO: 6978)

C5-2662 Target:
5'-AAAGCCCAGTCATTGATCATCAGGGCA-3' (SEQ ID NO: 9288)

5'-GCCCAGUCAUUGAUCAUCAGGGCac-3' (SEQ ID NO: 4669)

3'-UUCGGGUCAGUAACUAGUAGUCCCGUG-5' (SEQ ID NO: 6979)

C5-2663 Target:
5'-AAGCCCAGTCATTGATCATCAGGGCAC-3' (SEQ ID NO: 9289)

5'-CCCAGUCAUUGAUCAUCAGGGCAca-3' (SEQ ID NO: 4670)

3'-UCGGGUCAGUAACUAGUAGUCCCGUGU-5' (SEQ ID NO: 6980)

C5-2664 Target:
5'-AGCCCAGTCATTGATCATCAGGGCACA-3' (SEQ ID NO: 9290)

5'-CCAGUCAUUGAUCAUCAGGGCACaa-3' (SEQ ID NO: 4671)

3'-CGGGUCAGUAACUAGUAGUCCCGUGUU-5' (SEQ ID NO: 6981)

C5-2665 Target:
5'-GCCCAGTCATTGATCATCAGGGCACAA-3' (SEQ ID NO: 9291)

5'-CAGUCAUUGAUCAUCAGGGCACAaa-3' (SEQ ID NO: 4672)

3'-GGGUCAGUAACUAGUAGUCCCGUGUUU-5' (SEQ ID NO: 6982)

C5-2666 Target:
5'-CCCAGTCATTGATCATCAGGGCACAAA-3' (SEQ ID NO: 9292)

5'-AGUCAUUGAUCAUCAGGGCACAAag-3' (SEQ ID NO: 4673)

3'-GGUCAGUAACUAGUAGUCCCGUGUUUC-5' (SEQ ID NO: 6983)

C5-2667 Target:
5'-CCAGTCATTGATCATCAGGGCACAAAG-3' (SEQ ID NO: 9293)

5'-GUCAUUGAUCAUCAGGGCACAAAgt-3' (SEQ ID NO: 4674)

3'-GUCAGUAACUAGUAGUCCCGUGUUUCA-5' (SEQ ID NO: 6984)

C5-2668 Target:
5'-CAGTCATTGATCATCAGGGCACAAAGT-3' (SEQ ID NO: 9294)

5'-UCAUUGAUCAUCAGGGCACAAAGtc-3' (SEQ ID NO: 4675)

3'-UCAGUAACUAGUAGUCCCGUGUUUCAG-5' (SEQ ID NO: 6985)

C5-2669 Target:
5'-AGTCATTGATCATCAGGGCACAAAGTC-3' (SEQ ID NO: 9295)

5'-CAUUGAUCAUCAGGGCACAAAGUcc-3' (SEQ ID NO: 4676)

3'-CAGUAACUAGUAGUCCCGUGUUUCAGG-5' (SEQ ID NO: 6986)

C5-2670 Target:
5'-GTCATTGATCATCAGGGCACAAAGTCC-3' (SEQ ID NO: 9296)

5'-AUUGAUCAUCAGGGCACAAAGUCct-3' (SEQ ID NO: 4677)

3'-AGUAACUAGUAGUCCCGUGUUUCAGGA-5' (SEQ ID NO: 6987)

C5-2671 Target:
5'-TCATTGATCATCAGGGCACAAAGTCCT-3' (SEQ ID NO: 9297)

5'-UUGAUCAUCAGGGCACAAAGUCCtc-3' (SEQ ID NO: 4678)

3'-GUAACUAGUAGUCCCGUGUUUCAGGAG-5' (SEQ ID NO: 6988)

TABLE 7-continued

Human Anti-C5 DsiRNAs Predicted to have >50% Knockdown Efficacy (Asymmetrics)

C5-2672 Target:
5'-CATTGATCATCAGGGCACAAAGTCCTC-3' (SEQ ID NO: 9298)

5'-UGAUCAUCAGGGCACAAAGUCCUcc-3' (SEQ ID NO: 4679)

3'-UAACUAGUAGUCCCGUGUUUCAGGAGG-5' (SEQ ID NO: 6989)

C5-2673 Target:
5'-ATTGATCATCAGGGCACAAAGTCCTCC-3' (SEQ ID NO: 9299)

5'-GAUCAUCAGGGCACAAAGUCCUCca-3' (SEQ ID NO: 4680)

3'-AACUAGUAGUCCCGUGUUUCAGGAGGU-5' (SEQ ID NO: 6990)

C5-2674 Target:
5'-TTGATCATCAGGGCACAAAGTCCTCCA-3' (SEQ ID NO: 9300)

5'-AUCAUCAGGGCACAAAGUCCUCCaa-3' (SEQ ID NO: 4681)

3'-ACUAGUAGUCCCGUGUUUCAGGAGGUU-5' (SEQ ID NO: 6991)

C5-2675 Target:
5'-TGATCATCAGGGCACAAAGTCCTCCAA-3' (SEQ ID NO: 9301)

5'-UCAUCAGGGCACAAAGUCCUCCAaa-3' (SEQ ID NO: 4682)

3'-CUAGUAGUCCCGUGUUUCAGGAGGUUU-5' (SEQ ID NO: 6992)

C5-2676 Target:
5'-GATCATCAGGGCACAAAGTCCTCCAAA-3' (SEQ ID NO: 9302)

5'-CAUCAGGGCACAAAGUCCUCCAAat-3' (SEQ ID NO: 4683)

3'-UAGUAGUCCCGUGUUUCAGGAGGUUUA-5' (SEQ ID NO: 6993)

C5-2677 Target:
5'-ATCATCAGGGCACAAAGTCCTCCAAAT-3' (SEQ ID NO: 9303)

5'-AUCAGGGCACAAAGUCCUCCAAAtg-3' (SEQ ID NO: 4684)

3'-AGUAGUCCCGUGUUUCAGGAGGUUUAC-5' (SEQ ID NO: 6994)

C5-2678 Target:
5'-TCATCAGGGCACAAAGTCCTCCAAATG-3' (SEQ ID NO: 9304)

5'-UCAGGGCACAAAGUCCUCCAAAUgt-3' (SEQ ID NO: 4685)

3'-GUAGUCCCGUGUUUCAGGAGGUUUACA-5' (SEQ ID NO: 6995)

C5-2679 Target:
5'-CATCAGGGCACAAAGTCCTCCAAATGT-3' (SEQ ID NO: 9305)

5'-CAGGGCACAAAGUCCUCCAAAUGtg-3' (SEQ ID NO: 4686)

3'-UAGUCCCGUGUUUCAGGAGGUUUACAC-5' (SEQ ID NO: 6996)

C5-2680 Target:
5'-ATCAGGGCACAAAGTCCTCCAAATGTG-3' (SEQ ID NO: 9306)

5'-AGAAAGUAGAGGGCUCCUCCAGUca-3' (SEQ ID NO: 4687)

3'-GGUCUUUCAUCUCCCGAGGAGGUCAGU-5' (SEQ ID NO: 6997)

C5-2711 Target:
5'-CCAGAAAGTAGAGGGCTCCTCCAGTCA-3' (SEQ ID NO: 9307)

5'-ACUGUGCUUCCUCUGGAAAUUGGcc-3' (SEQ ID NO: 4688)

3'-AGUGACACGAAGGAGACCUUUAACCGG-5' (SEQ ID NO: 6998)

C5-2749 Target:
5'-TCACTGTGCTTCCTCTGGAAATTGGCC-3' (SEQ ID NO: 9308)

5'-CUGUGCUUCCUCUGGAAAUUGGCct-3' (SEQ ID NO: 4689)

3'-GUGACACGAAGGAGACCUUUAACCGGA-5' (SEQ ID NO: 6999)

TABLE 7-continued

Human Anti-C5 DsiRNAs Predicted to have >50% Knockdown Efficacy (Asymmetrics)

C5-2750 Target:
5'-CACTGTGCTTCCTCTGGAAATTGGCCT-3' (SEQ ID NO: 9309)

5'-UGUGCUUCCUCUGGAAAUUGGCCtt-3' (SEQ ID NO: 4690)

3'-UGACACGAAGGAGACCUUUAACCGGAA-5' (SEQ ID NO: 7000)

C5-2751 Target:
5'-ACTGTGCTTCCTCTGGAAATTGGCCTT-3' (SEQ ID NO: 9310)

5'-GUGCUUCCUCUGGAAAUUGGCCUtc-3' (SEQ ID NO: 4691)

3'-GACACGAAGGAGACCUUUAACCGGAAG-5' (SEQ ID NO: 7001)

C5-2752 Target:
5'-CTGTGCTTCCTCTGGAAATTGGCCTTC-3' (SEQ ID NO: 9311)

5'-GUUUGGAAAAGAAAUCUUAGUAAAaa-3' (SEQ ID NO: 4692)

3'-ACCAAACCUUUUCUUUAGAAUCAUUUU-5' (SEQ ID NO: 7002)

C5-2805 Target:
5'-TGGTTTGGAAAAGAAATCTTAGTAAAA-3' (SEQ ID NO: 9312)

5'-UUUGGAAAAGAAAUCUUAGUAAAaa-3' (SEQ ID NO: 4693)

3'-CCAAACCUUUUCUUUAGAAUCAUUUUU-5' (SEQ ID NO: 7003)

C5-2806 Target:
5'-GGTTTGGAAAAGAAATCTTAGTAAAAA-3' (SEQ ID NO: 9313)

5'-UUGGAAAAGAAAUCUUAGUAAAAac-3' (SEQ ID NO: 4694)

3'-CAAACCUUUUCUUUAGAAUCAUUUUUG-5' (SEQ ID NO: 7004)

C5-2807 Target:
5'-GTTTGGAAAAGAAATCTTAGTAAAAAC-3' (SEQ ID NO: 9314)

5'-UGGAAAAGAAAUCUUAGUAAAAACa-3' (SEQ ID NO: 4695)

3'-AAACCUUUUCUUUAGAAUCAUUUUUGU-5' (SEQ ID NO: 7005)

C5-2808 Target:
5'-TTTGGAAAAGAAATCTTAGTAAAAACA-3' (SEQ ID NO: 9315)

5'-GGAAAAGAAAUCUUAGUAAAAACat-3' (SEQ ID NO: 4696)

3'-AACCUUUUCUUUAGAAUCAUUUUUGUA-5' (SEQ ID NO: 7006)

C5-2809 Target:
5'-TTGGAAAAGAAATCTTAGTAAAAACAT-3' (SEQ ID NO: 9316)

5'-GAAAAGAAAUCUUAGUAAAAACAtt-3' (SEQ ID NO: 4697)

3'-ACCUUUUCUUUAGAAUCAUUUUUGUAA-5' (SEQ ID NO: 7007)

C5-2810 Target:
5'-TGGAAAAGAAATCTTAGTAAAAACATT-3' (SEQ ID NO: 9317)

5'-AAAAGAAAUCUUAGUAAAAACAUta-3' (SEQ ID NO: 4698)

3'-CCUUUUCUUUAGAAUCAUUUUUGUAAU-5' (SEQ ID NO: 7008)

C5-2811 Target:
5'-GGAAAAGAAATCTTAGTAAAAACATTA-3' (SEQ ID NO: 9318)

5'-UUACGAGUGGUGCCAGAAGGUGUca-3' (SEQ ID NO: 4699)

3'-GUAAUGCUCACCACGGUCUUCCACAGU-5' (SEQ ID NO: 7009)

C5-2833 Target:
5'-CATTACGAGTGGTGCCAGAAGGTGTCA-3' (SEQ ID NO: 9319)

5'-UACGAGUGGUGCCAGAAGGUGUCaa-3' (SEQ ID NO: 4700)

3'-UAAUGCUCACCACGGUCUUCCACAGUU-5' (SEQ ID NO: 7010)

C5-2834 Target:
5'-ATTACGAGTGGTGCCAGAAGGTGTCAA-3' (SEQ ID NO: 9320)

5'-ACGAGUGGUGCCAGAAGGUGUCAaa-3' (SEQ ID NO: 4701)

3'-AAUGCUCACCACGGUCUUCCACAGUUU-5' (SEQ ID NO: 7011)

C5-2835 Target:
5'-TTACGAGTGGTGCCAGAAGGTGTCAAA-3' (SEQ ID NO: 9321)

5'-CGAGUGGUGCCAGAAGGUGUCAAaa-3' (SEQ ID NO: 4702)

3'-AUGCUCACCACGGUCUUCCACAGUUUU-5' (SEQ ID NO: 7012)

C5-2836 Target:
5'-TACGAGTGGTGCCAGAAGGTGTCAAAA-3' (SEQ ID NO: 9322)

5'-GAGUGGUGCCAGAAGGUGUCAAAag-3' (SEQ ID NO: 4703)

3'-UGCUCACCACGGUCUUCCACAGUUUUC-5' (SEQ ID NO: 7013)

C5-2837 Target:
5'-ACGAGTGGTGCCAGAAGGTGTCAAAAG-3' (SEQ ID NO: 9323)

5'-AGUGGUGCCAGAAGGUGUCAAAAgg-3' (SEQ ID NO: 4704)

3'-GCUCACCACGGUCUUCCACAGUUUUCC-5' (SEQ ID NO: 7014)

C5-2838 Target:
5'-CGAGTGGTGCCAGAAGGTGTCAAAAGG-3' (SEQ ID NO: 9324)

5'-GUGGUGCCAGAAGGUGUCAAAAGgg-3' (SEQ ID NO: 4705)

3'-CUCACCACGGUCUUCCACAGUUUUCCC-5' (SEQ ID NO: 7015)

C5-2839 Target:
5'-GAGTGGTGCCAGAAGGTGTCAAAAGGG-3' (SEQ ID NO: 9325)

5'-UGGUGCCAGAAGGUGUCAAAAGGga-3' (SEQ ID NO: 4706)

3'-UCACCACGGUCUUCCACAGUUUUCCCU-5' (SEQ ID NO: 7016)

C5-2840 Target:
5'-AGTGGTGCCAGAAGGTGTCAAAAGGGA-3' (SEQ ID NO: 9326)

5'-GGUGCCAGAAGGUGUCAAAAGGGaa-3' (SEQ ID NO: 4707)

3'-CACCACGGUCUUCCACAGUUUUCCCUU-5' (SEQ ID NO: 7017)

C5-2841 Target:
5'-GTGGTGCCAGAAGGTGTCAAAAGGGAA-3' (SEQ ID NO: 9327)

5'-GUGCCAGAAGGUGUCAAAAGGGAaa-3' (SEQ ID NO: 4708)

3'-ACCACGGUCUUCCACAGUUUUCCCUUU-5' (SEQ ID NO: 7018)

C5-2842 Target:
5'-TGGTGCCAGAAGGTGTCAAAAGGGAAA-3' (SEQ ID NO: 9328)

5'-UGCCAGAAGGUGUCAAAAGGGAAag-3' (SEQ ID NO: 4709)

3'-CCACGGUCUUCCACAGUUUUCCCUUUC-5' (SEQ ID NO: 7019)

C5-2843 Target:
5'-GGTGCCAGAAGGTGTCAAAAGGGAAAG-3' (SEQ ID NO: 9329)

5'-GCCAGAAGGUGUCAAAAGGGAAAgc-3' (SEQ ID NO: 4710)

3'-CACGGUCUUCCACAGUUUUCCCUUUCG-5' (SEQ ID NO: 7020)

C5-2844 Target:
5'-GTGCCAGAAGGTGTCAAAAGGGAAAGC-3' (SEQ ID NO: 9330)

5'-CCAGAAGGUGUCAAAAGGGAAAGct-3' (SEQ ID NO: 4711)

3'-ACGGUCUUCCACAGUUUUCCCUUUCGA-5' (SEQ ID NO: 7021)

TABLE 7-continued

Human Anti-C5 DsiRNAs Predicted to have >50% Knockdown Efficacy (Asymmetrics)

C5-2845 Target:
5'-TGCCAGAAGGTGTCAAAAGGGAAAGCT-3' (SEQ ID NO: 9331)

5'-CAGAAGGUGUCAAAAGGGAAAGCta-3' (SEQ ID NO: 4712)

3'-CGGUCUUCCACAGUUUUCCCUUUCGAU-5' (SEQ ID NO: 7022)

C5-2846 Target:
5'-GCCAGAAGGTGTCAAAAGGGAAAGCTA-3' (SEQ ID NO: 9332)

5'-AGAAGGUGUCAAAAGGGAAAGCUat-3' (SEQ ID NO: 4713)

3'-GGUCUUCCACAGUUUUCCCUUUCGAUA-5' (SEQ ID NO: 7023)

C5-2847 Target:
5'-CCAGAAGGTGTCAAAAGGGAAAGCTAT-3' (SEQ ID NO: 9333)

5'-GAAGGUGUCAAAAGGGAAAGCUAtt-3' (SEQ ID NO: 4714)

3'-GUCUUCCACAGUUUUCCCUUUCGAUAA-5' (SEQ ID NO: 7024)

C5-2848 Target:
5'-CAGAAGGTGTCAAAAGGGAAAGCTATT-3' (SEQ ID NO: 9334)

5'-AAGGUGUCAAAAGGGAAAGCUAUtc-3' (SEQ ID NO: 4715)

3'-UCUUCCACAGUUUUCCCUUUCGAUAAG-5' (SEQ ID NO: 7025)

C5-2849 Target:
5'-AGAAGGTGTCAAAAGGGAAAGCTATTC-3' (SEQ ID NO: 9335)

5'-AGGUGUCAAAAGGGAAAGCUAUUct-3' (SEQ ID NO: 4716)

3'-CUUCCACAGUUUUCCCUUUCGAUAAGA-5' (SEQ ID NO: 7026)

C5-2850 Target:
5'-GAAGGTGTCAAAAGGGAAAGCTATTCT-3' (SEQ ID NO: 9336)

5'-GGUGUCAAAAGGGAAAGCUAUUCtg-3' (SEQ ID NO: 4717)

3'-UUCCACAGUUUUCCCUUUCGAUAAGAC-5' (SEQ ID NO: 7027)

C5-2851 Target:
5'-AAGGTGTCAAAAGGGAAAGCTATTCTG-3' (SEQ ID NO: 9337)

5'-GUGUCAAAAGGGAAAGCUAUUCUgg-3' (SEQ ID NO: 4718)

3'-UCCACAGUUUUCCCUUUCGAUAAGACC-5' (SEQ ID NO: 7028)

C5-2852 Target:
5'-AGGTGTCAAAAGGGAAAGCTATTCTGG-3' (SEQ ID NO: 9338)

5'-UGUCAAAAGGGAAAGCUAUUCUGgt-3' (SEQ ID NO: 4719)

3'-CCACAGUUUUCCCUUUCGAUAAGACCA-5' (SEQ ID NO: 7029)

C5-2853 Target:
5'-GGTGTCAAAAGGGAAAGCTATTCTGGT-3' (SEQ ID NO: 9339)

5'-GUCAAAAGGGAAAGCUAUUCUGGtg-3' (SEQ ID NO: 4720)

3'-CACAGUUUUCCCUUUCGAUAAGACCAC-5' (SEQ ID NO: 7030)

C5-2854 Target:
5'-GTGTCAAAAGGGAAAGCTATTCTGGTG-3' (SEQ ID NO: 9340)

5'-UCAAAAGGGAAAGCUAUUCUGGUgt-3' (SEQ ID NO: 4721)

3'-ACAGUUUUCCCUUUCGAUAAGACCACA-5' (SEQ ID NO: 7031)

C5-2855 Target:
5'-TGTCAAAAGGGAAAGCTATTCTGGTGT-3' (SEQ ID NO: 9341)

5'-CAAAAGGGAAAGCUAUUCUGGUGtt-3' (SEQ ID NO: 4722)

3'-CAGUUUUCCCUUUCGAUAAGACCACAA-5' (SEQ ID NO: 7032)

C5-2856 Target:
5'-GTCAAAAGGGAAAGCTATTCTGGTGTT-3' (SEQ ID NO: 9342)

5'-AAAAGGGAAAGCUAUUCUGGUGUta-3' (SEQ ID NO: 4723)

3'-AGUUUUCCCUUUCGAUAAGACCACAAU-5' (SEQ ID NO: 7033)

C5-2857 Target:
5'-TCAAAAGGGAAAGCTATTCTGGTGTTA-3' (SEQ ID NO: 9343)

5'-AAAGGGAAAGCUAUUCUGGUGUUac-3' (SEQ ID NO: 4724)

3'-GUUUUCCCUUUCGAUAAGACCACAAUG-5' (SEQ ID NO: 7034)

C5-2858 Target:
5'-CAAAAGGGAAAGCTATTCTGGTGTTAC-3' (SEQ ID NO: 9344)

5'-AAGGGAAAGCUAUUCUGGUGUUAct-3' (SEQ ID NO: 4725)

3'-UUUUCCCUUUCGAUAAGACCACAAUGA-5' (SEQ ID NO: 7035)

C5-2859 Target:
5'-AAAAGGGAAAGCTATTCTGGTGTTACT-3' (SEQ ID NO: 9345)

5'-UUACUUUGGAUCCUAGGGGUAUUta-3' (SEQ ID NO: 4726)

3'-ACAAUGAAACCUAGGAUCCCCAUAAAU-5' (SEQ ID NO: 7036)

C5-2879 Target:
5'-TGTTACTTTGGATCCTAGGGGTATTTA-3' (SEQ ID NO: 9346)

5'-UACUUUGGAUCCUAGGGGUAUUUat-3' (SEQ ID NO: 4727)

3'-CAAUGAAACCUAGGAUCCCCAUAAAUA-5' (SEQ ID NO: 7037)

C5-2880 Target:
5'-GTTACTTTGGATCCTAGGGGTATTTAT-3' (SEQ ID NO: 9347)

5'-ACUUUGGAUCCUAGGGGUAUUUAtg-3' (SEQ ID NO: 4728)

3'-AAUGAAACCUAGGAUCCCCAUAAAUAC-5' (SEQ ID NO: 7038)

C5-2881 Target:
5'-TTACTTTGGATCCTAGGGGTATTTATG-3' (SEQ ID NO: 9348)

5'-CUUUGGAUCCUAGGGGUAUUUAUgg-3' (SEQ ID NO: 4729)

3'-AUGAAACCUAGGAUCCCCAUAAAUACC-5' (SEQ ID NO: 7039)

C5-2882 Target:
5'-TACTTTGGATCCTAGGGGTATTTATGG-3' (SEQ ID NO: 9349)

5'-UUUGGAUCCUAGGGGUAUUUAUGgt-3' (SEQ ID NO: 4730)

3'-UGAAACCUAGGAUCCCCAUAAAUACCA-5' (SEQ ID NO: 7040)

C5-2883 Target:
5'-ACTTTGGATCCTAGGGGTATTTATGGT-3' (SEQ ID NO: 9350)

5'-UUGGAUCCUAGGGGUAUUUAUGGta-3' (SEQ ID NO: 4731)

3'-GAAACCUAGGAUCCCCAUAAAUACCAU-5' (SEQ ID NO: 7041)

C5-2884 Target:
5'-CTTTGGATCCTAGGGGTATTTATGGTA-3' (SEQ ID NO: 9351)

5'-UGGAUCCUAGGGGUAUUUAUGGUac-3' (SEQ ID NO: 4732)

3'-AAACCUAGGAUCCCCAUAAAUACCAUG-5' (SEQ ID NO: 7042)

C5-2885 Target:
5'-TTTGGATCCTAGGGGTATTTATGGTAC-3' (SEQ ID NO: 9352)

5'-GGAUCCUAGGGGUAUUUAUGGUAcc-3' (SEQ ID NO: 4733)

3'-AACCUAGGAUCCCCAUAAAUACCAUGG-5' (SEQ ID NO: 7043)

TABLE 7-continued

Human Anti-C5 DsiRNAs Predicted to have >50% Knockdown Efficacy (Asymmetrics)

C5-2886 Target:
5'-TTGGATCCTAGGGGTATTTATGGTACC-3' (SEQ ID NO: 9353)

5'-GAUCCUAGGGGUAUUUAUGGUACca-3' (SEQ ID NO: 4734)

3'-ACCUAGGAUCCCCAUAAAUACCAUGGU-5' (SEQ ID NO: 7044)

C5-2887 Target:
5'-TGGATCCTAGGGGTATTTATGGTACCA-3' (SEQ ID NO: 9354)

5'-CGAAAGGAGUUCCCAUACAGGAUac-3' (SEQ ID NO: 4735)

3'-CUGCUUUCCUCAAGGGUAUGUCCUAUG-5' (SEQ ID NO: 7045)

C5-2920 Target:
5'-GACGAAAGGAGTTCCCATACAGGATAC-3' (SEQ ID NO: 9355)

5'-GAAAGGAGUUCCCAUACAGGAUAcc-3' (SEQ ID NO: 4736)

3'-UGCUUUCCUCAAGGGUAUGUCCUAUGG-5' (SEQ ID NO: 7046)

C5-2921 Target:
5'-ACGAAAGGAGTTCCCATACAGGATACC-3' (SEQ ID NO: 9356)

5'-AAAGGAGUUCCCAUACAGGAUACcc-3' (SEQ ID NO: 4737)

3'-GCUUUCCUCAAGGGUAUGUCCUAUGGG-5' (SEQ ID NO: 7047)

C5-2922 Target:
5'-CGAAAGGAGTTCCCATACAGGATACCC-3' (SEQ ID NO: 9357)

5'-AAGGAGUUCCCAUACAGGAUACCct-3' (SEQ ID NO: 4738)

3'-CUUUCCUCAAGGGUAUGUCCUAUGGGA-5' (SEQ ID NO: 7048)

C5-2923 Target:
5'-GAAAGGAGTTCCCATACAGGATACCCT-3' (SEQ ID NO: 9358)

5'-AGGAGUUCCCAUACAGGAUACCCtt-3' (SEQ ID NO: 4739)

3'-UUUCCUCAAGGGUAUGUCCUAUGGGAA-5' (SEQ ID NO: 7049)

C5-2924 Target:
5'-AAAGGAGTTCCCATACAGGATACCTT-3' (SEQ ID NO: 9359)

5'-GGAGUUCCCAUACAGGAUACCCUta-3' (SEQ ID NO: 4740)

3'-UUCCUCAAGGGUAUGUCCUAUGGGAAU-5' (SEQ ID NO: 7050)

C5-2925 Target:
5'-AAGGAGTTCCCATACAGGATACCCTTA-3' (SEQ ID NO: 9360)

5'-GAGUUCCCAUACAGGAUACCCUUag-3' (SEQ ID NO: 4741)

3'-UCCUCAAGGGUAUGUCCUAUGGGAAUC-5' (SEQ ID NO: 7051)

C5-2926 Target:
5'-AGGAGTTCCCATACAGGATACCCTTAG-3' (SEQ ID NO: 9361)

5'-AGUUCCCAUACAGGAUACCCUUAga-3' (SEQ ID NO: 4742)

3'-CCUCAAGGGUAUGUCCUAUGGGAAUCU-5' (SEQ ID NO: 7052)

C5-2927 Target:
5'-GGAGTTCCCATACAGGATACCCTTAGA-3' (SEQ ID NO: 9362)

5'-UUAGAUUUGGUCCCCAAAACAGAaa-3' (SEQ ID NO: 4743)

3'-GGAAUCUAAACCAGGGGUUUUGUCUUU-5' (SEQ ID NO: 7053)

C5-2947 Target:
5'-CCTTAGATTTGGTCCCCAAAACAGAAA-3' (SEQ ID NO: 9363)

5'-UAGAUUUGGUCCCCAAAACAGAAat-3' (SEQ ID NO: 4744)

3'-GAAUCUAAACCAGGGGUUUUGUCUUUA-5' (SEQ ID NO: 7054)

C5-2948 Target:
5'-CTTAGATTTGGTCCCCAAAACAGAAAT-3' (SEQ ID NO: 9364)

5'-AGAUUUGGUCCCCAAAACAGAAAtc-3' (SEQ ID NO: 4745)

3'-AAUCUAAACCAGGGGUUUUGUCUUUAG-5' (SEQ ID NO: 7055)

C5-2949 Target:
5'-TTAGATTTGGTCCCCAAAACAGAAATC-3' (SEQ ID NO: 9365)

5'-GAUUUGGUCCCCAAAACAGAAAUca-3' (SEQ ID NO: 4746)

3'-AUCUAAACCAGGGGUUUUGUCUUUAGU-5' (SEQ ID NO: 7056)

C5-2950 Target:
5'-TAGATTTGGTCCCCAAAACAGAAATCA-3' (SEQ ID NO: 9366)

5'-AUUUGGUCCCCAAAACAGAAAUCaa-3' (SEQ ID NO: 4747)

3'-UCUAAACCAGGGGUUUUGUCUUUAGUU-5' (SEQ ID NO: 7057)

C5-2951 Target:
5'-AGATTTGGTCCCCAAAACAGAAATCAA-3' (SEQ ID NO: 9367)

5'-UUUGGUCCCCAAAACAGAAAUCAaa-3' (SEQ ID NO: 4748)

3'-CUAAACCAGGGGUUUUGUCUUUAGUUU-5' (SEQ ID NO: 7058)

C5-2952 Target:
5'-GATTTGGTCCCCAAAACAGAAATCAAA-3' (SEQ ID NO: 9368)

5'-UUGGUCCCCAAAACAGAAAUCAAaa-3' (SEQ ID NO: 4749)

3'-UAAACCAGGGGUUUUGUCUUUAGUUUU-5' (SEQ ID NO: 7059)

C5-2953 Target:
5'-ATTTGGTCCCCAAAACAGAAATCAAA-3' (SEQ ID NO: 9369)

5'-UGGUCCCCAAAACAGAAAUCAAAag-3' (SEQ ID NO: 4750)

3'-AAACCAGGGGUUUUGUCUUUAGUUUUC-5' (SEQ ID NO: 7060)

C5-2954 Target:
5'-TTTGGTCCCCAAAACAGAAATCAAAG-3' (SEQ ID NO: 9370)

5'-GGUCCCCAAAACAGAAAUCAAAgg-3' (SEQ ID NO: 4751)

3'-AACCAGGGGUUUUGUCUUUAGUUUUCC-5' (SEQ ID NO: 7061)

C5-2955 Target:
5'-TTGGTCCCCAAAACAGAAATCAAAGG-3' (SEQ ID NO: 9371)

5'-GUCCCCAAAACAGAAAUCAAAGga-3' (SEQ ID NO: 4752)

3'-ACCAGGGGUUUUGUCUUUAGUUUUCCU-5' (SEQ ID NO: 7062)

C5-2956 Target:
5'-TGGTCCCCAAAACAGAAATCAAAGGA-3' (SEQ ID NO: 9372)

5'-UCCCCAAAACAGAAAUCAAAGGat-3' (SEQ ID NO: 4753)

3'-CCAGGGGUUUUGUCUUUAGUUUUCCUA-5' (SEQ ID NO: 7063)

C5-2957 Target:
5'-GGTCCCCAAAACAGAAATCAAAGGAT-3' (SEQ ID NO: 9373)

5'-CCCCAAAACAGAAAUCAAAGGAtt-3' (SEQ ID NO: 4754)

3'-CAGGGGUUUUGUCUUUAGUUUUCCUAA-5' (SEQ ID NO: 7064)

C5-2958 Target:
5'-GTCCCCAAAACAGAAATCAAAGGATT-3' (SEQ ID NO: 9374)

5'-CCCAAAACAGAAAUCAAAGGAUtt-3' (SEQ ID NO: 4755)

3'-AGGGGUUUUGUCUUUAGUUUUCCUAAA-5' (SEQ ID NO: 7065)

TABLE 7-continued

Human Anti-C5 DsiRNAs Predicted to have >50% Knockdown Efficacy (Asymmetrics)

C5-2959 Target:
5'-TCCCCAAAACAGAAATCAAAAGGATTT-3' (SEQ ID NO: 9375)

5'-CCAAAACAGAAAUCAAAAGGAUUtt-3' (SEQ ID NO: 4756)

3'-GGGGUUUUGUCUUUAGUUUUCCUAAAA-5' (SEQ ID NO: 7066)

C5-2960 Target:
5'-CCCCAAAACAGAAATCAAAAGGATTTT-3' (SEQ ID NO: 9376)

5'-CAAAACAGAAAUCAAAAGGAUUUtg-3' (SEQ ID NO: 4757)

3'-GGGUUUUGUCUUUAGUUUUCCUAAAC-5' (SEQ ID NO: 7067)

C5-2961 Target:
5'-CCCAAAACAGAAATCAAAAGGATTTTG-3' (SEQ ID NO: 9377)

5'-AAAACAGAAAUCAAAAGGAUUUUga-3' (SEQ ID NO: 4758)

3'-GGUUUUGUCUUUAGUUUUCCUAAAACU-5' (SEQ ID NO: 7068)

C5-2962 Target:
5'-CCAAAACAGAAATCAAAAGGATTTTGA-3' (SEQ ID NO: 9378)

5'-AAACAGAAAUCAAAAGGAUUUUGag-3' (SEQ ID NO: 4759)

3'-GUUUUGUCUUUAGUUUUCCUAAAACUC-5' (SEQ ID NO: 7069)

C5-2963 Target:
5'-CAAAACAGAAATCAAAAGGATTTTGAG-3' (SEQ ID NO: 9379)

5'-AACAGAAAUCAAAAGGAUUUUGAgt-3' (SEQ ID NO: 4760)

3'-UUUUGUCUUUAGUUUUCCUAAAACUCA-5' (SEQ ID NO: 7070)

C5-2964 Target:
5'-AAAACAGAAATCAAAAGGATTTTGAGT-3' (SEQ ID NO: 9380)

5'-ACAGAAAUCAAAAGGAUUUUGAGtg-3' (SEQ ID NO: 4761)

3'-UUUGUCUUUAGUUUUCCUAAAACUCAC-5' (SEQ ID NO: 7071)

C5-2965 Target:
5'-AAACAGAAATCAAAAGGATTTTGAGTG-3' (SEQ ID NO: 9381)

5'-CAGAAAUCAAAAGGAUUUUGAGUgt-3' (SEQ ID NO: 4762)

3'-UUGUCUUUAGUUUUCCUAAAACUCACA-5' (SEQ ID NO: 7072)

C5-2966 Target:
5'-AACAGAAATCAAAAGGATTTTGAGTGT-3' (SEQ ID NO: 9382)

5'-AAAUCAAAAGGAUUUUGAGUGUAaa-3' (SEQ ID NO: 4763)

3'-UCUUUAGUUUUCCUAAAACUCACAUUU-5' (SEQ ID NO: 7073)

C5-2969 Target:
5'-AGAAATCAAAAGGATTTTGAGTGTAAA-3' (SEQ ID NO: 9383)

5'-AAUCAAAAGGAUUUUGAGUGUAAAa-3' (SEQ ID NO: 4764)

3'-CUUUAGUUUUCCUAAAACUCACAUUUU-5' (SEQ ID NO: 7074)

C5-2970 Target:
5'-GAAATCAAAAGGATTTTGAGTGTAAAA-3' (SEQ ID NO: 9384)

5'-AUCAAAAGGAUUUUGAGUGUAAAag-3' (SEQ ID NO: 4765)

3'-UUUAGUUUUCCUAAAACUCACAUUUC-5' (SEQ ID NO: 7075)

C5-2971 Target:
5'-AAATCAAAAGGATTTTGAGTGTAAAAG-3' (SEQ ID NO: 9385)

5'-UCAAAAGGAUUUUGAGUGUAAAAgg-3' (SEQ ID NO: 4766)

3'-UUAGUUUUCCUAAAACUCACAUUUUCC-5' (SEQ ID NO: 7076)

TABLE 7-continued

Human Anti-C5 DsiRNAs Predicted to have >50% Knockdown Efficacy (Asymmetrics)

C5-2972 Target:
5'-AATCAAAAGGATTTTGAGTGTAAAAGG-3' (SEQ ID NO: 9386)

5'-AAAAGGAUUUUGAGUGUAAAAGGac-3' (SEQ ID NO: 4767)

3'-AGUUUUCCUAAAACUCACAUUUUCCUG-5' (SEQ ID NO: 7077)

C5-2974 Target:
5'-TCAAAAGGATTTTGAGTGTAAAAGGAC-3' (SEQ ID NO: 9387)

5'-AAAGGAUUUUGAGUGUAAAAGGAct-3' (SEQ ID NO: 4768)

3'-GUUUUCCUAAAACUCACAUUUUCCUGA-5' (SEQ ID NO: 7078)

C5-2975 Target:
5'-CAAAAGGATTTTGAGTGTAAAAGGACT-3' (SEQ ID NO: 9388)

5'-AAGGAUUUUGAGUGUAAAAGGACtg-3' (SEQ ID NO: 4769)

3'-UUUUCCUAAAACUCACAUUUUCCUGAC-5' (SEQ ID NO: 7079)

C5-2976 Target:
5'-AAAAGGATTTTGAGTGTAAAAGGACTG-3' (SEQ ID NO: 9389)

5'-AGGAUUUUGAGUGUAAAAGGACUgc-3' (SEQ ID NO: 4770)

3'-UUUCCUAAAACUCACAUUUUCCUGACG-5' (SEQ ID NO: 7080)

C5-2977 Target:
5'-AAAGGATTTTGAGTGTAAAAGGACTGC-3' (SEQ ID NO: 9390)

5'-GGAUUUUGAGUGUAAAAGGACUGct-3' (SEQ ID NO: 4771)

3'-UUCCUAAAACUCACAUUUUCCUGACGA-5' (SEQ ID NO: 7081)

C5-2978 Target:
5'-AAGGATTTTGAGTGTAAAAGGACTGCT-3' (SEQ ID NO: 9391)

5'-GAUUUUGAGUGUAAAAGGACUGCtt-3' (SEQ ID NO: 4772)

3'-UCCUAAAACUCACAUUUUCCUGACGAA-5' (SEQ ID NO: 7082)

C5-2979 Target:
5'-AGGATTTTGAGTGTAAAAGGACTGCTT-3' (SEQ ID NO: 9392)

5'-AUUUUGAGUGUAAAAGGACUGCUtg-3' (SEQ ID NO: 4773)

3'-CCUAAAACUCACAUUUUCCUGACGAAC-5' (SEQ ID NO: 7083)

C5-2980 Target:
5'-GGATTTTGAGTGTAAAAGGACTGCTTG-3' (SEQ ID NO: 9393)

5'-UUUUGAGUGUAAAAGGACUGCUUgt-3' (SEQ ID NO: 4774)

3'-CUAAAACUCACAUUUUCCUGACGAACA-5' (SEQ ID NO: 7084)

C5-2981 Target:
5'-GATTTTGAGTGTAAAAGGACTGCTTGT-3' (SEQ ID NO: 9394)

5'-UUUGAGUGUAAAAGGACUGCUUGta-3' (SEQ ID NO: 4775)

3'-UAAAACUCACAUUUUCCUGACGAACAU-5' (SEQ ID NO: 7085)

C5-2982 Target:
5'-ATTTTGAGTGTAAAAGGACTGCTTGTA-3' (SEQ ID NO: 9395)

5'-UUGAGUGUAAAAGGACUGCUUGUag-3' (SEQ ID NO: 4776)

3'-AAAACUCACAUUUUCCUGACGAACAUC-5' (SEQ ID NO: 7086)

C5-2983 Target:
5'-TTTTGAGTGTAAAAGGACTGCTTGTAG-3' (SEQ ID NO: 9396)

5'-UGAGUGUAAAAGGACUGCUUGUAgg-3' (SEQ ID NO: 4777)

3'-AAACUCACAUUUUCCUGACGAACAUCC-5' (SEQ ID NO: 7087)

TABLE 7-continued

Human Anti-C5 DsiRNAs Predicted to have >50% Knockdown Efficacy (Asymmetrics)

C5-2984 Target:
5'-TTTGAGTGTAAAAGGACTGCTTGTAGG-3'    (SEQ ID NO: 9397)

5'-GAGUGUAAAAGGACUGCUUGUAGgt-3'  (SEQ ID NO: 4778)

3'-AACUCACAUUUUCCUGACGAACAUCCA-5'    (SEQ ID NO: 7088)

C5-2985 Target:
5'-TTGAGTGTAAAAGGACTGCTTGTAGGT-3'    (SEQ ID NO: 9398)

5'-AGUGUAAAAGGACUGCUUGUAGGtg-3'  (SEQ ID NO: 4779)

3'-ACUCACAUUUUCCUGACGAACAUCCAC-5'    (SEQ ID NO: 7089)

C5-2986 Target:
5'-TGAGTGTAAAAGGACTGCTTGTAGGTG-3'    (SEQ ID NO: 9399)

5'-GUGUAAAAGGACUGCUUGUAGGUga-3'  (SEQ ID NO: 4780)

3'-CUCACAUUUUCCUGACGAACAUCCACU-5'    (SEQ ID NO: 7090)

C5-2987 Target:
5'-GAGTGTAAAAGGACTGCTTGTAGGTGA-3'    (SEQ ID NO: 9400)

5'-UGUAAAAGGACUGCUUGUAGGUGag-3'  (SEQ ID NO: 4781)

3'-UCACAUUUUCCUGACGAACAUCCACUC-5'    (SEQ ID NO: 7091)

C5-2988 Target:
5'-AGTGTAAAAGGACTGCTTGTAGGTGAG-3'    (SEQ ID NO: 9401)

5'-GUAAAAGGACUGCUUGUAGGUGAga-3'  (SEQ ID NO: 4782)

3'-CACAUUUUCCUGACGAACAUCCACUCU-5'    (SEQ ID NO: 7092)

C5-2989 Target:
5'-GTGTAAAAGGACTGCTTGTAGGTGAGA-3'    (SEQ ID NO: 9402)

5'-UAAAAGGACUGCUUGUAGGUGAGat-3'  (SEQ ID NO: 4783)

3'-ACAUUUUCCUGACGAACAUCCACUCUA-5'    (SEQ ID NO: 7093)

C5-2990 Target:
5'-TGTAAAAGGACTGCTTGTAGGTGAGAT-3'    (SEQ ID NO: 9403)

5'-AAAAGGACUGCUUGUAGGUGAGAUc-3'  (SEQ ID NO: 4784)

3'-CAUUUUCCUGACGAACAUCCACUCUAG-5'    (SEQ ID NO: 7094)

C5-2991 Target:
5'-GTAAAAGGACTGCTTGTAGGTGAGATC-3'    (SEQ ID NO: 9404)

5'-AAAGGACUGCUUGUAGGUGAGAUct-3'  (SEQ ID NO: 4785)

3'-AUUUUCCUGACGAACAUCCACUCUAGA-5'    (SEQ ID NO: 7095)

C5-2992 Target:
5'-TAAAAGGACTGCTTGTAGGTGAGATCT-3'    (SEQ ID NO: 9405)

5'-AAGGACUGCUUGUAGGUGAGAUCtt-3'  (SEQ ID NO: 4786)

3'-UUUUCCUGACGAACAUCCACUCUAGAA-5'    (SEQ ID NO: 7096)

C5-2993 Target:
5'-AAAAGGACTGCTTGTAGGTGAGATCTT-3'    (SEQ ID NO: 9406)

5'-AGGACUGCUUGUAGGUGAGAUCUtg-3'  (SEQ ID NO: 4787)

3'-UUUCCUGACGAACAUCCACUCUAGAAC-5'    (SEQ ID NO: 7097)

C5-2994 Target:
5'-AAAGGACTGCTTGTAGGTGAGATCTTG-3'    (SEQ ID NO: 9407)

5'-GGACUGCUUGUAGGUGAGAUCUUgt-3'  (SEQ ID NO: 4788)

3'-UUCCUGACGAACAUCCACUCUAGAACA-5'    (SEQ ID NO: 7098)

C5-2995 Target:
5'-AAGGACTGCTTGTAGGTGAGATCTTGT-3'    (SEQ ID NO: 9408)

5'-GACUGCUUGUAGGUGAGAUCUUGtc-3'  (SEQ ID NO: 4789)

3'-UCCUGACGAACAUCCACUCUAGAACAG-5'    (SEQ ID NO: 7099)

C5-2996 Target:
5'-AGGACTGCTTGTAGGTGAGATCTTGTC-3'    (SEQ ID NO: 9409)

5'-ACUGCUUGUAGGUGAGAUCUUGUct-3'  (SEQ ID NO: 4790)

3'-CCUGACGAACAUCCACUCUAGAACAGA-5'    (SEQ ID NO: 7100)

C5-2997 Target:
5'-GGACTGCTTGTAGGTGAGATCTTGTCT-3'    (SEQ ID NO: 9410)

5'-CUGCUUGUAGGUGAGAUCUUGUCtg-3'  (SEQ ID NO: 4791)

3'-CUGACGAACAUCCACUCUAGAACAGAC-5'    (SEQ ID NO: 7101)

C5-2998 Target:
5'-GACTGCTTGTAGGTGAGATCTTGTCTG-3'    (SEQ ID NO: 9411)

5'-UGCUUGUAGGUGAGAUCUUGUCUgc-3'  (SEQ ID NO: 4792)

3'-UGACGAACAUCCACUCUAGAACAGACG-5'    (SEQ ID NO: 7102)

C5-2999 Target:
5'-ACTGCTTGTAGGTGAGATCTTGTCTGC-3'    (SEQ ID NO: 9412)

5'-GCUUGUAGGUGAGAUCUUGUCUGca-3'  (SEQ ID NO: 4793)

3'-GACGAACAUCCACUCUAGAACAGACGU-5'    (SEQ ID NO: 7103)

C5-3000 Target:
5'-CTGCTTGTAGGTGAGATCTTGTCTGCA-3'    (SEQ ID NO: 9413)

5'-CUUGUAGGUGAGAUCUUGUCUGCag-3'  (SEQ ID NO: 4794)

3'-ACGAACAUCCACUCUAGAACAGACGUC-5'    (SEQ ID NO: 7104)

C5-3001 Target:
5'-TGCTTGTAGGTGAGATCTTGTCTGCAG-3'    (SEQ ID NO: 9414)

5'-UUGUAGGUGAGAUCUUGUCUGCAgt-3'  (SEQ ID NO: 4795)

3'-CGAACAUCCACUCUAGAACAGACGUCA-5'    (SEQ ID NO: 7105)

C5-3002 Target:
5'-GCTTGTAGGTGAGATCTTGTCTGCAGT-3'    (SEQ ID NO: 9415)

5'-UGUAGGUGAGAUCUUGUCUGCAGtt-3'  (SEQ ID NO: 4796)

3'-GAACAUCCACUCUAGAACAGACGUCAA-5'    (SEQ ID NO: 7106)

C5-3003 Target:
5'-CTTGTAGGTGAGATCTTGTCTGCAGTT-3'    (SEQ ID NO: 9416)

5'-GUAGGUGAGAUCUUGUCUGCAGUtc-3'  (SEQ ID NO: 4797)

3'-AACAUCCACUCUAGAACAGACGUCAAG-5'    (SEQ ID NO: 7107)

C5-3004 Target:
5'-TTGTAGGTGAGATCTTGTCTGCAGTTC-3'    (SEQ ID NO: 9417)

5'-UAGGUGAGAUCUUGUCUGCAGUUct-3'  (SEQ ID NO: 4798)

3'-ACAUCCACUCUAGAACAGACGUCAAGA-5'    (SEQ ID NO: 7108)

C5-3005 Target:
5'-TGTAGGTGAGATCTTGTCTGCAGTTCT-3'    (SEQ ID NO: 9418)

5'-AGGUGAGAUCUUGUCUGCAGUUCta-3'  (SEQ ID NO: 4799)

3'-CAUCCACUCUAGAACAGACGUCAAGAU-5'    (SEQ ID NO: 7109)

TABLE 7-continued

Human Anti-C5 DsiRNAs Predicted to have >50% Knockdown Efficacy (Asymmetrics)

C5-3006 Target:
5'-GTAGGTGAGATCTTGTCTGCAGTTCTA-3' (SEQ ID NO: 9419)

5'-G<u>GUG</u>AGAUCUUGU<u>CUG</u>CAGUUCUaa-3' (SEQ ID NO: 4800)

3'-<u>AUCC</u>ACUCUAGAACA<u>GA</u>CGUCAAG<u>AUU</u>-5' (SEQ ID NO: 7110)

C5-3007 Target:
5'-TAGGTGAGATCTTGTCTGCAGTTCTAA-3' (SEQ ID NO: 9420)

5'-G<u>UG</u>AGAUCUUGU<u>CUG</u>CAGUUCUAag-3' (SEQ ID NO: 4801)

3'-<u>UCCA</u>CUCUAGAACA<u>GA</u>CGUCAAG<u>AUUC</u>-5' (SEQ ID NO: 7111)

C5-3008 Target:
5'-AGGTGAGATCTTGTCTGCAGTTCTAAG-3' (SEQ ID NO: 9421)

5'-U<u>GA</u>GAUCUUGUCU<u>G</u>C<u>A</u>GUUCUAAgt-3' (SEQ ID NO: 4802)

3'-<u>CCA</u>CUCUAGAACAGA<u>C</u>GUCAAGAU<u>UCA</u>-5' (SEQ ID NO: 7112)

C5-3009 Target:
5'-GGTGAGATCTTGTCTGCAGTTCTAAGT-3' (SEQ ID NO: 9422)

5'-G<u>AG</u>AUCUUGUCUG<u>C</u>AGUUCUAAGtc-3' (SEQ ID NO: 4803)

3'-<u>CAC</u>UCUAGAACAGA<u>C</u>GUCAAGAUUC<u>AG</u>-5' (SEQ ID NO: 7113)

C5-3010 Target:
5'-GTGAGATCTTGTCTGCAGTTCTAAGTC-3' (SEQ ID NO: 9423)

5'-A<u>GA</u>UCUUGUCUGC<u>A</u>GUUCUAAGUca-3' (SEQ ID NO: 4804)

3'-<u>ACU</u>CUAGAACAGAC<u>G</u>UCAAGAUUC<u>AGU</u>-5' (SEQ ID NO: 7114)

C5-3011 Target:
5'-TGAGATCTTGTCTGCAGTTCTAAGTCA-3' (SEQ ID NO: 9424)

5'-G<u>AU</u>CUUGUCUGCA<u>GUU</u>CUAAGUCag-3' (SEQ ID NO: 4805)

3'-<u>CUC</u>UAGAACAGACGU<u>C</u>AAGAUUC<u>AGUC</u>-5' (SEQ ID NO: 7115)

C5-3012 Target:
5'-GAGATCTTGTCTGCAGTTCTAAGTCAG-3' (SEQ ID NO: 9425)

5'-A<u>UC</u>UUGUCUGCAG<u>UU</u>CUAAGUCAgg-3' (SEQ ID NO: 4806)

3'-<u>UCU</u>AGAACAGACGU<u>C</u>AAGAUUCAG<u>UCC</u>-5' (SEQ ID NO: 7116)

C5-3013 Target:
5'-AGATCTTGTCTGCAGTTCTAAGTCAGG-3' (SEQ ID NO: 9426)

5'-U<u>CU</u>UGUCUGCAGU<u>U</u>C<u>U</u>AAGUCAGga-3' (SEQ ID NO: 4807)

3'-<u>CUAG</u>AACAGACGUC<u>AA</u>GAUUCAG<u>UCCU</u>-5' (SEQ ID NO: 7117)

C5-3014 Target:
5'-GATCTTGTCTGCAGTTCTAAGTCAGGA-3' (SEQ ID NO: 9427)

5'-C<u>UU</u>GUCUGCAGUU<u>CU</u>AAGUCAGGaa-3' (SEQ ID NO: 4808)

3'-<u>UAG</u>AACAGACGUC<u>AAG</u>AUUCAGU<u>CCUU</u>-5' (SEQ ID NO: 7118)

C5-3015 Target:
5'-ATCTTGTCTGCAGTTCTAAGTCAGGAA-3' (SEQ ID NO: 9428)

5'-U<u>UG</u>UCUGCAGUUC<u>U</u>AAGUCAGGAag-3' (SEQ ID NO: 4809)

3'-<u>AGA</u>ACAGACGUCA<u>AG</u>AUUCAGUC<u>CUUC</u>-5' (SEQ ID NO: 7119)

C5-3016 Target:
5'-TCTTGTCTGCAGTTCTAAGTCAGGAAG-3' (SEQ ID NO: 9429)

5'-G<u>GAA</u>GGCAUCAAUAU<u>C</u>CUAACCCac-3' (SEQ ID NO: 4810)

3'-<u>GUCC</u>UUCCGUAGUUA<u>U</u>AGGAUUGGG<u>UG</u>-5' (SEQ ID NO: 7120)

TABLE 7-continued

Human Anti-C5 DsiRNAs Predicted to have >50% Knockdown Efficacy (Asymmetrics)

C5-3036 Target:
5'-CAGGAAGGCATCAATATCCTAACCCAC-3' (SEQ ID NO: 9430)

5'-G<u>AA</u>GGCAUCAAUAU<u>CC</u>UAACCCAcc-3' (SEQ ID NO: 4811)

3'-<u>UCCU</u>UCCGUAGUUAU<u>A</u>GGAUUGGG<u>UGG</u>-5' (SEQ ID NO: 7121)

C5-3037 Target:
5'-AGGAAGGCATCAATATCCTAACCCACC-3' (SEQ ID NO: 9431)

5'-<u>A</u>AGGCAUCAAUAU<u>CC</u>UAACCCACct-3' (SEQ ID NO: 4812)

3'-<u>CCUU</u>CCGUAGUUAU<u>AGG</u>AUUGGG<u>UGGA</u>-5' (SEQ ID NO: 7122)

C5-3038 Target:
5'-GGAAGGCATCAATATCCTAACCCACCT-3' (SEQ ID NO: 9432)

5'-<u>A</u>GGCAUCAAUAUC<u>CU</u>AACCCACCtc-3' (SEQ ID NO: 4813)

3'-<u>CUUCC</u>GUAGUUAU<u>AGG</u>AUUGGGU<u>GGAG</u>-5' (SEQ ID NO: 7123)

C5-3039 Target:
5'-GAAGGCATCAATATCCTAACCCACCTC-3' (SEQ ID NO: 9433)

5'-G<u>GC</u>AUCAAUAUCC<u>UA</u>ACCCACCUcc-3' (SEQ ID NO: 4814)

3'-<u>UUCC</u>GUAGUUAUAGG<u>A</u>UUGGGUGG<u>AGG</u>-5' (SEQ ID NO: 7124)

C5-3040 Target:
5'-AAGGCATCAATATCCTAACCCACCTCC-3' (SEQ ID NO: 9434)

5'-G<u>C</u>AUCAAUAUCCU<u>AA</u>CCCACCUCcc-3' (SEQ ID NO: 4815)

3'-<u>UCCG</u>UAGUUAUAGG<u>AU</u>UGGGUGG<u>AGGG</u>-5' (SEQ ID NO: 7125)

C5-3041 Target:
5'-AGGCATCAATATCCTAACCCACCTCCC-3' (SEQ ID NO: 9435)

5'-C<u>AU</u>CAAUAUCCUA<u>ACC</u>CACCUCCcc-3' (SEQ ID NO: 4816)

3'-<u>CCGU</u>AGUUAUAGGA<u>UU</u>GGGUGGA<u>GGGG</u>-5' (SEQ ID NO: 7126)

C5-3042 Target:
5'-GGCATCAATATCCTAACCCACCTCCCC-3' (SEQ ID NO: 9436)

5'-A<u>UC</u>AAUAUCCUAA<u>CCC</u>ACCUCCCca-3' (SEQ ID NO: 4817)

3'-<u>CGUA</u>GUUAUAGGAU<u>UGG</u>GUGGAG<u>GGGU</u>-5' (SEQ ID NO: 7127)

C5-3043 Target:
5'-GCATCAATATCCTAACCCACCTCCCCA-3' (SEQ ID NO: 9437)

5'-U<u>CA</u>AUAUCCUAAC<u>CC</u>ACCUCCCCaa-3' (SEQ ID NO: 4818)

3'-<u>GUAG</u>UUAUAGGAUU<u>GGG</u>UGGAGG<u>GGUU</u>-5' (SEQ ID NO: 7128)

C5-3044 Target:
5'-CATCAATATCCTAACCCACCTCCCCAA-3' (SEQ ID NO: 9438)

5'-C<u>AA</u>UAUCCUAACC<u>AC</u>CUCCCCAaa-3' (SEQ ID NO: 4819)

3'-<u>UAGU</u>UAUAGGAUUGG<u>G</u>UGGAGGG<u>GUUU</u>-5' (SEQ ID NO: 7129)

C5-3045 Target:
5'-ATCAATATCCTAACCCACCTCCCCAAA-3' (SEQ ID NO: 9439)

5'-A<u>AU</u>AUCCUAACCC<u>ACC</u>UCCCCAAag-3' (SEQ ID NO: 4820)

3'-<u>AGUU</u>AUAGGAUUGGGUGGAGGG<u>GUUUC</u>-5' (SEQ ID NO: 7130)

C5-3046 Target:
5'-TCAATATCCTAACCCACCTCCCCAAAG-3' (SEQ ID NO: 9440)

5'-A<u>UA</u>UCCUAACCCA<u>CC</u>UCCCCAAAgg-3' (SEQ ID NO: 4821)

3'-<u>GUUA</u>UAGGAUUGGGUGGAGGGG<u>UUUCC</u>-5' (SEQ ID NO: 7131)

TABLE 7-continued

Human Anti-C5 DsiRNAs Predicted to have >50% Knockdown Efficacy (Asymmetrics)

C5-3047 Target:
5'-CAATATCCTAACCCACCTCCCCAAAGG-3' (SEQ ID NO: 9441)

5'-U<u>AU</u>CCUAACCCACC<u>UC</u>CCCAAAGgg-3' (SEQ ID NO: 4822)

3'-<u>UUAUA</u>GGAUUGGGU<u>GG</u>AGGGGUUU<u>CCC</u>-5' (SEQ ID NO: 7132)

C5-3048 Target:
5'-AATATCCTAACCCACCTCCCCAAAGGG-3' (SEQ ID NO: 9442)

5'-A<u>A</u>CCCACCUCCCC<u>AA</u>AGGGAGUGCa-3' (SEQ ID NO: 4823)

3'-<u>GAU</u>UGGGUGGAGGGG<u>UUU</u>CCCUC<u>ACGU</u>-5' (SEQ ID NO: 7133)

C5-3054 Target:
5'-CTAACCCACCTCCCCAAAGGGAGTGCA-3' (SEQ ID NO: 9443)

5'-A<u>CCC</u>ACCUCCCC<u>AAA</u>GGGAGUGCag-3' (SEQ ID NO: 4824)

3'-<u>AUU</u>GGGUGGAGGGGUUU<u>CCC</u>UCAC<u>GUC</u>-5' (SEQ ID NO: 7134)

C5-3055 Target:
5'-TAACCCACCTCCCCAAAGGGAGTGCAG-3' (SEQ ID NO: 9444)

5'-C<u>CC</u>ACCUCCCCA<u>AA</u>GGGAGUGCAga-3' (SEQ ID NO: 4825)

3'-<u>UUGGG</u>UGGAGGGGUUU<u>CC</u>CUCACGUC<u>U</u>-5' (SEQ ID NO: 7135)

C5-3056 Target:
5'-AACCCACCTCCCCAAAGGGAGTGCAGA-3' (SEQ ID NO: 9445)

5'-GAGG<u>C</u>GGAGCUGA<u>UG</u>AGCGUUGU<u>cc</u>-3' (SEQ ID NO: 4826)

3'-<u>GUCU</u>CCGCCUCGACU<u>AC</u>UCGCAAC<u>AGG</u>-5' (SEQ ID NO: 7136)

C5-3079 Target:
5'-CAGAGGCGGAGCTGATGAGCGTTGTCC-3' (SEQ ID NO: 9446)

5'-GC<u>GG</u>AGCUGAUGA<u>GCG</u>UUGUCCCag-3' (SEQ ID NO: 4827)

3'-<u>UCCGC</u>CUCGACUACU<u>C</u>GCAACAGG<u>GUC</u>-5' (SEQ ID NO: 7137)

C5-3082 Target:
5'-AGGCGGAGCTGATGAGCGTTGTCCCAG-3' (SEQ ID NO: 9447)

5'-C<u>GG</u>AGCUGAUGAGC<u>G</u>UUGUCCCAgt-3' (SEQ ID NO: 4828)

3'-<u>CCGC</u>CUCGACUACUC<u>G</u>CAACAGGG<u>UCA</u>-5' (SEQ ID NO: 7138)

C5-3083 Target:
5'-GGCGGAGCTGATGAGCGTTGTCCCAGT-3' (SEQ ID NO: 9448)

5'-GG<u>A</u>GCUGAUGAGCG<u>UU</u>GUCCCAGta-3' (SEQ ID NO: 4829)

3'-<u>CGCC</u>UCGACUACUCGC<u>AA</u>CAGGGU<u>CAU</u>-5' (SEQ ID NO: 7139)

C5-3084 Target:
5'-GCGGAGCTGATGAGCGTTGTCCCAGTA-3' (SEQ ID NO: 9449)

5'-GA<u>G</u>CUGAUGAGCG<u>U</u>UGUCCCAGUat-3' (SEQ ID NO: 4830)

3'-<u>GCC</u>U<u>C</u>GACUACUCGC<u>AA</u>CAGGGUC<u>AUA</u>-5' (SEQ ID NO: 7140)

C5-3085 Target:
5'-CGGAGCTGATGAGCGTTGTCCCAGTAT-3' (SEQ ID NO: 9450)

5'-A<u>G</u>CUGAUGAGCGUU<u>G</u>UCCCAGUAtt-3' (SEQ ID NO: 4831)

3'-<u>CC</u>U<u>C</u>GACUACUCGC<u>AA</u>CAGGGUCAU<u>AA</u>-5' (SEQ ID NO: 7141)

C5-3086 Target:
5'-GGAGCTGATGAGCGTTGTCCCAGTATT-3' (SEQ ID NO: 9451)

5'-GC<u>U</u>GAUGAGCGUUG<u>U</u>CCCAGUAUtc-3' (SEQ ID NO: 4832)

3'-<u>CUCGA</u>CUACUCGCA<u>A</u>CAGGGUCA<u>UAAG</u>-5' (SEQ ID NO: 7142)

TABLE 7-continued

Human Anti-C5 DsiRNAs Predicted to have >50% Knockdown Efficacy (Asymmetrics)

C5-3087 Target:
5'-GAGCTGATGAGCGTTGTCCCAGTATTC-3' (SEQ ID NO: 9452)

5'-C<u>UG</u>AUGAGCGUUG<u>U</u>CCCAGUAUUct-3' (SEQ ID NO: 4833)

3'-<u>UCG</u>ACUACUCGCAAC<u>A</u>GGGUCAU<u>AAGA</u>-5' (SEQ ID NO: 7143)

C5-3088 Target:
5'-AGCTGATGAGCGTTGTCCCAGTATTCT-3' (SEQ ID NO: 9453)

5'-U<u>G</u>AUGAGCGUUGU<u>C</u>CCAGUAUUCta-3' (SEQ ID NO: 4834)

3'-<u>CG</u>ACUACUCGCAAC<u>A</u>GGGUCAUAAG<u>AU</u>-5' (SEQ ID NO: 7144)

C5-3089 Target:
5'-GCTGATGAGCGTTGTCCCAGTATTCTA-3' (SEQ ID NO: 9454)

5'-G<u>AU</u>GAGCGUUGUCC<u>CA</u>GUAUUCUat-3' (SEQ ID NO: 4835)

3'-<u>GAC</u>UACUCGCAACAGGGUCAUAAG<u>AUA</u>-5' (SEQ ID NO: 7145)

C5-3090 Target:
5'-CTGATGAGCGTTGTCCCAGTATTCTAT-3' (SEQ ID NO: 9455)

5'-<u>A</u>UG<u>A</u>GCGUUGUCCC<u>A</u>GUAUUCUAtg-3' (SEQ ID NO: 4836)

3'-<u>A</u>CUACUCGCAACAGGGUCAUAAG<u>AUAC</u>-5' (SEQ ID NO: 7146)

C5-3091 Target:
5'-TGATGAGCGTTGTCCCAGTATTCTATG-3' (SEQ ID NO: 9456)

5'-U<u>G</u>AGCGUUGUCCC<u>A</u>GUAUUCUAUgt-3' (SEQ ID NO: 4837)

3'-<u>CUA</u>CUCGCAACAGG<u>GU</u>CAUAAGAU<u>ACA</u>-5' (SEQ ID NO: 7147)

C5-3092 Target:
5'-GATGAGCGTTGTCCCAGTATTCTATGT-3' (SEQ ID NO: 9457)

5'-GAGCGUUGUCCCA<u>GU</u>AUUCUAUGtt-3' (SEQ ID NO: 4838)

3'-<u>UAC</u>UCGCAACAGGGU<u>C</u>AUAAGAU<u>ACAA</u>-5' (SEQ ID NO: 7148)

C5-3093 Target:
5'-ATGAGCGTTGTCCCAGTATTCTATGTT-3' (SEQ ID NO: 9458)

5'-AGCGUUGUCCCAGU<u>A</u>UUCUAUGUtt-3' (SEQ ID NO: 4839)

3'-<u>ACU</u>CGCAACAGGGUC<u>A</u>UAAGAUACAAA-5' (SEQ ID NO: 7149)

C5-3094 Target:
5'-TGAGCGTTGTCCCAGTATTCTATGTTT-3' (SEQ ID NO: 9459)

5'-GC<u>G</u>UUGUCCCAGU<u>AU</u>UCUAUGUtt-3' (SEQ ID NO: 4840)

3'-<u>CUCG</u>CAACAGGGUC<u>AU</u>AAGAUACAAAA-5' (SEQ ID NO: 7150)

C5-3095 Target:
5'-GAGCGTTGTCCCAGTATTCTATGTTTT-3' (SEQ ID NO: 9460)

5'-C<u>GU</u>UGUCCCAGU<u>AU</u>UCUAUGUUUtt-3' (SEQ ID NO: 4841)

3'-<u>UCGC</u>AACAGGGUC<u>AU</u>AAGAUACAAAAA-5' (SEQ ID NO: 7151)

C5-3096 Target:
5'-AGCGTTGTCCCAGTATTCTATGTTTTT-3' (SEQ ID NO: 9461)

5'-G<u>UU</u>GUCCCAGUAU<u>U</u>CUAUGUUUUtc-3' (SEQ ID NO: 4842)

3'-<u>CGC</u>AACAGGGUCAU<u>A</u>AGAUACAAAAAG-5' (SEQ ID NO: 7152)

C5-3097 Target:
5'-GCGTTGTCCCAGTATTCTATGTTTTTC-3' (SEQ ID NO: 9462)

5'-<u>UUG</u>UCCCAGUAUUC<u>U</u>AUGUUUUUca-3' (SEQ ID NO: 4843)

3'-<u>GC</u>AACAGGGUCAUAAG<u>A</u>UACAAAAAGU-5' (SEQ ID NO: 7153)

TABLE 7-continued

Human Anti-C5 DsiRNAs Predicted to have >50% Knockdown Efficacy (Asymmetrics)

C5-3098 Target:
5'-CGTTGTCCCAGTATTCTATGTTTTTCA-3' (SEQ ID NO: 9463)

5'-UGUCCCAGUAUUCUAUGUUUUUCac-3' (SEQ ID NO: 4844)

3'-CAACAGGGUCAUAAGAUACAAAAAGUG-5' (SEQ ID NO: 7154)

C5-3099 Target:
5'-GTTGTCCCAGTATTCTATGTTTTTCAC-3' (SEQ ID NO: 9464)

5'-GUCCCAGUAUUCUAUGUUUUUCAct-3' (SEQ ID NO: 4845)

3'-AACAGGGUCAUAAGAUACAAAAAGUGA-5' (SEQ ID NO: 7155)

C5-3100 Target:
5'-TTGTCCCAGTATTCTATGTTTTTCACT-3' (SEQ ID NO: 9465)

5'-UCCCAGUAUUCUAUGUUUUUCACta-3' (SEQ ID NO: 4846)

3'-ACAGGGUCAUAAGAUACAAAAAGUGAU-5' (SEQ ID NO: 7156)

C5-3101 Target:
5'-TGTCCCAGTATTCTATGTTTTTCACTA-3' (SEQ ID NO: 9466)

5'-CCCAGUAUUCUAUGUUUUUCACUac-3' (SEQ ID NO: 4847)

3'-CAGGGUCAUAAGAUACAAAAAGUGAUG-5' (SEQ ID NO: 7157)

C5-3102 Target:
5'-GTCCCAGTATTCTATGTTTTTCACTAC-3' (SEQ ID NO: 9467)

5'-CAGUAUUCUAUGUUUUUCACUACct-3' (SEQ ID NO: 4848)

3'-GGGUCAUAAGAUACAAAAAGUGAUGGA-5' (SEQ ID NO: 7158)

C5-3104 Target:
5'-CCCAGTATTCTATGTTTTTCACTACCT-3' (SEQ ID NO: 9468)

5'-AGUAUUCUAUGUUUUUCACUACCtg-3' (SEQ ID NO: 4849)

3'-GGUCAUAAGAUACAAAAAGUGAUGGAC-5' (SEQ ID NO: 7159)

C5-3105 Target:
5'-CCAGTATTCTATGTTTTTCACTACCTG-3' (SEQ ID NO: 9469)

5'-GUAUUCUAUGUUUUUCACUACCUgg-3' (SEQ ID NO: 4850)

3'-GUCAUAAGAUACAAAAAGUGAUGGACC-5' (SEQ ID NO: 7160)

C5-3106 Target:
5'-CAGTATTCTATGTTTTTCACTACCTGG-3' (SEQ ID NO: 9470)

5'-UAUUCUAUGUUUUUCACUACCUGga-3' (SEQ ID NO: 4851)

3'-UCAUAAGAUACAAAAAGUGAUGGACCU-5' (SEQ ID NO: 7161)

C5-3107 Target:
5'-AGTATTCTATGTTTTTCACTACCTGGA-3' (SEQ ID NO: 9471)

5'-AUUCUAUGUUUUUCACUACCUGGaa-3' (SEQ ID NO: 4852)

3'-CAUAAGAUACAAAAAGUGAUGGACCUU-5' (SEQ ID NO: 7162)

C5-3108 Target:
5'-GTATTCTATGTTTTTCACTACCTGGAA-3' (SEQ ID NO: 9472)

5'-UUCUAUGUUUUUCACUACCUGGAaa-3' (SEQ ID NO: 4853)

3'-AUAAGAUACAAAAAGUGAUGGACCUUU-5' (SEQ ID NO: 7163)

C5-3109 Target:
5'-TATTCTATGTTTTTCACTACCTGGAAA-3' (SEQ ID NO: 9473)

5'-UCUAUGUUUUUCACUACCUGGAAac-3' (SEQ ID NO: 4854)

3'-UAAGAUACAAAAAGUGAUGGACCUUUG-5' (SEQ ID NO: 7164)

C5-3110 Target:
5'-ATTCTATGTTTTTCACTACCTGGAAAC-3' (SEQ ID NO: 9474)

5'-CUAUGUUUUUCACUACCUGGAAAca-3' (SEQ ID NO: 4855)

3'-AAGAUACAAAAAGUGAUGGACCUUUGU-5' (SEQ ID NO: 7165)

C5-3111 Target:
5'-TTCTATGTTTTTCACTACCTGGAAACA-3' (SEQ ID NO: 9475)

5'-UAUGUUUUUCACUACCUGGAAACag-3' (SEQ ID NO: 4856)

3'-AGAUACAAAAAGUGAUGGACCUUUGUC-5' (SEQ ID NO: 7166)

C5-3112 Target:
5'-TCTATGTTTTTCACTACCTGGAAACAG-3' (SEQ ID NO: 9476)

5'-AUGUUUUUCACUACCUGGAAACAgg-3' (SEQ ID NO: 4857)

3'-GAUACAAAAAGUGAUGGACCUUUGUCC-5' (SEQ ID NO: 7167)

C5-3113 Target:
5'-CTATGTTTTTCACTACCTGGAAACAGG-3' (SEQ ID NO: 9477)

5'-UGUUUUUCACUACCUGGAAACAGga-3' (SEQ ID NO: 4858)

3'-AUACAAAAAGUGAUGGACCUUUGUCCU-5' (SEQ ID NO: 7168)

C5-3114 Target:
5'-TATGTTTTTCACTACCTGGAAACAGGA-3' (SEQ ID NO: 9478)

5'-GUUUUUCACUACCUGGAAACAGGaa-3' (SEQ ID NO: 4859)

3'-UACAAAAAGUGAUGGACCUUUGUCCUU-5' (SEQ ID NO: 7169)

C5-3115 Target:
5'-ATGTTTTTCACTACCTGGAAACAGGAA-3' (SEQ ID NO: 9479)

5'-UUUUUCACUACCUGGAAACAGGAaa-3' (SEQ ID NO: 4860)

3'-ACAAAAAGUGAUGGACCUUUGUCCUUU-5' (SEQ ID NO: 7170)

C5-3116 Target:
5'-TGTTTTTCACTACCTGGAAACAGGAAA-3' (SEQ ID NO: 9480)

5'-UUUUCACUACCUGGAAACAGGAAat-3' (SEQ ID NO: 4861)

3'-CAAAAAGUGAUGGACCUUUGUCCUUUA-5' (SEQ ID NO: 7171)

C5-3117 Target:
5'-GTTTTTCACTACCTGGAAACAGGAAAT-3' (SEQ ID NO: 9481)

5'-UUUCACUACCUGGAAACAGGAAAtc-3' (SEQ ID NO: 4862)

3'-AAAAAGUGAUGGACCUUUGUCCUUUAG-5' (SEQ ID NO: 7172)

C5-3118 Target:
5'-TTTTTCACTACCTGGAAACAGGAAATC-3' (SEQ ID NO: 9482)

5'-UUCACUACCUGGAAACAGGAAAUca-3' (SEQ ID NO: 4863)

3'-AAAAGUGAUGGACCUUUGUCCUUUAGU-5' (SEQ ID NO: 7173)

C5-3119 Target:
5'-TTTTCACTACCTGGAAACAGGAAATCA-3' (SEQ ID NO: 9483)

5'-UCACUACCUGGAAACAGGAAAUCat-3' (SEQ ID NO: 4864)

3'-AAAGUGAUGGACCUUUGUCCUUUAGUA-5' (SEQ ID NO: 7174)

C5-3120 Target:
5'-TTTCACTACCTGGAAACAGGAAATCAT-3' (SEQ ID NO: 9484)

5'-CACUACCUGGAAACAGGAAAUCAtt-3' (SEQ ID NO: 4865)

3'-AAGUGAUGGACCUUUGUCCUUUAGUAA-5' (SEQ ID NO: 7175)

TABLE 7-continued

Human Anti-C5 DsiRNAs Predicted to have >50% Knockdown Efficacy (Asymmetrics)

C5-3121 Target:
5'-TTCACTACCTGGAAACAGGAAATCATT-3' (SEQ ID NO: 9485)

5'-ACUACCUGGAAACAGGAAAUCAUtg-3' (SEQ ID NO: 4866)

3'-AGUGAUGGACCUUUGUCCUUUAGUAAC-5' (SEQ ID NO: 7176)

C5-3122 Target:
5'-TCACTACCTGGAAACAGGAAATCATTG-3' (SEQ ID NO: 9486)

5'-CUACCUGGAAACAGGAAAUCAUUgg-3' (SEQ ID NO: 4867)

3'-GUGAUGGACCUUUGUCCUUUAGUAACC-5' (SEQ ID NO: 7177)

C5-3123 Target:
5'-CACTACCTGGAAACAGGAAATCATTGG-3' (SEQ ID NO: 9487)

5'-UACCUGGAAACAGGAAAUCAUUGga-3' (SEQ ID NO: 4868)

3'-UGAUGGACCUUUGUCCUUUAGUAACCU-5' (SEQ ID NO: 7178)

C5-3124 Target:
5'-ACTACCTGGAAACAGGAAATCATTGGA-3' (SEQ ID NO: 9488)

5'-ACCUGGAAACAGGAAAUCAUUGGaa-3' (SEQ ID NO: 4869)

3'-GAUGGACCUUUGUCCUUUAGUAACCUU-5' (SEQ ID NO: 7179)

C5-3125 Target:
5'-CTACCTGGAAACAGGAAATCATTGGAA-3' (SEQ ID NO: 9489)

5'-CCUGGAAACAGGAAAUCAUUGGac-3' (SEQ ID NO: 4870)

3'-AUGGACCUUUGUCCUUUAGUAACCUUG-5' (SEQ ID NO: 7180)

C5-3126 Target:
5'-TACCTGGAAACAGGAAATCATTGGAAC-3' (SEQ ID NO: 9490)

5'-CUGGAAACAGGAAAUCAUUGGAAca-3' (SEQ ID NO: 4871)

3'-UGGACCUUUGUCCUUUAGUAACCUUGU-5' (SEQ ID NO: 7181)

C5-3127 Target:
5'-ACCTGGAAACAGGAAATCATTGGAACA-3' (SEQ ID NO: 9491)

5'-UGGAAACAGGAAAUCAUUGGAAcat-3' (SEQ ID NO: 4872)

3'-GGACCUUUGUCCUUUAGUAACCUUGUA-5' (SEQ ID NO: 7182)

C5-3128 Target:
5'-CCTGGAAACAGGAAATCATTGGAACAT-3' (SEQ ID NO: 9492)

5'-GGAAACAGGAAAUCAUUGGAACAtt-3' (SEQ ID NO: 4873)

3'-GACCUUUGUCCUUUAGUAACCUUGUAA-5' (SEQ ID NO: 7183)

C5-3129 Target:
5'-CTGGAAACAGGAAATCATTGGAACATT-3' (SEQ ID NO: 9493)

5'-GAAACAGGAAAUCAUUGGAACAUtt-3' (SEQ ID NO: 4874)

3'-ACCUUUGUCCUUUAGUAACCUUGUAAA-5' (SEQ ID NO: 7184)

C5-3130 Target:
5'-TGGAAACAGGAAATCATTGGAACATTT-3' (SEQ ID NO: 9494)

5'-AAACAGGAAAUCAUUGGAACAUUtt-3' (SEQ ID NO: 4875)

3'-CCUUUGUCCUUUAGUAACCUUGUAAAA-5' (SEQ ID NO: 7185)

C5-3131 Target:
5'-GGAAACAGGAAATCATTGGAACATTTT-3' (SEQ ID NO: 9495)

5'-AACAGGAAAUCAUUGGAACAUUUtt-3' (SEQ ID NO: 4876)

3'-CUUUGUCCUUUAGUAACCUUGUAAAAA-5' (SEQ ID NO: 7186)

TABLE 7-continued

Human Anti-C5 DsiRNAs Predicted to have >50% Knockdown Efficacy (Asymmetrics)

C5-3132 Target:
5'-GAAACAGGAAATCATTGGAACATTTTT-3' (SEQ ID NO: 9496)

5'-ACAGGAAAUCAUUGGAACAUUUUtc-3' (SEQ ID NO: 4877)

3'-UUUGUCCUUUAGUAACCUUGUAAAAAG-5' (SEQ ID NO: 7187)

C5-3133 Target:
5'-AAACAGGAAATCATTGGAACATTTTTC-3' (SEQ ID NO: 9497)

5'-CAGGAAAUCAUUGGAACAUUUUUca-3' (SEQ ID NO: 4878)

3'-UUGUCCUUUAGUAACCUUGUAAAAAGU-5' (SEQ ID NO: 7188)

C5-3134 Target:
5'-AACAGGAAATCATTGGAACATTTTTCA-3' (SEQ ID NO: 9498)

5'-GAAAUCAUUGGAACAUUUUUCAUtc-3' (SEQ ID NO: 4879)

3'-UCCUUUAGUAACCUUGUAAAAAGUAAG-5' (SEQ ID NO: 7189)

C5-3137 Target:
5'-AGGAAATCATTGGAACATTTTTCATTC-3' (SEQ ID NO: 9499)

5'-AAAUCAUUGGAACAUUUUUCAUUct-3' (SEQ ID NO: 4880)

3'-CCUUUAGUAACCUUGUAAAAAGUAAGA-5' (SEQ ID NO: 7190)

C5-3138 Target:
5'-GGAAATCATTGGAACATTTTTCATTCT-3' (SEQ ID NO: 9500)

5'-AAUCAUUGGAACAUUUUUCAUUCtg-3' (SEQ ID NO: 4881)

3'-CUUUAGUAACCUUGUAAAAAGUAAGAC-5' (SEQ ID NO: 7191)

C5-3139 Target:
5'-GAAATCATTGGAACATTTTTCATTCTG-3' (SEQ ID NO: 9501)

5'-AUCAUUGGAACAUUUUUCAUUCUga-3' (SEQ ID NO: 4882)

3'-UUUAGUAACCUUGUAAAAAGUAAGACU-5' (SEQ ID NO: 7192)

C5-3140 Target:
5'-AAATCATTGGAACATTTTTCATTCTGA-3' (SEQ ID NO: 9502)

5'-UCAUUGGAACAUUUUUCAUUCUGac-3' (SEQ ID NO: 4883)

3'-UUAGUAACCUUGUAAAAAGUAAGACUG-5' (SEQ ID NO: 7193)

C5-3141 Target:
5'-AATCATTGGAACATTTTTCATTCTGAC-3' (SEQ ID NO: 9503)

5'-CAUUGGAACAUUUUUCAUUCUGAcc-3' (SEQ ID NO: 4884)

3'-UAGUAACCUUGUAAAAAGUAAGACUGG-5' (SEQ ID NO: 7194)

C5-3142 Target:
5'-ATCATTGGAACATTTTTCATTCTGACC-3' (SEQ ID NO: 9504)

5'-AUUGGAACAUUUUUCAUUCUGACcc-3' (SEQ ID NO: 4885)

3'-AGUAACCUUGUAAAAAGUAAGACUGGG-5' (SEQ ID NO: 7195)

C5-3143 Target:
5'-TCATTGGAACATTTTTCATTCTGACCC-3' (SEQ ID NO: 9505)

5'-GACCCAUUAAUUGAAAAGCAGAAac-3' (SEQ ID NO: 4886)

3'-GACUGGGUAAUUAACUUUUCGUCUUUG-5' (SEQ ID NO: 7196)

C5-3163 Target:
5'-CTGACCCATTAATTGAAAAGCAGAAAC-3' (SEQ ID NO: 9506)

5'-AGAAAAAUUAAAAGAAGGGAUGtt-3' (SEQ ID NO: 4887)

3'-CUUCUUUUUUAAUUUUCUUCCCUACAA-5' (SEQ ID NO: 7197)

TABLE 7-continued

Human Anti-C5 DsiRNAs Predicted to have >50% Knockdown Efficacy (Asymmetrics)

C5-3191 Target:
5'-GAAGAAAAAATTAAAAGAAGGGATGTTT-3' (SEQ ID NO: 9507)

5'-G<u>AAAAAAUUAAAAGAA</u>GGG<u>AUGUU</u>tg-3' (SEQ ID NO: 4888)

3'-<u>UUCUUUUUAAUUUUCUU</u>CCCU<u>AC</u>AA<u>C</u>-5' (SEQ ID NO: 7198)

C5-3192 Target:
5'-AAGAAAAAATTAAAAGAAGGGATGTTG-3' (SEQ ID NO: 9508)

5'-A<u>AAAAAUUAAAAGAA</u>GGG<u>AUGUU</u>ga-3' (SEQ ID NO: 4889)

3'-<u>UCUUUUUAAUUUUCUU</u>CCCU<u>AC</u>AA<u>CU</u>-5' (SEQ ID NO: 7199)

C5-3193 Target:
5'-AGAAAAAATTAAAAGAAGGGATGTTGA-3' (SEQ ID NO: 9509)

5'-A<u>AAAAUUAAAAGAA</u>GGG<u>AUGUU</u>Gag-3' (SEQ ID NO: 4890)

3'-<u>CUUUUUAAUUUUCUU</u>CCCU<u>AC</u>AA<u>CUC</u>-5' (SEQ ID NO: 7200)

C5-3194 Target:
5'-GAAAAAATTAAAAGAAGGGATGTTGAG-3' (SEQ ID NO: 9510)

5'-<u>AAAAUUAAAAGAA</u>GGG<u>AUGUU</u>GAgc-3' (SEQ ID NO: 4891)

3'-<u>UUUUUAAUUUUCUU</u>CCCU<u>AC</u>AA<u>CUCG</u>-5' (SEQ ID NO: 7201)

C5-3195 Target:
5'-AAAAAATTAAAAGAAGGGATGTTGAGC-3' (SEQ ID NO: 9511)

5'-U<u>GAG</u>C<u>AUU</u>AUGU<u>CCU</u>A<u>C</u>AGAAAU<u>G</u>c-3' (SEQ ID NO: 4892)

3'-<u>CAACUCGUAAUACAGG</u>AU<u>GUCUUUACG</u>-5' (SEQ ID NO: 7202)

C5-3215 Target:
5'-GTTGAGCATTATGTCCTACAGAAATGC-3' (SEQ ID NO: 9512)

5'-A<u>GC</u>AUU<u>AUGUCCU</u>A<u>C</u>AGAAAUGCUg-3' (SEQ ID NO: 4893)

3'-<u>ACUCGUAAUACAGG</u>AU<u>GUCUUUACGAC</u>-5' (SEQ ID NO: 7203)

C5-3217 Target:
5'-TGAGCATTATGTCCTACAGAAATGCTG-3' (SEQ ID NO: 9513)

5'-<u>GC</u>AUU<u>AUGUCCU</u>A<u>C</u>AGAAAUGCUga-3' (SEQ ID NO: 4894)

3'-<u>CUCGUAAUACAGG</u>AU<u>GUCUUUACGACU</u>-5' (SEQ ID NO: 7204)

C5-3218 Target:
5'-GAGCATTATGTCCTACAGAAATGCTGA-3' (SEQ ID NO: 9514)

5'-<u>C</u>AUU<u>AUGUCCU</u>A<u>C</u>A<u>G</u>AAAUGCU<u>G</u>ac-3' (SEQ ID NO: 4895)

3'-<u>UCGUAAUACAGG</u>AU<u>GUCUUUACG</u>A<u>CUG</u>-5' (SEQ ID NO: 7205)

C5-3219 Target:
5'-AGCATTATGTCCTACAGAAATGCTGAC-3' (SEQ ID NO: 9515)

5'-<u>A</u>UU<u>AUGUCCU</u>A<u>C</u>AG<u>A</u>AAUGCU<u>G</u>Act-3' (SEQ ID NO: 4896)

3'-<u>CGUAAUACAGG</u>AU<u>GUCUUUACGACUGA</u>-5' (SEQ ID NO: 7206)

C5-3220 Target:
5'-GCATTATGTCCTACAGAAATGCTGACT-3' (SEQ ID NO: 9516)

5'-<u>UU</u>AUGU<u>CCU</u>A<u>C</u>AGA<u>A</u>AUGCU<u>G</u>ACta-3' (SEQ ID NO: 4897)

3'-<u>GUAAUACAGG</u>AU<u>GUCUUUACGACUGAU</u>-5' (SEQ ID NO: 7207)

C5-3221 Target:
5'-CATTATGTCCTACAGAAATGCTGACTA-3' (SEQ ID NO: 9517)

5'-<u>U</u>AUGU<u>CCU</u>A<u>C</u>AGA<u>A</u>AUGCU<u>G</u>A<u>C</u>Uac-3' (SEQ ID NO: 4898)

3'-<u>UAAU</u>A<u>CAGG</u>AU<u>GUCUUUACG</u>A<u>C</u>U<u>GAUG</u>-5' (SEQ ID NO: 7208)

C5-3222 Target:
5'-ATTATGTCCTACAGAAATGCTGACTAC-3' (SEQ ID NO: 9518)

5'-<u>A</u>UGU<u>CCU</u>ACAGAA<u>A</u>UGCUGACUAct-3' (SEQ ID NO: 4899)

3'-<u>AAUA</u>CAGG<u>A</u>UGUCUU<u>U</u>A<u>C</u>GACUG<u>A</u>U<u>GA</u>-5' (SEQ ID NO: 7209)

C5-3223 Target:
5'-TTATGTCCTACAGAAATGCTGACTACT-3' (SEQ ID NO: 9519)

5'-<u>U</u>GU<u>CC</u>UACAGAA<u>U</u>GCUGACUACtc-3' (SEQ ID NO: 4900)

3'-<u>AUA</u>CAGG<u>A</u>UGUCUU<u>U</u>A<u>C</u>GACUGAU<u>GAG</u>-5' (SEQ ID NO: 7210)

C5-3224 Target:
5'-TATGTCCTACAGAAATGCTGACTACTC-3' (SEQ ID NO: 9520)

5'-<u>GUC</u>CUACAGAAAU<u>G</u>CUGACUACUct-3' (SEQ ID NO: 4901)

3'-<u>UAC</u>AGG<u>A</u>UGUCUU<u>U</u>A<u>C</u>GACUGAU<u>GAGA</u>-5' (SEQ ID NO: 7211)

C5-3225 Target:
5'-ATGTCCTACAGAAATGCTGACTACTCT-3' (SEQ ID NO: 9521)

5'-<u>UCC</u>UACAGAAAU<u>GC</u>UGACUACUCtt-3' (SEQ ID NO: 4902)

3'-<u>AC</u>AGG<u>A</u>UGUCUU<u>U</u>A<u>C</u>GACUGAU<u>GAGAA</u>-5' (SEQ ID NO: 7212)

C5-3226 Target:
5'-TGTCCTACAGAAATGCTGACTACTCTT-3' (SEQ ID NO: 9522)

5'-<u>CC</u>UACAGAAAUGCU<u>G</u>ACUACUCUta-3' (SEQ ID NO: 4903)

3'-<u>C</u>AGG<u>A</u>UGUCUUUACG<u>A</u>CUGAU<u>G</u>AG<u>AAU</u>-5' (SEQ ID NO: 7213)

C5-3227 Target:
5'-GTCCTACAGAAATGCTGACTACTCTTA-3' (SEQ ID NO: 9523)

5'-<u>A</u>GUGCUAGCACUUGG<u>U</u>UAACAGCUtt-3' (SEQ ID NO: 4904)

3'-<u>C</u>UU<u>CACGAUCGUGAACC</u>AAUUGU<u>C</u>GAA-5' (SEQ ID NO: 7214)

C5-3271 Target:
5'-GAAGTGCTAGCACTTGGTTAACAGCTT-3' (SEQ ID NO: 9524)

5'-<u>GUGC</u>UAGCACUUGG<u>U</u>U<u>A</u>ACAGCUtt-3' (SEQ ID NO: 4905)

3'-<u>UUCACGAUCGUGAACC</u>AAUUGU<u>C</u>GAAA-5' (SEQ ID NO: 7215)

C5-3272 Target:
5'-AAGTGCTAGCACTTGGTTAACAGCTTT-3' (SEQ ID NO: 9525)

5'-<u>UGC</u>UAGCACUUGG<u>UU</u>A<u>A</u>CAGCUUtt-3' (SEQ ID NO: 4906)

3'-<u>UCACGAUCGUGAACC</u>AAUUGU<u>C</u>GAAAA-5' (SEQ ID NO: 7216)

C5-3273 Target:
5'-AGTGCTAGCACTTGGTTAACAGCTTTT-3' (SEQ ID NO: 9526)

5'-<u>GC</u>UAGCACUUGG<u>UU</u>A<u>A</u>CAGCUUUtg-3' (SEQ ID NO: 4907)

3'-<u>CACG</u>AUCGUGAACC<u>AA</u>UUGUCGA<u>AAAC</u>-5' (SEQ ID NO: 7217)

C5-3274 Target:
5'-GTGCTAGCACTTGGTTAACAGCTTTTG-3' (SEQ ID NO: 9527)

5'-<u>C</u>UAGCACUUGG<u>UU</u>A<u>A</u>CAGCUUUUgc-3' (SEQ ID NO: 4908)

3'-<u>ACG</u>AUCGUGAACCAAUUGUCGA<u>AAACG</u>-5' (SEQ ID NO: 7218)

C5-3275 Target:
5'-TGCTAGCACTTGGTTAACAGCTTTTGC-3' (SEQ ID NO: 9528)

5'-<u>U</u>AGCACUUGGUUA<u>AC</u>AGCUUUUGct-3' (SEQ ID NO: 4909)

3'-<u>CGA</u>UCGUGAACCAAUUGUCGA<u>AAACGA</u>-5' (SEQ ID NO: 7219)

TABLE 7-continued

Human Anti-C5 DsiRNAs Predicted to have >50% Knockdown Efficacy (Asymmetrics)

C5-3276 Target:
5'-GCTAGCACTTGGTTAACAGCTTTTGCT-3' (SEQ ID NO: 9529)

5'-A<u>GC</u>A<u>C</u>UUGGUUAA<u>C</u>AG<u>C</u>UUUUGCtt-3' (SEQ ID NO: 4910)

3'-<u>GAUC</u>GUGAACCAAUU<u>G</u>U<u>C</u>GAAAA<u>CGAA</u>-5' (SEQ ID NO: 7220)

C5-3277 Target:
5'-CTAGCACTTGGTTAACAGCTTTTGCTT-3' (SEQ ID NO: 9530)

5'-G<u>C</u>A<u>C</u>UUGGUUAA<u>C</u>AG<u>C</u>UUUUGCUtt-3' (SEQ ID NO: 4911)

3'-<u>AUC</u>GUGAACCAAUU<u>G</u>U<u>C</u>GAAAAC<u>GAAA</u>-5' (SEQ ID NO: 7221)

C5-3278 Target:
5'-TAGCACTTGGTTAACAGCTTTTGCTTT-3' (SEQ ID NO: 9531)

5'-C<u>AC</u>UUGGUUAACAG<u>C</u>UUUUGC<u>U</u>Uta-3' (SEQ ID NO: 4912)

3'-<u>UC</u>GUGAACCAAUUGUC<u>G</u>AAAACGAAAU-5' (SEQ ID NO: 7222)

C5-3279 Target:
5'-AGCACTTGGTTAACAGCTTTTGCTTTA-3' (SEQ ID NO: 9532)

5'-A<u>C</u>UUGGUUAACAGC<u>U</u>UUUGCUUUaa-3' (SEQ ID NO: 4913)

3'-<u>CGUGA</u>ACCAAUUGUC<u>G</u>AAAACGA<u>AUU</u>-5' (SEQ ID NO: 7223)

C5-3280 Target:
5'-GCACTTGGTTAACAGCTTTTGCTTTAA-3' (SEQ ID NO: 9533)

5'-<u>UUGG</u>UUAACAGCUU<u>UU</u>GCUUUAga-3' (SEQ ID NO: 4914)

3'-<u>UGAAC</u>CAAUUGUC<u>G</u>AA<u>A</u>ACGAAA<u>UUCU</u>-5' (SEQ ID NO: 7224)

C5-3282 Target:
5'-ACTTGGTTAACAGCTTTTGCTTTAAGA-3' (SEQ ID NO: 9534)

5'-U<u>GG</u>UUAACAGCUUUUG<u>C</u>UUUAAGag-3' (SEQ ID NO: 4915)

3'-<u>GAAC</u>CAAUUGUC<u>GAAA</u>ACGAAAU<u>UCUC</u>-5' (SEQ ID NO: 7225)

C5-3283 Target:
5'-CTTGGTTAACAGCTTTTGCTTTAAGAG-3' (SEQ ID NO: 9535)

5'-U<u>UAA</u>CAGCUUUUG<u>C</u>UUUAAGAGUac-3' (SEQ ID NO: 4916)

3'-<u>CCAA</u>UUGUCGAAAA<u>C</u>GAAAUUCUC<u>AUG</u>-5' (SEQ ID NO: 7226)

C5-3286 Target:
5'-GGTTAACAGCTTTTGCTTTAAGAGTAC-3' (SEQ ID NO: 9536)

5'-U<u>AA</u>CAGCUUUUGC<u>U</u>UUAAGAGUAct-3' (SEQ ID NO: 4917)

3'-<u>C</u>AA<u>U</u>UGUCGAAAACG<u>A</u>AAUUCUC<u>AUGA</u>-5' (SEQ ID NO: 7227)

C5-3287 Target:
5'-GTTAACAGCTTTTGCTTTAAGAGTACT-3' (SEQ ID NO: 9537)

5'-A<u>AC</u>AGCUUUUGCUU<u>U</u>AAGAGUACtt-3' (SEQ ID NO: 4918)

3'-<u>AAU</u>UGUCGAAAACG<u>A</u>AAUUCUCAUGAA-5' (SEQ ID NO: 7228)

C5-3288 Target:
5'-TTAACAGCTTTTGCTTTAAGAGTACTT-3' (SEQ ID NO: 9538)

5'-A<u>C</u>AG<u>C</u>UUUUGCUUU<u>A</u>AGAGUA<u>C</u>Utg-3' (SEQ ID NO: 4919)

3'-<u>A</u>UUGUCGAAAACGA<u>A</u>AUUCUCAUGAA<u>C</u>-5' (SEQ ID NO: 7229)

C5-3289 Target:
5'-TAACAGCTTTTGCTTTAAGAGTACTTG-3' (SEQ ID NO: 9539)

5'-C<u>AGC</u>UUUUGCUUUA<u>A</u>GAGUACUUgg-3' (SEQ ID NO: 4920)

3'-<u>UUGUC</u>GAAAACGAAA<u>U</u>UCUCAUGA<u>ACC</u>-5' (SEQ ID NO: 7230)

C5-3290 Target:
5'-AACAGCTTTTGCTTTAAGAGTACTTGG-3' (SEQ ID NO: 9540)

5'-A<u>GC</u>UUUUGCUUUA<u>A</u>GAGUACUUGga-3' (SEQ ID NO: 4921)

3'-<u>U</u>GUCGAAAACGAAA<u>UU</u>CUCAUGA<u>ACCU</u>-5' (SEQ ID NO: 7231)

C5-3291 Target:
5'-ACAGCTTTTGCTTTAAGAGTACTTGGA-3' (SEQ ID NO: 9541)

5'-G<u>C</u>UUUUGCUUUAAG<u>AG</u>UACUUGGac-3' (SEQ ID NO: 4922)

3'-<u>GUC</u>GAAAACGAAAUU<u>C</u>UCAUGAA<u>CCUG</u>-5' (SEQ ID NO: 7232)

C5-3292 Target:
5'-CAGCTTTTGCTTTAAGAGTACTTGGAC-3' (SEQ ID NO: 9542)

5'-C<u>U</u>UUUUGCUUUAAG<u>AG</u>UACUUGGAca-3' (SEQ ID NO: 4923)

3'-<u>UCG</u>AAAACGAAAUUC<u>U</u>CAUGAA<u>CCUGU</u>-5' (SEQ ID NO: 7233)

C5-3293 Target:
5'-AGCTTTTGCTTTAAGAGTACTTGGACA-3' (SEQ ID NO: 9543)

5'-U<u>UUU</u>GCUUUAAGAG<u>UA</u>CUUGGACaa-3' (SEQ ID NO: 4924)

3'-<u>CGA</u>AAACGAAAUUC<u>U</u>C<u>A</u>UGAACCUGUU-5' (SEQ ID NO: 7234)

C5-3294 Target:
5'-GCTTTTGCTTTAAGAGTACTTGGACAA-3' (SEQ ID NO: 9544)

5'-U<u>UUU</u>GCUUUAAGAGU<u>A</u>CUUGGACAag-3' (SEQ ID NO: 4925)

3'-<u>GAAA</u>ACGAAAUUCUC<u>A</u>UGAACCUGUU<u>C</u>-5' (SEQ ID NO: 7235)

C5-3295 Target:
5'-CTTTTGCTTTAAGAGTACTTGGACAAG-3' (SEQ ID NO: 9545)

5'-U<u>UG</u>CUUUAAGAGUA<u>C</u>UUGGACAAgt-3' (SEQ ID NO: 4926)

3'-<u>AAAA</u>CGAAAUUCUC<u>A</u>UGAACCUGUU<u>CA</u>-5' (SEQ ID NO: 7236)

C5-3296 Target:
5'-TTTTGCTTTAAGAGTACTTGGACAAGT-3' (SEQ ID NO: 9546)

5'-U<u>GC</u>UUUAAGAGUA<u>C</u>UUGGACAAGta-3' (SEQ ID NO: 4927)

3'-<u>AAAC</u>GAAAUUCUCAUGAACCUGU<u>UCAU</u>-5' (SEQ ID NO: 7237)

C5-3297 Target:
5'-TTTGCTTTAAGAGTACTTGGACAAGTA-3' (SEQ ID NO: 9547)

5'-U<u>UU</u>AAGAGUACUUGG<u>A</u>CAAGUAAat-3' (SEQ ID NO: 4928)

3'-<u>CGAA</u>UUCUCAUGAA<u>CC</u>UGUUCA<u>UUUA</u>-5' (SEQ ID NO: 7238)

C5-3300 Target:
5'-GCTTTAAGAGTACTTGGACAAGTAAAT-3' (SEQ ID NO: 9548)

5'-U<u>UU</u>AAGAGUACUUG<u>GAC</u>AAGUAAAta-3' (SEQ ID NO: 4929)

3'-<u>GAAA</u>UUCUCAUGAA<u>CC</u>UGUUCA<u>UUUAU</u>-5' (SEQ ID NO: 7239)

C5-3301 Target:
5'-CTTTAAGAGTACTTGGACAAGTAAATA-3' (SEQ ID NO: 9549)

5'-G<u>UA</u>GAGCAGAACC<u>A</u>AAAUUCAAUtt-3' (SEQ ID NO: 4930)

3'-<u>UGCAU</u>CUCGUCUUGG<u>U</u>UUUAAGUU<u>AAA</u>-5' (SEQ ID NO: 7240)

C5-3331 Target:
5'-ACGTAGAGCAGAACCAAAATTCAATTT-3' (SEQ ID NO: 9550)

5'-U<u>GUA</u>AUUCUUUAU<u>U</u>GUGGCUAGUg-3' (SEQ ID NO: 4931)

3'-<u>AAAC</u>AUUAAGAAAUAA<u>C</u>ACCGAU<u>CAAC</u>-5' (SEQ ID NO: 7241)

TABLE 7-continued

Human Anti-C5 DsiRNAs Predicted to have >50%
Knockdown Efficacy (Asymmetrics)

C5-3355 Target:
5'-TTTGTAATTCTTTATTGTGGCTAGTTG-3' (SEQ ID NO: 9551)

5'-GUAAUUCUUUAUUGUGGCUAGUUga-3' (SEQ ID NO: 4932)

3'-AACAUUAAGAAAUAACACCGAUCAACU-5' (SEQ ID NO: 7242)

C5-3356 Target:
5'-TTGTAATTCTTTATTGTGGCTAGTTGA-3' (SEQ ID NO: 9552)

5'-UUCAAGGAAAAUUCACAGUAUCAac-3' (SEQ ID NO: 4933)

3'-GAAAGUUCCUUUUAAGUGUCAUAGUUG-5' (SEQ ID NO: 7243)

C5-3406 Target:
5'-CTTTCAAGGAAAATTCACAGTATCAAC-3' (SEQ ID NO: 9553)

5'-UCAAGGAAAAUUCACAGUAUCAAcc-3' (SEQ ID NO: 4934)

3'-AAAGUUCCUUUUAAGUGUCAUAGUUGG-5' (SEQ ID NO: 7244)

C5-3407 Target:
5'-TTTCAAGGAAAATTCACAGTATCAACC-3' (SEQ ID NO: 9554)

5'-CAAGGAAAAUUCACAGUAUCAACca-3' (SEQ ID NO: 4935)

3'-AAGUUCCUUUUAAGUGUCAUAGUUGGU-5' (SEQ ID NO: 7245)

C5-3408 Target:
5'-TTCAAGGAAAATTCACAGTATCAACCA-3' (SEQ ID NO: 9555)

5'-AAGGAAAAUUCACAGUAUCAACCaa-3' (SEQ ID NO: 4936)

3'-AGUUCCUUUUAAGUGUCAUAGUUGGUU-5' (SEQ ID NO: 7246)

C5-3409 Target:
5'-TCAAGGAAAATTCACAGTATCAACCAA-3' (SEQ ID NO: 9556)

5'-AGGAAAAUUCACAGUAUCAACCAat-3' (SEQ ID NO: 4937)

3'-GUUCCUUUUAAGUGUCAUAGUUGGUUA-5' (SEQ ID NO: 7247)

C5-3410 Target:
5'-CAAGGAAAATTCACAGTATCAACCAAT-3' (SEQ ID NO: 9557)

5'-GGAAAAUUCACAGUAUCAACCAAta-3' (SEQ ID NO: 4938)

3'-UUCCUUUUAAGUGUCAUAGUUGGUUAU-5' (SEQ ID NO: 7248)

C5-3411 Target:
5'-AAGGAAAATTCACAGTATCAACCAATA-3' (SEQ ID NO: 9558)

5'-GAAAAUUCACAGUAUCAACCAAUaa-3' (SEQ ID NO: 4939)

3'-UCCUUUUAAGUGUCAUAGUUGGUUAUU-5' (SEQ ID NO: 7249)

C5-3412 Target:
5'-AGGAAAATTCACAGTATCAACCAATAA-3' (SEQ ID NO: 9559)

5'-AAAAUUCACAGUAUCAACCAAUAaa-3' (SEQ ID NO: 4940)

3'-CCUUUUAAGUGUCAUAGUUGGUUAUU-5' (SEQ ID NO: 7250)

C5-3413 Target:
5'-GGAAAATTCACAGTATCAACCAATAAA-3' (SEQ ID NO: 9560)

5'-AAAUUCACAGUAUCAACCAAUAAaa-3' (SEQ ID NO: 4941)

3'-CUUUUAAGUGUCAUAGUUGGUUAUUU-5' (SEQ ID NO: 7251)

C5-3414 Target:
5'-GAAAATTCACAGTATCAACCAATAAAA-3' (SEQ ID NO: 9561)

5'-AAUUCACAGUAUCAACCAAUAAAat-3' (SEQ ID NO: 4942)

3'-UUUUAAGUGUCAUAGUUGGUUAUUUA-5' (SEQ ID NO: 7252)

TABLE 7-continued

Human Anti-C5 DsiRNAs Predicted to have >50%
Knockdown Efficacy (Asymmetrics)

C5-3415 Target:
5'-AAAATTCACAGTATCAACCAATAAAAT-3' (SEQ ID NO: 9562)

5'-AUUCACAGUAUCAACCAAUAAAAtt-3' (SEQ ID NO: 4943)

3'-UUUAAGUGUCAUAGUUGGUUAUUUUAA-5' (SEQ ID NO: 7253)

C5-3416 Target:
5'-AAATTCACAGTATCAACCAATAAAATT-3' (SEQ ID NO: 9563)

5'-UUCACAGUAUCAACCAAUAAAAUta-3' (SEQ ID NO: 4944)

3'-UUAAGUGUCAUAGUUGGUUAUUUUAAU-5' (SEQ ID NO: 7254)

C5-3417 Target:
5'-AATTCACAGTATCAACCAATAAAATTA-3' (SEQ ID NO: 9564)

5'-UCACAGUAUCAACCAAUAAAAUUac-3' (SEQ ID NO: 4945)

3'-UAAGUGUCAUAGUUGGUUAUUUUAAUG-5' (SEQ ID NO: 7255)

C5-3418 Target:
5'-ATTCACAGTATCAACCAATAAAATTAC-3' (SEQ ID NO: 9565)

5'-ACAGUAUCAACCAAUAAAAUUACag-3' (SEQ ID NO: 4946)

3'-AGUGUCAUAGUUGGUUAUUUUAAUGUC-5' (SEQ ID NO: 7256)

C5-3420 Target:
5'-TCACAGTATCAACCAATAAAATTACAG-3' (SEQ ID NO: 9566)

5'-CAGUAUCAACCAAUAAAAUUACAgg-3' (SEQ ID NO: 4947)

3'-GUGUCAUAGUUGGUUAUUUUAAUGUCC-5' (SEQ ID NO: 7257)

C5-3421 Target:
5'-CACAGTATCAACCAATAAAATTACAGG-3' (SEQ ID NO: 9567)

5'-AGUAUCAACCAAUAAAAUUACAGgg-3' (SEQ ID NO: 4948)

3'-UGUCAUAGUUGGUUAUUUUAAUGUCCC-5' (SEQ ID NO: 7258)

C5-3422 Target:
5'-ACAGTATCAACCAATAAAATTACAGGG-3' (SEQ ID NO: 9568)

5'-GUAUCAACCAAUAAAAUUACAGGgt-3' (SEQ ID NO: 4949)

3'-GUCAUAGUUGGUUAUUUUAAUGUCCCA-5' (SEQ ID NO: 7259)

C5-3423 Target:
5'-CAGTATCAACCAATAAAATTACAGGGT-3' (SEQ ID NO: 9569)

5'-UAUCAACCAAUAAAAUUACAGGGta-3' (SEQ ID NO: 4950)

3'-UCAUAGUUGGUUAUUUUAAUGUCCCAU-5' (SEQ ID NO: 7260)

C5-3424 Target:
5'-AGTATCAACCAATAAAATTACAGGGTA-3' (SEQ ID NO: 9570)

5'-AUCAACCAAUAAAAUUACAGGGUac-3' (SEQ ID NO: 4951)

3'-CAUAGUUGGUUAUUUUAAUGUCCCAUG-5' (SEQ ID NO: 7261)

C5-3425 Target:
5'-GTATCAACCAATAAAATTACAGGGTAC-3' (SEQ ID NO: 9571)

5'-UCAACCAAUAAAAUUACAGGGUAcc-3' (SEQ ID NO: 4952)

3'-AUAGUUGGUUAUUUUAAUGUCCCAUGG-5' (SEQ ID NO: 7262)

C5-3426 Target:
5'-TATCAACCAATAAAATTACAGGGTACC-3' (SEQ ID NO: 9572)

5'-CAGCUCUAAUUAAAGCUGACAACtt-3' (SEQ ID NO: 4953)

3'-GUGUCGAGAUUAAUUUCGACUGUUGAA-5' (SEQ ID NO: 7263)

TABLE 7-continued

Human Anti-C5 DsiRNAs Predicted to have >50% Knockdown Efficacy (Asymmetrics)

```
C5-3551 Target:
5'-CACAGCTCTAATTAAAGCTGACAACTT-3' (SEQ ID NO: 9573)

5'-AGCUCUAAUUAAAGCUGACAACUtt-3' (SEQ ID NO: 4954)

3'-UGUCGAGAUUAAUUUCGACUGUUGAAA-5' (SEQ ID NO: 7264)

C5-3552 Target:
5'-ACAGCTCTAATTAAAGCTGACAACTTT-3' (SEQ ID NO: 9574)

5'-GCUCUAAUUAAAGCUGACAACUUtc-3' (SEQ ID NO: 4955)

3'-GUCGAGAUUAAUUUCGACUGUUGAAAG-5' (SEQ ID NO: 7265)

C5-3553 Target:
5'-CAGCTCTAATTAAAGCTGACAACTTTC-3' (SEQ ID NO: 9575)

5'-CUUUCUGCUUGAAAAUACACUGCca-3' (SEQ ID NO: 4956)

3'-UUGAAAGACGAACUUUUAUGUGACGGU-5' (SEQ ID NO: 7266)

C5-3573 Target:
5'-AACTTTCTGCTTGAAAATACACTGCCA-3' (SEQ ID NO: 9576)

5'-UUUCUGCUUGAAAAUACACUGCCag-3' (SEQ ID NO: 4957)

3'-UGAAAGACGAACUUUUAUGUGACGGUC-5' (SEQ ID NO: 7267)

C5-3574 Target:
5'-ACTTTCTGCTTGAAAATACACTGCCAG-3' (SEQ ID NO: 9577)

5'-UUCUGCUUGAAAAUACACUGCCAgc-3' (SEQ ID NO: 4958)

3'-GAAAGACGAACUUUUAUGUGACGGUCG-5' (SEQ ID NO: 7268)

C5-3575 Target:
5'-CTTTCTGCTTGAAAATACACTGCCAGC-3' (SEQ ID NO: 9578)

5'-UCUGCUUGAAAAUACACUGCCAGcc-3' (SEQ ID NO: 4959)

3'-AAAGACGAACUUUUAUGUGACGGUCGG-5' (SEQ ID NO: 7269)

C5-3576 Target:
5'-TTTCTGCTTGAAAATACACTGCCAGCC-3' (SEQ ID NO: 9579)

5'-CUGCUUGAAAAUACACUGCCAGCcc-3' (SEQ ID NO: 4960)

3'-AAGACGAACUUUUAUGUGACGGUCGGG-5' (SEQ ID NO: 7270)

C5-3577 Target:
5'-TTCTGCTTGAAAATACACTGCCAGCCC-3' (SEQ ID NO: 9580)

5'-UGCUUGAAAAUACACUGCCAGCCca-3' (SEQ ID NO: 4961)

3'-AGACGAACUUUUAUGUGACGGUCGGGU-5' (SEQ ID NO: 7271)

C5-3578 Target:
5'-TCTGCTTGAAAATACACTGCCAGCCCA-3' (SEQ ID NO: 9581)

5'-GCUUGAAAAUACACUGCCAGCCCag-3' (SEQ ID NO: 4962)

3'-GACGAACUUUUAUGUGACGGUCGGGUC-5' (SEQ ID NO: 7272)

C5-3579 Target:
5'-CTGCTTGAAAATACACTGCCAGCCCAG-3' (SEQ ID NO: 9582)

5'-CUUGAAAAUACACUGCCAGCCCAga-3' (SEQ ID NO: 4963)

3'-ACGAACUUUUAUGUGACGGUCGGGUCU-5' (SEQ ID NO: 7273)

C5-3580 Target:
5'-TGCTTGAAAATACACTGCCAGCCCAGA-3' (SEQ ID NO: 9583)

5'-UUGAAAAUACACUGCCAGCCCAGag-3' (SEQ ID NO: 4964)

3'-CGAACUUUUAUGUGACGGUCGGGUCUC-5' (SEQ ID NO: 7274)

C5-3581 Target:
5'-GCTTGAAAATACACTGCCAGCCCAGAG-3' (SEQ ID NO: 9584)

5'-UGAAAAUACACUGCCAGCCCAGAgc-3' (SEQ ID NO: 4965)

3'-GAACUUUUAUGUGACGGUCGGGUCUCG-5' (SEQ ID NO: 7275)

C5-3582 Target:
5'-CTTGAAAATACACTGCCAGCCCAGAGC-3' (SEQ ID NO: 9585)

5'-GAAAAUACACUGCCAGCCCAGAGca-3' (SEQ ID NO: 4966)

3'-AACUUUUAUGUGACGGUCGGGUCUCGU-5' (SEQ ID NO: 7276)

C5-3583 Target:
5'-TTGAAAATACACTGCCAGCCCAGAGCA-3' (SEQ ID NO: 9586)

5'-AAAAUACACUGCCAGCCCAGAGCac-3' (SEQ ID NO: 4967)

3'-ACUUUUAUGUGACGGUCGGGUCUCGUG-5' (SEQ ID NO: 7277)

C5-3584 Target:
5'-TGAAAATACACTGCCAGCCCAGAGCAC-3' (SEQ ID NO: 9587)

5'-AAAUACACUGCCAGCCCAGAGCAcc-3' (SEQ ID NO: 4968)

3'-CUUUUAUGUGACGGUCGGGUCUCGUGG-5' (SEQ ID NO: 7278)

C5-3585 Target:
5'-GAAAATACACTGCCAGCCCAGAGCACC-3' (SEQ ID NO: 9588)

5'-AAUACACUGCCAGCCCAGAGCACct-3' (SEQ ID NO: 4969)

3'-UUUUAUGUGACGGUCGGGUCUCGUGGA-5' (SEQ ID NO: 7279)

C5-3586 Target:
5'-AAAATACACTGCCAGCCCAGAGCACCT-3' (SEQ ID NO: 9589)

5'-AUACACUGCCAGCCCAGAGCACCtt-3' (SEQ ID NO: 4970)

3'-UUUAUGUGACGGUCGGGUCUCGUGGAA-5' (SEQ ID NO: 7280)

C5-3587 Target:
5'-AAATACACTGCCAGCCCAGAGCACCTT-3' (SEQ ID NO: 9590)

5'-UACACUGCCAGCCCAGAGCACCUtt-3' (SEQ ID NO: 4971)

3'-UUAUGUGACGGUCGGGUCUCGUGGAAA-5' (SEQ ID NO: 7281)

C5-3588 Target:
5'-AATACACTGCCAGCCCAGAGCACCTTT-3' (SEQ ID NO: 9591)

5'-ACACUGCCAGCCCAGAGCACCUUta-3' (SEQ ID NO: 4972)

3'-UAUGUGACGGUCGGGUCUCGUGGAAAU-5' (SEQ ID NO: 7282)

C5-3589 Target:
5'-ATACACTGCCAGCCCAGAGCACCTTTA-3' (SEQ ID NO: 9592)

5'-CACUGCCAGCCCAGAGCACCUUUac-3' (SEQ ID NO: 4973)

3'-AUGUGACGGUCGGGUCUCGUGGAAAUG-5' (SEQ ID NO: 7283)

C5-3590 Target:
5'-TACACTGCCAGCCCAGAGCACCTTTAC-3' (SEQ ID NO: 9593)

5'-ACUGCCAGCCCAGAGCACCUUUAca-3' (SEQ ID NO: 4974)

3'-UGUGACGGUCGGGUCUCGUGGAAAUGU-5' (SEQ ID NO: 7284)

C5-3591 Target:
5'-ACACTGCCAGCCCAGAGCACCTTTACA-3' (SEQ ID NO: 9594)

5'-CUGCCAGCCCAGAGCACCUUUACat-3' (SEQ ID NO: 4975)

3'-GUGACGGUCGGGUCUCGUGGAAAUGUA-5' (SEQ ID NO: 7285)
```

TABLE 7-continued

Human Anti-C5 DsiRNAs Predicted to have >50% Knockdown Efficacy (Asymmetrics)

C5-3592 Target:
5'-CACTGCCAGCCCAGAGCACCTTTACAT-3' (SEQ ID NO: 9595)

5'-UGCCAGCCCAGAGCACCUUUACAtt-3' (SEQ ID NO: 4976)

3'-UGACGGUCGGGUCUCGUGGAAAUGUAA-5' (SEQ ID NO: 7286)

C5-3593 Target:
5'-ACTGCCAGCCCAGAGCACCTTTACATT-3' (SEQ ID NO: 9596)

5'-GCCAGCCCAGAGCACCUUUACAUtg-3' (SEQ ID NO: 4977)

3'-GACGGUCGGGUCUCGUGGAAAUGUAAC-5' (SEQ ID NO: 7287)

C5-3594 Target:
5'-CTGCCAGCCCAGAGCACCTTTACATTG-3' (SEQ ID NO: 9597)

5'-CCAGCCCAGAGCACCUUUACAUUgg-3' (SEQ ID NO: 4978)

3'-ACGGUCGGGUCUCGUGGAAAUGUAACC-5' (SEQ ID NO: 7288)

C5-3595 Target:
5'-TGCCAGCCCAGAGCACCTTTACATTGG-3' (SEQ ID NO: 9598)

5'-CAGCCCAGAGCACCUUUACAUUGgc-3' (SEQ ID NO: 4979)

3'-CGGUCGGGUCUCGUGGAAAUGUAACCG-5' (SEQ ID NO: 7289)

C5-3596 Target:
5'-GCCAGCCCAGAGCACCTTTACATTGGC-3' (SEQ ID NO: 9599)

5'-AGCCCAGAGCACCUUUACAUUGGcc-3' (SEQ ID NO: 4980)

3'-GGUCGGGUCUCGUGGAAAUGUAACCGG-5' (SEQ ID NO: 7290)

C5-3597 Target:
5'-CCAGCCCAGAGCACCTTTACATTGGCC-3' (SEQ ID NO: 9600)

5'-GCCCAGAGCACCUUUACAUUGGCca-3' (SEQ ID NO: 4981)

3'-GUCGGGUCUCGUGGAAAUGUAACCGGU-5' (SEQ ID NO: 7291)

C5-3598 Target:
5'-CAGCCCAGAGCACCTTTACATTGGCCA-3' (SEQ ID NO: 9601)

5'-CCCAGAGCACCUUUACAUUGGCcat-3' (SEQ ID NO: 4982)

3'-UCGGGUCUCGUGGAAAUGUAACCGGUA-5' (SEQ ID NO: 7292)

C5-3599 Target:
5'-AGCCCAGAGCACCTTTACATTGGCCAT-3' (SEQ ID NO: 9602)

5'-CCAGAGCACCUUUACAUUGGCCAtt-3' (SEQ ID NO: 4983)

3'-CGGGUCUCGUGGAAAUGUAACCGGUAA-5' (SEQ ID NO: 7293)

C5-3600 Target:
5'-GCCCAGAGCACCTTTACATTGGCCATT-3' (SEQ ID NO: 9603)

5'-CAGAGCACCUUUACAUUGGCCAUtt-3' (SEQ ID NO: 4984)

3'-GGGUCUCGUGGAAAUGUAACCGGUAAA-5' (SEQ ID NO: 7294)

C5-3601 Target:
5'-CCCAGAGCACCTTTACATTGGCCATTT-3' (SEQ ID NO: 9604)

5'-AGAGCACCUUUACAUUGGCCAUUtc-3' (SEQ ID NO: 4985)

3'-GGUCUCGUGGAAAUGUAACCGGUAAAG-5' (SEQ ID NO: 7295)

C5-3602 Target:
5'-CCAGAGCACCTTTACATTGGCCATTTC-3' (SEQ ID NO: 9605)

5'-GAGCACCUUUACAUUGGCCAUUUct-3' (SEQ ID NO: 4986)

3'-GUCUCGUGGAAAUGUAACCGGUAAAGA-5' (SEQ ID NO: 7296)

TABLE 7-continued

Human Anti-C5 DsiRNAs Predicted to have >50% Knockdown Efficacy (Asymmetrics)

C5-3603 Target:
5'-CAGAGCACCTTTACATTGGCCATTTCT-3' (SEQ ID NO: 9606)

5'-AGCACCUUUACAUUGGCCAUUUCtg-3' (SEQ ID NO: 4987)

3'-UCUCGUGGAAAUGUAACCGGUAAAGAC-5' (SEQ ID NO: 7297)

C5-3604 Target:
5'-AGAGCACCTTTACATTGGCCATTTCTG-3' (SEQ ID NO: 9607)

5'-GCACCUUUACAUUGGCCAUUUCUgc-3' (SEQ ID NO: 4988)

3'-CUCGUGGAAAUGUAACCGGUAAAGACG-5' (SEQ ID NO: 7298)

C5-3605 Target:
5'-GAGCACCTTTACATTGGCCATTTCTGC-3' (SEQ ID NO: 9608)

5'-CACCUUUACAUUGGCCAUUUCUGcg-3' (SEQ ID NO: 4989)

3'-UCGUGGAAAUGUAACCGGUAAAGACGC-5' (SEQ ID NO: 7299)

C5-3606 Target:
5'-AGCACCTTTACATTGGCCATTTCTGCG-3' (SEQ ID NO: 9609)

5'-ACCUUUACAUUGGCCAUUUCUGCgt-3' (SEQ ID NO: 4990)

3'-CGUGGAAAUGUAACCGGUAAAGACGCA-5' (SEQ ID NO: 7300)

C5-3607 Target:
5'-GCACCTTTACATTGGCCATTTCTGCGT-3' (SEQ ID NO: 9610)

5'-CCUUUACAUUGGCCAUUUCUGCGta-3' (SEQ ID NO: 4991)

3'-GUGGAAAUGUAACCGGUAAAGACGCAU-5' (SEQ ID NO: 7301)

C5-3608 Target:
5'-CACCTTTACATTGGCCATTTCTGCGTA-3' (SEQ ID NO: 9611)

5'-CUUUACAUUGGCCAUUUCUGCGUat-3' (SEQ ID NO: 4992)

3'-UGGAAAUGUAACCGGUAAAGACGCAUA-5' (SEQ ID NO: 7302)

C5-3609 Target:
5'-ACCTTTACATTGGCCATTTCTGCGTAT-3' (SEQ ID NO: 9612)

5'-UUUACAUUGGCCAUUUCUGCGUAtg-3' (SEQ ID NO: 4993)

3'-GGAAAUGUAACCGGUAAAGACGCAUAC-5' (SEQ ID NO: 7303)

C5-3610 Target:
5'-CCTTTACATTGGCCATTTCTGCGTATG-3' (SEQ ID NO: 9613)

5'-UUACAUUGGCCAUUUCUGCGUAUgc-3' (SEQ ID NO: 4994)

3'-GAAAUGUAACCGGUAAAGACGCAUACG-5' (SEQ ID NO: 7304)

C5-3611 Target:
5'-CTTTACATTGGCCATTTCTGCGTATGC-3' (SEQ ID NO: 9614)

5'-UAUGCUCUUUCCCUGGGAGAUAAaa-3' (SEQ ID NO: 4995)

3'-GCAUACGAGAAAGGGACCCUCUAUUUU-5' (SEQ ID NO: 7305)

C5-3631 Target:
5'-CGTATGCTCTTTCCCTGGGAGATAAAA-3' (SEQ ID NO: 9615)

5'-AUGCUCUUUCCCUGGGAGAUAAAac-3' (SEQ ID NO: 4996)

3'-CAUACGAGAAAGGGACCCUCUAUUUUG-5' (SEQ ID NO: 7306)

C5-3632 Target:
5'-GTATGCTCTTTCCCTGGGAGATAAAAC-3' (SEQ ID NO: 9616)

5'-UGCUCUUUCCCUGGGAGAUAAAAct-3' (SEQ ID NO: 4997)

3'-AUACGAGAAAGGGACCCUCUAUUUUGA-5' (SEQ ID NO: 7307)

TABLE 7-continued

Human Anti-C5 DsiRNAs Predicted to have >50%
Knockdown Efficacy (Asymmetrics)

C5-3633 Target:
5'-TATGCTCTTTCCCTGGGAGATAAAACT-3' (SEQ ID NO: 9617)

5'-GCUCUUUCCCUGGGAGAUAAAACtc-3' (SEQ ID NO: 4998)

3'-UACGAGAAAGGGACCCUCUAUUUUGAG-5' (SEQ ID NO: 7308)

C5-3634 Target:
5'-ATGCTCTTTCCCTGGGAGATAAAACTC-3' (SEQ ID NO: 9618)

5'-CUCUUUCCCUGGGAGAUAAAACUca-3' (SEQ ID NO: 4999)

3'-ACGAGAAAGGGACCCUCUAUUUUGAGU-5' (SEQ ID NO: 7309)

C5-3635 Target:
5'-TGCTCTTTCCCTGGGAGATAAAACTCA-3' (SEQ ID NO: 9619)

5'-UCUUUCCCUGGGAGAUAAAACUCac-3' (SEQ ID NO: 5000)

3'-CGAGAAAGGGACCCUCUAUUUUGAGUG-5' (SEQ ID NO: 7310)

C5-3636 Target:
5'-GCTCTTTCCCTGGGAGATAAAACTCAC-3' (SEQ ID NO: 9620)

5'-CUUUCCCUGGGAGAUAAAACUCAcc-3' (SEQ ID NO: 5001)

3'-GAGAAAGGGACCCUCUAUUUUGAGUGG-5' (SEQ ID NO: 7311)

C5-3637 Target:
5'-CTCTTTCCCTGGGAGATAAAACTCACC-3' (SEQ ID NO: 9621)

5'-UUUCCCUGGGAGAUAAAACUCACcc-3' (SEQ ID NO: 5002)

3'-AGAAAGGGACCCUCUAUUUUGAGUGGG-5' (SEQ ID NO: 7312)

C5-3638 Target:
5'-TCTTTCCCTGGGAGATAAAACTCACCC-3' (SEQ ID NO: 9622)

5'-UUCCCUGGGAGAUAAAACUCACCca-3' (SEQ ID NO: 5003)

3'-GAAAGGGACCCUCUAUUUUGAGUGGGU-5' (SEQ ID NO: 7313)

C5-3639 Target:
5'-CTTTCCCTGGGAGATAAAACTCACCCA-3' (SEQ ID NO: 9623)

5'-UCCCUGGGAGAUAAAACUCACCCac-3' (SEQ ID NO: 5004)

3'-AAAGGGACCCUCUAUUUUGAGUGGGU-5' (SEQ ID NO: 7314)

C5-3640 Target:
5'-TTTCCCTGGGAGATAAAACTCACCCAC-3' (SEQ ID NO: 9624)

5'-CCCUGGGAGAUAAAACUCACCCAca-3' (SEQ ID NO: 5005)

3'-AAGGGACCCUCUAUUUUGAGUGGGUGU-5' (SEQ ID NO: 7315)

C5-3641 Target:
5'-TTCCCTGGGAGATAAAACTCACCCACA-3' (SEQ ID NO: 9625)

5'-CCUGGGAGAUAAAACUCACCCACag-3' (SEQ ID NO: 5006)

3'-AGGGACCCUCUAUUUUGAGUGGGUGUC-5' (SEQ ID NO: 7316)

C5-3642 Target:
5'-TCCCTGGGAGATAAAACTCACCCACAG-3' (SEQ ID NO: 9626)

5'-CUGGGAGAUAAAACUCACCCACAgt-3' (SEQ ID NO: 5007)

3'-GGGACCCUCUAUUUUGAGUGGGUGUCA-5' (SEQ ID NO: 7317)

C5-3643 Target:
5'-CCCTGGGAGATAAAACTCACCCACAGT-3' (SEQ ID NO: 9627)

5'-UGGGAGAUAAAACUCACCCACAGtt-3' (SEQ ID NO: 5008)

3'-GGACCCUCUAUUUUGAGUGGGUGUCAA-5' (SEQ ID NO: 7318)

TABLE 7-continued

Human Anti-C5 DsiRNAs Predicted to have >50%
Knockdown Efficacy (Asymmetrics)

C5-3644 Target:
5'-CCTGGGAGATAAAACTCACCCACAGTT-3' (SEQ ID NO: 9628)

5'-GGGAGAUAAAACUCACCCACAGUtt-3' (SEQ ID NO: 5009)

3'-GACCCUCUAUUUUGAGUGGGUGUCAAA-5' (SEQ ID NO: 7319)

C5-3645 Target:
5'-CTGGGAGATAAAACTCACCCACAGTTT-3' (SEQ ID NO: 9629)

5'-GGAGAUAAAACUCACCCACAGUUtc-3' (SEQ ID NO: 5010)

3'-ACCCUCUAUUUUGAGUGGGUGUCAAAG-5' (SEQ ID NO: 7320)

C5-3646 Target:
5'-TGGGAGATAAAACTCACCCACAGTTTC-3' (SEQ ID NO: 9630)

5'-GAGAUAAAACUCACCCACAGUUUcg-3' (SEQ ID NO: 5011)

3'-CCCUCUAUUUUGAGUGGGUGUCAAAGC-5' (SEQ ID NO: 7321)

C5-3647 Target:
5'-GGGAGATAAAACTCACCCACAGTTTCG-3' (SEQ ID NO: 9631)

5'-AGAUAAAACUCACCCACAGUUUCgt-3' (SEQ ID NO: 5012)

3'-CCUCUAUUUUGAGUGGGUGUCAAAGCA-5' (SEQ ID NO: 7322)

C5-3648 Target:
5'-GGAGATAAAACTCACCCACAGTTTCGT-3' (SEQ ID NO: 9632)

5'-GAUAAAACUCACCCACAGUUUCGtt-3' (SEQ ID NO: 5013)

3'-CUCUAUUUUGAGUGGGUGUCAAAGCAA-5' (SEQ ID NO: 7323)

C5-3649 Target:
5'-GAGATAAAACTCACCCACAGTTTCGTT-3' (SEQ ID NO: 9633)

5'-AUAAAACUCACCCACAGUUUCGUtc-3' (SEQ ID NO: 5014)

3'-UCUAUUUUGAGUGGGUGUCAAAGCAAG-5' (SEQ ID NO: 7324)

C5-3650 Target:
5'-AGATAAAACTCACCCACAGTTTCGTTC-3' (SEQ ID NO: 9634)

5'-UAAAACUCACCCACAGUUUCGUUca-3' (SEQ ID NO: 5015)

3'-CUAUUUUGAGUGGGUGUCAAAGCAAGU-5' (SEQ ID NO: 7325)

C5-3651 Target:
5'-GATAAAACTCACCCACAGTTTCGTTCA-3' (SEQ ID NO: 9635)

5'-GUUCAAUUGUUUCAGCUUUGAAGag-3' (SEQ ID NO: 5016)

3'-AGCAAGUUAACAAAGUCGAAACUUCUC-5' (SEQ ID NO: 7326)

C5-3671 Target:
5'-TCGTTCAATTGTTTCAGCTTTGAAGAG-3' (SEQ ID NO: 9636)

5'-UCAAUUGUUUCAGCUUUGAAGAGag-3' (SEQ ID NO: 5017)

3'-CAAGUUAACAAAGUCGAAACUUCUCUC-5' (SEQ ID NO: 7327)

C5-3673 Target:
5'-GTTCAATTGTTTCAGCTTTGAAGAGAG-3' (SEQ ID NO: 9637)

5'-CAAUUGUUUCAGCUUUGAAGAGAga-3' (SEQ ID NO: 5018)

3'-AAGUUAACAAAGUCGAAACUUCUCUCU-5' (SEQ ID NO: 7328)

C5-3674 Target:
5'-TTCAATTGTTTCAGCTTTGAAGAGAGA-3' (SEQ ID NO: 9638)

5'-AAUUGUUUCAGCUUUGAAGAGAGaa-3' (SEQ ID NO: 5019)

3'-AGUUAACAAAGUCGAAACUUCUCUCUU-5' (SEQ ID NO: 7329)

TABLE 7-continued

Human Anti-C5 DsiRNAs Predicted to have >50% Knockdown Efficacy (Asymmetrics)

C5-3675 Target:
5'-TCAATTGTTTCAGCTTTGAAGAGAGAA-3' (SEQ ID NO: 9639)

5'-A<u>UUG</u>UUUCAGCUUU<u>G</u>AAGAGAGAag-3' (SEQ ID NO: 5020)

3'-<u>GUUA</u>ACAAAGUCGAA<u>A</u>CUUCUCU<u>C</u>UUC-5' (SEQ ID NO: 7330)

C5-3676 Target:
5'-CAATTGTTTCAGCTTTGAAGAGAGAAG-3' (SEQ ID NO: 9640)

5'-<u>UUG</u>UUUCAGCUUU<u>G</u>AAGAGAGAgc-3' (SEQ ID NO: 5021)

3'-<u>UUA</u>ACAAAGUCGAA<u>A</u>CUUCUCUCUU<u>CG</u>-5' (SEQ ID NO: 7331)

C5-3677 Target:
5'-AATTGTTTCAGCTTTGAAGAGAGAAGC-3' (SEQ ID NO: 9641)

5'-U<u>G</u>UUUCAGCUUUG<u>A</u>AGAGAGAAGct-3' (SEQ ID NO: 5022)

3'-<u>UAA</u>C<u>AAAGUCGAAACUU</u>CUCUCUU<u>CGA</u>-5' (SEQ ID NO: 7332)

C5-3678 Target:
5'-ATTGTTTCAGCTTTGAAGAGAGAAGCT-3' (SEQ ID NO: 9642)

5'-G<u>UUU</u>CAGCUUUGA<u>A</u>GAGAGAAGCtt-3' (SEQ ID NO: 5023)

3'-<u>AAC</u>AAAGUCGAAA<u>CUU</u>CUCUCUU<u>CGAA</u>-5' (SEQ ID NO: 7333)

C5-3679 Target:
5'-TTGTTTCAGCTTTGAAGAGAGAAGCTT-3' (SEQ ID NO: 9643)

5'-<u>UUU</u>CAGCUUUGAAG<u>AGA</u>GAAGCUtt-3' (SEQ ID NO: 5024)

3'-<u>A</u>CAAAGUCGAAACUU<u>CU</u>CUCUUC<u>GAAA</u>-5' (SEQ ID NO: 7334)

C5-3680 Target:
5'-TGTTTCAGCTTTGAAGAGAGAAGCTTT-3' (SEQ ID NO: 9644)

5'-<u>UU</u>CAGCUUUGAAG<u>AGA</u>GAAGCUUtg-3' (SEQ ID NO: 5025)

3'-<u>CAAA</u>GUCGAAACUU<u>CU</u>CUCUUCG<u>AAAC</u>-5' (SEQ ID NO: 7335)

C5-3681 Target:
5'-GTTTCAGCTTTGAAGAGAGAAGCTTTG-3' (SEQ ID NO: 9645)

5'-U<u>CAG</u>CUUUGAAGA<u>G</u>A<u>G</u>AAGCUUUgg-3' (SEQ ID NO: 5026)

3'-<u>AAA</u>GUCGAAACUU<u>C</u>U<u>C</u>UCUUCGA<u>AACC</u>-5' (SEQ ID NO: 7336)

C5-3682 Target:
5'-TTTCAGCTTTGAAGAGAGAAGCTTTGG-3' (SEQ ID NO: 9646)

5'-C<u>AG</u>CUUUGAAGAG<u>A</u>GAAGCUUUGgt-3' (SEQ ID NO: 5027)

3'-<u>A</u>AGUCGAAACUUC<u>U</u>CUCUUCGAA<u>ACCA</u>-5' (SEQ ID NO: 7337)

C5-3683 Target:
5'-TTCAGCTTTGAAGAGAGAAGCTTTGGT-3' (SEQ ID NO: 9647)

5'-A<u>GC</u>UUUGAAGAGA<u>G</u>AAGCUUUGGtt-3' (SEQ ID NO: 5028)

3'-<u>A</u>GUCGAAACUUCU<u>C</u>UCUUCGAAA<u>CCAA</u>-5' (SEQ ID NO: 7338)

C5-3684 Target:
5'-TCAGCTTTGAAGAGAGAAGCTTTGGTT-3' (SEQ ID NO: 9648)

5'-G<u>CUUU</u>GAAGAGAG<u>A</u>AGCUUUGGUta-3' (SEQ ID NO: 5029)

3'-<u>GUC</u>GAAACUUCUC<u>U</u>CUUCGAAACC<u>AAU</u>-5' (SEQ ID NO: 7339)

C5-3685 Target:
5'-CAGCTTTGAAGAGAGAAGCTTTGGTTA-3' (SEQ ID NO: 9649)

5'-C<u>UUU</u>GAAGAGAGA<u>AG</u>CUUUGGUUaa-3' (SEQ ID NO: 5030)

3'-<u>UCG</u>AAACUUCUCU<u>UC</u>GAAACCAAUU-5' (SEQ ID NO: 7340)

C5-3686 Target:
5'-AGCTTTGAAGAGAGAAGCTTTGGTTAA-3' (SEQ ID NO: 9650)

5'-<u>UUU</u>GAAGAGAGAA<u>GC</u>UUUGGUUAaa-3' (SEQ ID NO: 5031)

3'-<u>CGA</u>AACUUCUCUU<u>C</u>GAAACCA<u>AUUU</u>-5' (SEQ ID NO: 7341)

C5-3687 Target:
5'-GCTTTGAAGAGAGAAGCTTTGGTTAAA-3' (SEQ ID NO: 9651)

5'-<u>UU</u>GAAGAGAGAAG<u>C</u>UUUGGUUAAag-3' (SEQ ID NO: 5032)

3'-<u>GAAA</u>CUUCUCUCUU<u>C</u>GAAACCAA<u>UUUC</u>-5' (SEQ ID NO: 7342)

C5-3688 Target:
5'-CTTTGAAGAGAGAAGCTTTGGTTAAAG-3' (SEQ ID NO: 9652)

5'-U<u>G</u>AAGAGAAGC<u>UUU</u>GGUUAAAgg-3' (SEQ ID NO: 5033)

3'-<u>AAAC</u>UUCUCUCUUC<u>G</u>AAACCAAUU<u>UCC</u>-5' (SEQ ID NO: 7343)

C5-3689 Target:
5'-TTTGAAGAGAGAAGCTTTGGTTAAAGG-3' (SEQ ID NO: 9653)

5'-<u>G</u>A<u>G</u>AGAAGCUUUG<u>G</u>U<u>U</u>AAAGGUAat-3' (SEQ ID NO: 5034)

3'-<u>UUCUC</u>UCUUCGAAA<u>CC</u>AAUUUCC<u>AUUA</u>-5' (SEQ ID NO: 7344)

C5-3693 Target:
5'-AAGAGAGAAGCTTTGGTTAAAGGTAAT-3' (SEQ ID NO: 9654)

5'-<u>AGA</u>GAAGCUUUGG<u>UU</u>AAAGGUAAtc-3' (SEQ ID NO: 5035)

3'-<u>UCUC</u>UCUUCGAAAC<u>C</u>AUUUCC<u>AUUAG</u>-5' (SEQ ID NO: 7345)

C5-3694 Target:
5'-AGAGAGAAGCTTTGGTTAAAGGTAATC-3' (SEQ ID NO: 9655)

5'-<u>G</u>A<u>G</u>AAGCUUUGGU<u>UA</u>AAGGUAAUcc-3' (SEQ ID NO: 5036)

3'-<u>CUCU</u>CUUCGAAACC<u>AA</u>UUUCC<u>AUUA</u>GG-5' (SEQ ID NO: 7346)

C5-3695 Target:
5'-GAGAGAAGCTTTGGTTAAAGGTAATCC-3' (SEQ ID NO: 9656)

5'-<u>AAG</u>CUUUGGUUAA<u>AG</u>GUAAUCCAcc-3' (SEQ ID NO: 5037)

3'-<u>UCU</u>UCGAAACCAAUU<u>C</u>CAUUAGGUGG-5' (SEQ ID NO: 7347)

C5-3698 Target:
5'-AGAAGCTTTGGTTAAAGGTAATCCACC-3' (SEQ ID NO: 9657)

5'-<u>AG</u>CUUUGGUUAAA<u>GG</u>UAAUCCACcc-3' (SEQ ID NO: 5038)

3'-<u>CUUC</u>GAAACCAAUU<u>CC</u>AUUAGGU<u>GGG</u>-5' (SEQ ID NO: 7348)

C5-3699 Target:
5'-GAAGCTTTGGTTAAAGGTAATCCACCC-3' (SEQ ID NO: 9658)

5'-<u>GC</u>UUUGGUUAAAG<u>GU</u>AAUCCACCca-3' (SEQ ID NO: 5039)

3'-<u>UUCG</u>AAACCAAUUU<u>CC</u>AUUAGGU<u>GGGU</u>-5' (SEQ ID NO: 7349)

C5-3700 Target:
5'-AAGCTTTGGTTAAAGGTAATCCACCCA-3' (SEQ ID NO: 9659)

5'-<u>C</u>UUUGGUUAAAGG<u>U</u>A<u>A</u>UCCACCCat-3' (SEQ ID NO: 5040)

3'-<u>UCG</u>AAACCAAUUU<u>CC</u>AUUAGGUGG<u>GUA</u>-5' (SEQ ID NO: 7350)

C5-3701 Target:
5'-AGCTTTGGTTAAAGGTAATCCACCCAT-3' (SEQ ID NO: 9660)

5'-<u>UUU</u>GGUUAAAGGU<u>A</u>A<u>U</u>CCACCCAtt-3' (SEQ ID NO: 5041)

3'-<u>CGA</u>AACCAAUUUCC<u>A</u>UUAGGUGGG<u>UAA</u>-5' (SEQ ID NO: 7351)

TABLE 7-continued

Human Anti-C5 DsiRNAs Predicted to have >50% Knockdown Efficacy (Asymmetrics)

C5-3702 Target:
5'-GCTTTGGTTAAAGGTAATCCACCCATT-3' (SEQ ID NO: 9661)

5'-UUGGUUAAAGGUAAUCCACCCAUtt-3' (SEQ ID NO: 5042)

3'-GAAACCAAUUUCCAUUAGGUGGGUAAA-5' (SEQ ID NO: 7352)

C5-3703 Target:
5'-CTTTGGTTAAAGGTAATCCACCCATTT-3' (SEQ ID NO: 9662)

5'-UGGUUAAAGGUAAUCCACCCAUUta-3' (SEQ ID NO: 5043)

3'-AAACCAAUUUCCAUUAGGUGGGUAAAU-5' (SEQ ID NO: 7353)

C5-3704 Target:
5'-TTTGGTTAAAGGTAATCCACCCATTTA-3' (SEQ ID NO: 9663)

5'-GGUUAAAGGUAAUCCACCCAUUUat-3' (SEQ ID NO: 5044)

3'-AACCAAUUUCCAUUAGGUGGGUAAAUA-5' (SEQ ID NO: 7354)

C5-3705 Target:
5'-TTGGTTAAAGGTAATCCACCCATTTAT-3' (SEQ ID NO: 9664)

5'-GUUAAAGGUAAUCCACCCAUUUAtc-3' (SEQ ID NO: 5045)

3'-ACCAAUUUCCAUUAGGUGGGUAAAUAG-5' (SEQ ID NO: 7355)

C5-3706 Target:
5'-TGGTTAAAGGTAATCCACCCATTTATC-3' (SEQ ID NO: 9665)

5'-UUAAAGGUAAUCCACCCAUUUAUcg-3' (SEQ ID NO: 5046)

3'-CCAAUUUCCAUUAGGUGGGUAAAUAGC-5' (SEQ ID NO: 7356)

C5-3707 Target:
5'-GGTTAAAGGTAATCCACCCATTTATCG-3' (SEQ ID NO: 9666)

5'-UAAAGGUAAUCCACCCAUUUAUCgt-3' (SEQ ID NO: 5047)

3'-CAAUUUCCAUUAGGUGGGUAAAUAGCA-5' (SEQ ID NO: 7357)

C5-3708 Target:
5'-GTTAAAGGTAATCCACCCATTTATCGT-3' (SEQ ID NO: 9667)

5'-AAAGGUAAUCCACCCAUUUAUCGtt-3' (SEQ ID NO: 5048)

3'-AAUUUCCAUUAGGUGGGUAAAUAGCAA-5' (SEQ ID NO: 7358)

C5-3709 Target:
5'-TTAAAGGTAATCCACCCATTTATCGTT-3' (SEQ ID NO: 9668)

5'-AAGGUAAUCCACCCAUUUAUCGUtt-3' (SEQ ID NO: 5049)

3'-AUUUCCAUUAGGUGGGUAAAUAGCAAA-5' (SEQ ID NO: 7359)

C5-3710 Target:
5'-TAAAGGTAATCCACCCATTTATCGTTT-3' (SEQ ID NO: 9669)

5'-AGGUAAUCCACCCAUUUAUCGUUtt-3' (SEQ ID NO: 5050)

3'-UUUCCAUUAGGUGGGUAAAUAGCAAAA-5' (SEQ ID NO: 7360)

C5-3711 Target:
5'-AAAGGTAATCCACCCATTTATCGTTTT-3' (SEQ ID NO: 9670)

5'-GGUAAUCCACCCAUUUAUCGUUUtt-3' (SEQ ID NO: 5051)

3'-UUCCAUUAGGUGGGUAAAUAGCAAAAA-5' (SEQ ID NO: 7361)

C5-3712 Target:
5'-AAGGTAATCCACCCATTTATCGTTTTT-3' (SEQ ID NO: 9671)

5'-GUAAUCCACCCAUUUAUCGUUUUtg-3' (SEQ ID NO: 5052)

3'-UCCAUUAGGUGGGUAAAUAGCAAAAAC-5' (SEQ ID NO: 7362)

C5-3713 Target:
5'-AGGTAATCCACCCATTTATCGTTTTTG-3' (SEQ ID NO: 9672)

5'-UAAUCCACCCAUUUAUCGUUUUUgg-3' (SEQ ID NO: 5053)

3'-CCAUUAGGUGGGUAAAUAGCAAAAAACC-5' (SEQ ID NO: 7363)

C5-3714 Target:
5'-GGTAATCCACCCATTTATCGTTTTTGG-3' (SEQ ID NO: 9673)

5'-AAUCCACCCAUUUAUCGUUUUUGga-3' (SEQ ID NO: 5054)

3'-CAUUAGGUGGGUAAAUAGCAAAAAACCU-5' (SEQ ID NO: 7364)

C5-3715 Target:
5'-GTAATCCACCCATTTATCGTTTTTGGA-3' (SEQ ID NO: 9674)

5'-AUCCACCCAUUUAUCGUUUUUGGaa-3' (SEQ ID NO: 5055)

3'-AUUAGGUGGGUAAAUAGCAAAAACCUU-5' (SEQ ID NO: 7365)

C5-3716 Target:
5'-TAATCCACCCATTTATCGTTTTTGGAA-3' (SEQ ID NO: 9675)

5'-UCCACCCAUUUAUCGUUUUUGGAaa-3' (SEQ ID NO: 5056)

3'-UUAGGUGGGUAAAUAGCAAAAACCUUU-5' (SEQ ID NO: 7366)

C5-3717 Target:
5'-AATCCACCCATTTATCGTTTTTGGAAA-3' (SEQ ID NO: 9676)

5'-CCACCCAUUUAUCGUUUUUGGAAag-3' (SEQ ID NO: 5057)

3'-UAGGUGGGUAAAUAGCAAAAACCUUUC-5' (SEQ ID NO: 7367)

C5-3718 Target:
5'-ATCCACCCATTTATCGTTTTTGGAAAG-3' (SEQ ID NO: 9677)

5'-CACCCAUUUAUCGUUUUUGGAAAga-3' (SEQ ID NO: 5058)

3'-AGGUGGGUAAAUAGCAAAAACCUUUCU-5' (SEQ ID NO: 7368)

C5-3719 Target:
5'-TCCACCCATTTATCGTTTTTGGAAAGA-3' (SEQ ID NO: 9678)

5'-ACCCAUUUAUCGUUUUUGGAAAGac-3' (SEQ ID NO: 5059)

3'-GGUGGGUAAAUAGCAAAAACCUUUCUG-5' (SEQ ID NO: 7369)

C5-3720 Target:
5'-CCACCCATTTATCGTTTTTGGAAAGAC-3' (SEQ ID NO: 9679)

5'-CCCAUUUAUCGUUUUUGGAAAGAca-3' (SEQ ID NO: 5060)

3'-GUGGGUAAAUAGCAAAAACCUUUCUGU-5' (SEQ ID NO: 7370)

C5-3721 Target:
5'-CACCCATTTATCGTTTTTGGAAAGACA-3' (SEQ ID NO: 9680)

5'-CAUUUAUCGUUUUUGGAAAGACAat-3' (SEQ ID NO: 5061)

3'-GGGUAAAUAGCAAAAACCUUUCUGUUA-5' (SEQ ID NO: 7371)

C5-3723 Target:
5'-CCCATTTATCGTTTTTGGAAAGACAAT-3' (SEQ ID NO: 9681)

5'-AUUUAUCGUUUUUGGAAAGACAAtc-3' (SEQ ID NO: 5062)

3'-GGUAAAUAGCAAAAACCUUUCUGUUAG-5' (SEQ ID NO: 7372)

C5-3724 Target:
5'-CCATTTATCGTTTTTGGAAAGACAATC-3' (SEQ ID NO: 9682)

5'-UUUAUCGUUUUUGGAAAGACAAUct-3' (SEQ ID NO: 5063)

3'-GUAAAUAGCAAAAACCUUUCUGUUAGA-5' (SEQ ID NO: 7373)

TABLE 7-continued

Human Anti-C5 DsiRNAs Predicted to have >50% Knockdown Efficacy (Asymmetrics)

C5-3725 Target:
5'-CATTTATCGTTTTTGGAAAGACAATCT-3' (SEQ ID NO: 9683)

5'-U<u>UA</u>UCGUUUUUGG<u>A</u>A<u>A</u>GACAAUCtt-3' (SEQ ID NO: 5064)

3'-<u>UAAA</u>UAGCAAAAAC<u>C</u>UU<u>U</u>CUGUUA<u>GAA</u>A-5' (SEQ ID NO: 7374)

C5-3726 Target:
5'-ATTTATCGTTTTTGGAAAGACAATCTT-3' (SEQ ID NO: 9684)

5'-U<u>A</u>UCGUUUUUGGA<u>AA</u>GACAAUCUtc-3' (SEQ ID NO: 5065)

3'-<u>AAA</u>UAGCAAAAACCUU<u>U</u>CUGUUA<u>GAA</u>G-5' (SEQ ID NO: 7375)

C5-3727 Target:
5'-TTTATCGTTTTTGGAAAGACAATCTTC-3' (SEQ ID NO: 9685)

5'-C<u>AU</u>AAAGACAGCUC<u>U</u>GUACCUAAca-3' (SEQ ID NO: 5066)

3'-<u>UCGUA</u>UUUCUGUCG<u>AGA</u>CAUGGAUUGU-5' (SEQ ID NO: 7376)

C5-3754 Target:
5'-AGCATAAAGACAGCTCTGTACCTAACA-3' (SEQ ID NO: 9686)

5'-<u>A</u>U<u>AA</u>AGACAGCUC<u>U</u>GU<u>A</u>CCUAACac-3' (SEQ ID NO: 5067)

3'-<u>CGUA</u>UUUCUGUCG<u>AGA</u>CAUGGAUUGUG-5' (SEQ ID NO: 7377)

C5-3755 Target:
5'-GCATAAAGACAGCTCTGTACCTAACAC-3' (SEQ ID NO: 9687)

5'-U<u>A</u>AAGACAGCUCUGU<u>A</u>CCUAACAct-3' (SEQ ID NO: 5068)

3'-<u>GUA</u>UU<u>U</u>CUGUCGAGAC<u>A</u>UGGAUU<u>GUA</u>-5' (SEQ ID NO: 7378)

C5-3756 Target:
5'-CATAAAGACAGCTCTGTACCTAACACT-3' (SEQ ID NO: 9688)

5'-<u>A</u>A<u>A</u>GACAGCUCUGUA<u>C</u>CUAACACtg-3' (SEQ ID NO: 5069)

3'-<u>UAU</u>UU<u>C</u>UGUCGAGAC<u>A</u>UGGAUUGU<u>GAC</u>-5' (SEQ ID NO: 7379)

C5-3757 Target:
5'-ATAAAGACAGCTCTGTACCTAACACTG-3' (SEQ ID NO: 9689)

5'-A<u>A</u>GACAGCUCUGUA<u>CC</u>UAACACUgg-3' (SEQ ID NO: 5070)

3'-<u>A</u>UU<u>U</u>CUGUCGAGAC<u>A</u>UGGAUUGU<u>GACC</u>-5' (SEQ ID NO: 7380)

C5-3758 Target:
5'-TAAAGACAGCTCTGTACCTAACACTGG-3' (SEQ ID NO: 9690)

5'-A<u>GA</u>CAGCUCUGUAC<u>C</u>UAACACUGgt-3' (SEQ ID NO: 5071)

3'-<u>UUU</u>CUGUCGAGACAU<u>GG</u>AUUGU<u>GACCA</u>-5' (SEQ ID NO: 7381)

C5-3759 Target:
5'-AAAGACAGCTCTGTACCTAACACTGGT-3' (SEQ ID NO: 9691)

5'-G<u>AC</u>AGCUCUGUAC<u>C</u>UAACACUGGta-3' (SEQ ID NO: 5072)

3'-<u>UUC</u>UGUCGAGACAU<u>GGA</u>UUGU<u>GACCAU</u>-5' (SEQ ID NO: 7382)

C5-3760 Target:
5'-AAGACAGCTCTGTACCTAACACTGGTA-3' (SEQ ID NO: 9692)

5'-<u>A</u>C<u>AG</u>CUCUGUACC<u>UAA</u>CACUGGUac-3' (SEQ ID NO: 5073)

3'-<u>UC</u>UGUCGAGACAUG<u>GA</u>UUGUGACC<u>AUG</u>-5' (SEQ ID NO: 7383)

C5-3761 Target:
5'-AGACAGCTCTGTACCTAACACTGGTAC-3' (SEQ ID NO: 9693)

5'-C<u>AG</u>CUCUGUACCUA<u>A</u>CACUGGUAcg-3' (SEQ ID NO: 5074)

3'-<u>C</u>UGU<u>C</u>GAGACAUGG<u>A</u>UUGUGACC<u>AUGC</u>-5' (SEQ ID NO: 7384)

C5-3762 Target:
5'-GACAGCTCTGTACCTAACACTGGTACG-3' (SEQ ID NO: 9694)

5'-<u>A</u>G<u>C</u>UCUGUACCUA<u>AC</u>ACUGGUACgg-3' (SEQ ID NO: 5075)

3'-<u>UGUC</u>GAGACAUGGA<u>UU</u>GUGACCAU<u>GCC</u>-5' (SEQ ID NO: 7385)

C5-3763 Target:
5'-ACAGCTCTGTACCTAACACTGGTACGG-3' (SEQ ID NO: 9695)

5'-G<u>C</u>UCUGUACCUAA<u>CAC</u>UGGUACGgc-3' (SEQ ID NO: 5076)

3'-<u>GUC</u>GAGACAUGGAU<u>U</u>GUGACCAUG<u>CCG</u>-5' (SEQ ID NO: 7386)

C5-3764 Target:
5'-CAGCTCTGTACCTAACACTGGTACGGC-3' (SEQ ID NO: 9696)

5'-C<u>U</u>CUGUACCUAAC<u>AC</u>UGGUACGGca-3' (SEQ ID NO: 5077)

3'-<u>UCG</u>AGACAUGGAUU<u>G</u>UGACCAUG<u>CCGU</u>-5' (SEQ ID NO: 7387)

C5-3765 Target:
5'-AGCTCTGTACCTAACACTGGTACGGCA-3' (SEQ ID NO: 9697)

5'-U<u>C</u>UGUACCUAACA<u>C</u>UGGUACGGCac-3' (SEQ ID NO: 5078)

3'-<u>CG</u>AGACAUGGAUUG<u>U</u>GA<u>C</u>CAUGCC<u>GUG</u>-5' (SEQ ID NO: 7388)

C5-3766 Target:
5'-GCTCTGTACCTAACACTGGTACGGCAC-3' (SEQ ID NO: 9698)

5'-C<u>U</u>GUACCUAACAC<u>U</u>GGUACGGCAcg-3' (SEQ ID NO: 5079)

3'-<u>GAGA</u>CAUGGAUUGUG<u>A</u>CCAUGCC<u>GUGC</u>-5' (SEQ ID NO: 7389)

C5-3767 Target:
5'-CTCTGTACCTAACACTGGTACGGCACG-3' (SEQ ID NO: 9699)

5'-<u>GC</u>A<u>C</u>GUAUGGUAG<u>AAA</u>CAACUGCct-3' (SEQ ID NO: 5080)

3'-<u>GCC</u>GUGCAUACCAU<u>C</u>UU<u>U</u>GUUGAC<u>GGA</u>-5' (SEQ ID NO: 7390)

C5-3787 Target:
5'-CGGCACGTATGGTAGAAACAACTGCCT-3' (SEQ ID NO: 9700)

5'-C<u>AC</u>GUAUGGUAGA<u>AA</u>CAACUGCCta-3' (SEQ ID NO: 5081)

3'-<u>CC</u>GUGCAUACCAUC<u>U</u>UUGUUGAC<u>GGAU</u>-5' (SEQ ID NO: 7391)

C5-3788 Target:
5'-GGCACGTATGGTAGAAACAACTGCCTA-3' (SEQ ID NO: 9701)

5'-<u>AC</u>GUAUGGUAGAA<u>AC</u>AACUGCCUat-3' (SEQ ID NO: 5082)

3'-<u>CGUGC</u>AUACCAUCU<u>U</u>UGUUGAC<u>GGAUA</u>-5' (SEQ ID NO: 7392)

C5-3789 Target:
5'-GCACGTATGGTAGAAACAACTGCCTAT-3' (SEQ ID NO: 9702)

5'-C<u>GU</u>AUGGUAGAAA<u>CA</u>ACUGCCUAtg-3' (SEQ ID NO: 5083)

3'-<u>GUGC</u>AUACCAUCUU<u>U</u>GUUGACGG<u>AUAC</u>-5' (SEQ ID NO: 7393)

C5-3790 Target:
5'-CACGTATGGTAGAAACAACTGCCTATG-3' (SEQ ID NO: 9703)

5'-G<u>U</u>AUGGUAGAAAC<u>AA</u>CUGCCUAUgc-3' (SEQ ID NO: 5084)

3'-<u>UGC</u>AUACCAUCUUUGUUGACGGA<u>UACG</u>-5' (SEQ ID NO: 7394)

C5-3791 Target:
5'-ACGTATGGTAGAAACAACTGCCTATGC-3' (SEQ ID NO: 9704)

5'-U<u>A</u>UGGUAGAAACA<u>AC</u>UGCCUAUGct-3' (SEQ ID NO: 5085)

3'-<u>GCAU</u>ACCAUCUUUGUUGACGGAU<u>ACGA</u>-5' (SEQ ID NO: 7395)

TABLE 7-continued

Human Anti-C5 DsiRNAs Predicted to have >50% Knockdown Efficacy (Asymmetrics)

C5-3792 Target:
5'-CGTATGGTAGAAACAACTGCCTATGCT-3' (SEQ ID NO: 9705)

5'-AUGGUAGAAACAACUGCCUAUGCtt-3' (SEQ ID NO: 5086)

3'-CAUACCAUCUUUGUUGACGGAUACGAA-5' (SEQ ID NO: 7396)

C5-3793 Target:
5'-GTATGGTAGAAACAACTGCCTATGCTT-3' (SEQ ID NO: 9706)

5'-UGGUAGAAACAACUGCCUAUGCUtt-3' (SEQ ID NO: 5087)

3'-AUACCAUCUUUGUUGACGGAUACGAAA-5' (SEQ ID NO: 7397)

C5-3794 Target:
5'-TATGGTAGAAACAACTGCCTATGCTTT-3' (SEQ ID NO: 9707)

5'-GGUAGAAACAACUGCCUAUGCUUta-3' (SEQ ID NO: 5088)

3'-UACCAUCUUUGUUGACGGAUACGAAAU-5' (SEQ ID NO: 7398)

C5-3795 Target:
5'-ATGGTAGAAACAACTGCCTATGCTTTA-3' (SEQ ID NO: 9708)

5'-GUAGAAACAACUGCCUAUGCUUUac-3' (SEQ ID NO: 5089)

3'-ACCAUCUUUGUUGACGGAUACGAAAUG-5' (SEQ ID NO: 7399)

C5-3796 Target:
5'-TGGTAGAAACAACTGCCTATGCTTTAC-3' (SEQ ID NO: 9709)

5'-UAGAAACAACUGCCUAUGCUUUAct-3' (SEQ ID NO: 5090)

3'-CCAUCUUUGUUGACGGAUACGAAAUGA-5' (SEQ ID NO: 7400)

C5-3797 Target:
5'-GGTAGAAACAACTGCCTATGCTTTACT-3' (SEQ ID NO: 9710)

5'-AGAAACAACUGCCUAUGCUUUACtc-3' (SEQ ID NO: 5091)

3'-CAUCUUUGUUGACGGAUACGAAAUGAG-5' (SEQ ID NO: 7401)

C5-3798 Target:
5'-GTAGAAACAACTGCCTATGCTTTACTC-3' (SEQ ID NO: 9711)

5'-GAAACAACUGCCUAUGCUUUACUca-3' (SEQ ID NO: 5092)

3'-AUCUUUGUUGACGGAUACGAAAUGAGU-5' (SEQ ID NO: 7402)

C5-3799 Target:
5'-TAGAAACAACTGCCTATGCTTTACTCA-3' (SEQ ID NO: 9712)

5'-AAACAACUGCCUAUGCUUUACUCac-3' (SEQ ID NO: 5093)

3'-UCUUUGUUGACGGAUACGAAAUGAGUG-5' (SEQ ID NO: 7403)

C5-3800 Target:
5'-AGAAACAACTGCCTATGCTTTACTCAC-3' (SEQ ID NO: 9713)

5'-AACAACUGCCUAUGCUUUACUCAcc-3' (SEQ ID NO: 5094)

3'-CUUUGUUGACGGAUACGAAAUGAGUGG-5' (SEQ ID NO: 7404)

C5-3801 Target:
5'-GAAACAACTGCCTATGCTTTACTCACC-3' (SEQ ID NO: 9714)

5'-ACAACUGCCUAUGCUUUACUCACca-3' (SEQ ID NO: 5095)

3'-UUUGUUGACGGAUACGAAAUGAGUGGU-5' (SEQ ID NO: 7405)

C5-3802 Target:
5'-AAACAACTGCCTATGCTTTACTCACCA-3' (SEQ ID NO: 9715)

5'-CAACUGCCUAUGCUUUACUCACCag-3' (SEQ ID NO: 5096)

3'-UUGUUGACGGAUACGAAAUGAGUGGUC-5' (SEQ ID NO: 7406)

C5-3803 Target:
5'-AACAACTGCCTATGCTTTACTCACCAG-3' (SEQ ID NO: 9716)

5'-AACUGCCUAUGCUUUACUCACCAgt-3' (SEQ ID NO: 5097)

3'-UGUUGACGGAUACGAAAUGAGUGGUCA-5' (SEQ ID NO: 7407)

C5-3804 Target:
5'-ACAACTGCCTATGCTTTACTCACCAGT-3' (SEQ ID NO: 9717)

5'-ACUGCCUAUGCUUUACUCACCAGtc-3' (SEQ ID NO: 5098)

3'-GUUGACGGAUACGAAAUGAGUGGUCAG-5' (SEQ ID NO: 7408)

C5-3805 Target:
5'-CAACTGCCTATGCTTTACTCACCAGTC-3' (SEQ ID NO: 9718)

5'-CUGCCUAUGCUUUACUCACCAGUct-3' (SEQ ID NO: 5099)

3'-UUGACGGAUACGAAAUGAGUGGUCAGA-5' (SEQ ID NO: 7409)

C5-3806 Target:
5'-AACTGCCTATGCTTTACTCACCAGTCT-3' (SEQ ID NO: 9719)

5'-UGCCUAUGCUUUACUCACCAGUCtg-3' (SEQ ID NO: 5100)

3'-UGACGGAUACGAAAUGAGUGGUCAGAC-5' (SEQ ID NO: 7410)

C5-3807 Target:
5'-ACTGCCTATGCTTTACTCACCAGTCTG-3' (SEQ ID NO: 9720)

5'-GCCUAUGCUUUACUCACCAGUCUga-3' (SEQ ID NO: 5101)

3'-GACGGAUACGAAAUGAGUGGUCAGACU-5' (SEQ ID NO: 7411)

C5-3808 Target:
5'-CTGCCTATGCTTTACTCACCAGTCTGA-3' (SEQ ID NO: 9721)

5'-CCUAUGCUUUACUCACCAGUCUGaa-3' (SEQ ID NO: 5102)

3'-ACGGAUACGAAAUGAGUGGUCAGACUU-5' (SEQ ID NO: 7412)

C5-3809 Target:
5'-TGCCTATGCTTTACTCACCAGTCTGAA-3' (SEQ ID NO: 9722)

5'-CUAUGCUUUACUCACCAGUCUGAac-3' (SEQ ID NO: 5103)

3'-CGGAUACGAAAUGAGUGGUCAGACUUG-5' (SEQ ID NO: 7413)

C5-3810 Target:
5'-GCCTATGCTTTACTCACCAGTCTGAAC-3' (SEQ ID NO: 9723)

5'-UAUGCUUUACUCACCAGUCUGAAct-3' (SEQ ID NO: 5104)

3'-GGAUACGAAAUGAGUGGUCAGACUUGA-5' (SEQ ID NO: 7414)

C5-3811 Target:
5'-CCTATGCTTTACTCACCAGTCTGAACT-3' (SEQ ID NO: 9724)

5'-AUGCUUUACUCACCAGUCUGAACtt-3' (SEQ ID NO: 5105)

3'-GAUACGAAAUGAGUGGUCAGACUUGAA-5' (SEQ ID NO: 7415)

C5-3812 Target:
5'-CTATGCTTTACTCACCAGTCTGAACTT-3' (SEQ ID NO: 9725)

5'-UGCUUUACUCACCAGUCUGAACUtg-3' (SEQ ID NO: 5106)

3'-AUACGAAAUGAGUGGUCAGACUUGAAC-5' (SEQ ID NO: 7416)

C5-3813 Target:
5'-TATGCTTTACTCACCAGTCTGAACTTG-3' (SEQ ID NO: 9726)

5'-UUUACUCACCAGUCUGAACUUGAaa-3' (SEQ ID NO: 5107)

3'-CGAAAUGAGUGGUCAGACUUGAACUUU-5' (SEQ ID NO: 7417)

TABLE 7-continued

Human Anti-C5 DsiRNAs Predicted to have >50% Knockdown Efficacy (Asymmetrics)

C5-3816 Target:
5'-GCTTTACTCACCAGTCTGAACTTGAAA-3' (SEQ ID NO: 9727)

5'-UUACUCACCAGUCUGAACUUGAAag-3' (SEQ ID NO: 5108)

3'-GAAAUGAGUGGUCAGACUUGAACUUUC-5' (SEQ ID NO: 7418)

C5-3817 Target:
5'-CTTTACTCACCAGTCTGAACTTGAAAG-3' (SEQ ID NO: 9728)

5'-UACUCACCAGUCUGAACUUGAAAga-3' (SEQ ID NO: 5109)

3'-AAAUGAGUGGUCAGACUUGAACUUUCU-5' (SEQ ID NO: 7419)

C5-3818 Target:
5'-TTTACTCACCAGTCTGAACTTGAAAGA-3' (SEQ ID NO: 9729)

5'-ACUCACCAGUCUGAACUUGAAAgat-3' (SEQ ID NO: 5110)

3'-AAUGAGUGGUCAGACUUGAACUUUCUA-5' (SEQ ID NO: 7420)

C5-3819 Target:
5'-TTACTCACCAGTCTGAACTTGAAAGAT-3' (SEQ ID NO: 9730)

5'-UCACCAGUCUGAACUUGAAAGAUat-3' (SEQ ID NO: 5111)

3'-UGAGUGGUCAGACUUGAACUUUCUAUA-5' (SEQ ID NO: 7421)

C5-3821 Target:
5'-ACTCACCAGTCTGAACTTGAAAGATAT-3' (SEQ ID NO: 9731)

5'-CACCAGUCUGAACUUGAAAGAUata-3' (SEQ ID NO: 5112)

3'-GAGUGGUCAGACUUGAACUUUCUAUAU-5' (SEQ ID NO: 7422)

C5-3822 Target:
5'-CTCACCAGTCTGAACTTGAAAGATATA-3' (SEQ ID NO: 9732)

5'-ACCAGUCUGAACUUGAAAGAUAUaa-3' (SEQ ID NO: 5113)

3'-AGUGGUCAGACUUGAACUUUCUAUAUU-5' (SEQ ID NO: 7423)

C5-3823 Target:
5'-TCACCAGTCTGAACTTGAAAGATATAA-3' (SEQ ID NO: 9733)

5'-UCAUCAAAUGGCUAUCAGAAGAGca-3' (SEQ ID NO: 5114)

3'-UCAGUAGUUUACCGAUAGUCUUCUCGU-5' (SEQ ID NO: 7424)

C5-3863 Target:
5'-AGTCATCAAATGGCTATCAGAAGAGCA-3' (SEQ ID NO: 9734)

5'-CAUCAAAUGGCUAUCAGAAGAGCag-3' (SEQ ID NO: 5115)

3'-CAGUAGUUUACCGAUAGUCUUCUCGUC-5' (SEQ ID NO: 7425)

C5-3864 Target:
5'-GTCATCAAATGGCTATCAGAAGAGCAG-3' (SEQ ID NO: 9735)

5'-AUCAAAUGGCUAUCAGAAGAGCAga-3' (SEQ ID NO: 5116)

3'-AGUAGUUUACCGAUAGUCUUCUCGUCU-5' (SEQ ID NO: 7426)

C5-3865 Target:
5'-TCATCAAATGGCTATCAGAAGAGCAGA-3' (SEQ ID NO: 9736)

5'-UCAAAUGGCUAUCAGAAGAGCAGag-3' (SEQ ID NO: 5117)

3'-GUAGUUUACCGAUAGUCUUCUCGUCUC-5' (SEQ ID NO: 7427)

C5-3866 Target:
5'-CATCAAATGGCTATCAGAAGAGCAGAG-3' (SEQ ID NO: 9737)

5'-CAAAUGGCUAUCAGAAGAGCAGAgg-3' (SEQ ID NO: 5118)

3'-UAGUUUACCGAUAGUCUUCUCGUCUCC-5' (SEQ ID NO: 7428)

C5-3867 Target:
5'-ATCAAATGGCTATCAGAAGAGCAGAGG-3' (SEQ ID NO: 9738)

5'-AAAUGGCUAUCAGAAGAGCAGAGgt-3' (SEQ ID NO: 5119)

3'-AGUUUACCGAUAGUCUUCUCGUCUCCA-5' (SEQ ID NO: 7429)

C5-3868 Target:
5'-TCAAATGGCTATCAGAAGAGCAGAGGT-3' (SEQ ID NO: 9739)

5'-AAUGGCUAUCAGAAGAGCAGAGGta-3' (SEQ ID NO: 5120)

3'-GUUUACCGAUAGUCUUCUCGUCUCCAU-5' (SEQ ID NO: 7430)

C5-3869 Target:
5'-CAAATGGCTATCAGAAGAGCAGAGGTA-3' (SEQ ID NO: 9740)

5'-AUGGCUAUCAGAAGAGCAGAGGUat-3' (SEQ ID NO: 5121)

3'-UUUACCGAUAGUCUUCUCGUCUCCAUA-5' (SEQ ID NO: 7431)

C5-3870 Target:
5'-AAATGGCTATCAGAAGAGCAGAGGTAT-3' (SEQ ID NO: 9741)

5'-UGGCUAUCAGAAGAGCAGAGGUAtg-3' (SEQ ID NO: 5122)

3'-UUACCGAUAGUCUUCUCGUCUCCAUAC-5' (SEQ ID NO: 7432)

C5-3871 Target:
5'-AATGGCTATCAGAAGAGCAGAGGTATG-3' (SEQ ID NO: 9742)

5'-GGCUAUCAGAAGAGCAGAGGUAUgg-3' (SEQ ID NO: 5123)

3'-UACCGAUAGUCUUCUCGUCUCCAUACC-5' (SEQ ID NO: 7433)

C5-3872 Target:
5'-ATGGCTATCAGAAGAGCAGAGGTATGG-3' (SEQ ID NO: 9743)

5'-GCUAUCAGAAGAGCAGAGGUAUGga-3' (SEQ ID NO: 5124)

3'-ACCGAUAGUCUUCUCGUCUCCAUACCU-5' (SEQ ID NO: 7434)

C5-3873 Target:
5'-TGGCTATCAGAAGAGCAGAGGTATGGA-3' (SEQ ID NO: 9744)

5'-CUAUCAGAAGAGCAGAGGUAUGGag-3' (SEQ ID NO: 5125)

3'-CCGAUAGUCUUCUCGUCUCCAUACCUC-5' (SEQ ID NO: 7435)

C5-3874 Target:
5'-GGCTATCAGAAGAGCAGAGGTATGGAG-3' (SEQ ID NO: 9745)

5'-UAUCAGAAGAGCAGAGGUAUGGAgg-3' (SEQ ID NO: 5126)

3'-CGAUAGUCUUCUCGUCUCCAUACCUCC-5' (SEQ ID NO: 7436)

C5-3875 Target:
5'-GCTATCAGAAGAGCAGAGGTATGGAGG-3' (SEQ ID NO: 9746)

5'-AUCAGAAGAGCAGAGGUAUGGAGgt-3' (SEQ ID NO: 5127)

3'-GAUAGUCUUCUCGUCUCCAUACCUCCA-5' (SEQ ID NO: 7437)

C5-3876 Target:
5'-CTATCAGAAGAGCAGAGGTATGGAGGT-3' (SEQ ID NO: 9747)

5'-UCAGAAGAGCAGAGGUAUGGAGGtg-3' (SEQ ID NO: 5128)

3'-AUAGUCUUCUCGUCUCCAUACCUCCAC-5' (SEQ ID NO: 7438)

C5-3877 Target:
5'-TATCAGAAGAGCAGAGGTATGGAGGTG-3' (SEQ ID NO: 9748)

5'-CAGAAGAGCAGAGGUAUGGAGGUgg-3' (SEQ ID NO: 5129)

3'-UAGUCUUCUCGUCUCCAUACCUCCACC-5' (SEQ ID NO: 7439)

TABLE 7-continued

Human Anti-C5 DsiRNAs Predicted to have >50% Knockdown Efficacy (Asymmetrics)

C5-3878 Target:
5'-ATCAGAAGAGCAGAGGTATGGAGGTGG-3' (SEQ ID NO: 9749)

5'-A<u>GA</u>AGAGCAGAGG<u>UA</u>U<u>GG</u>AGG<u>U</u>Ggc-3' (SEQ ID NO: 5130)

3'-<u>AGU</u>C<u>UUCUCGUCUCC</u>A<u>U</u>ACC<u>U</u>CC<u>ACCG</u>-5' (SEQ ID NO: 7440)

C5-3879 Target:
5'-TCAGAAGAGCAGAGGTATGGAGGTGGC-3' (SEQ ID NO: 9750)

5'-A<u>GA</u>GCAGAGGUAU<u>GG</u>A<u>GG</u>UGGCUtt-3' (SEQ ID NO: 5131)

3'-<u>CUUCUCGUCUCC</u>AU<u>ACC</u>UCCACC<u>GAAA</u>-5' (SEQ ID NO: 7441)

C5-3882 Target:
5'-GAAGAGCAGAGGTATGGAGGTGGCTTT-3' (SEQ ID NO: 9751)

5'-G<u>AG</u>CAGAGGUAUGG<u>AG</u>GUGGCUUtt-3' (SEQ ID NO: 5132)

3'-<u>UUC</u>U<u>C</u>G<u>UCUCC</u>AU<u>ACC</u>UCCACCG<u>AAAA</u>-5' (SEQ ID NO: 7442)

C5-3883 Target:
5'-AAGAGCAGAGGTATGGAGGTGGCTTTT-3' (SEQ ID NO: 9752)

5'-A<u>GC</u>AGAGGUAUGGA<u>GG</u>UGGCUUUta-3' (SEQ ID NO: 5133)

3'-<u>UCUC</u>G<u>UCUCC</u>AUACC<u>UCC</u>ACCGAAAAU-5' (SEQ ID NO: 7443)

C5-3884 Target:
5'-AGAGCAGAGGTATGGAGGTGGCTTTTA-3' (SEQ ID NO: 9753)

5'-GC<u>A</u>GAGGUAUGGAG<u>GU</u>GGCUUUUat-3' (SEQ ID NO: 5134)

3'-<u>CUC</u>G<u>U</u>C<u>UCC</u>AUACC<u>UCC</u>ACCGAAAAUA-5' (SEQ ID NO: 7444)

C5-3885 Target:
5'-GAGCAGAGGTATGGAGGTGGCTTTTAT-3' (SEQ ID NO: 9754)

5'-C<u>A</u>GAGGUAUGGAGG<u>UG</u>GCUUUUAtt-3' (SEQ ID NO: 5135)

3'-<u>UCGU</u>C<u>UCC</u>AUACC<u>UCC</u>ACCGAAAAUAA-5' (SEQ ID NO: 7445)

C5-3886 Target:
5'-AGCAGAGGTATGGAGGTGGCTTTTATT-3' (SEQ ID NO: 9755)

5'-A<u>GA</u>GGUAUGGAGG<u>UGG</u>CUUUUAUtc-3' (SEQ ID NO: 5136)

3'-<u>CGUCUCC</u>AUACC<u>UCC</u>ACCGAAAAU<u>AAG</u>-5' (SEQ ID NO: 7446)

C5-3887 Target:
5'-GCAGAGGTATGGAGGTGGCTTTTATTC-3' (SEQ ID NO: 9756)

5'-G<u>AG</u>GUAUGGAGGUGG<u>C</u>UUUUAUUca-3' (SEQ ID NO: 5137)

3'-<u>GUCUCC</u>AUACCUCC<u>A</u>CCGAAAAU<u>AAGU</u>-5' (SEQ ID NO: 7447)

C5-3888 Target:
5'-CAGAGGTATGGAGGTGGCTTTTATTCA-3' (SEQ ID NO: 9757)

5'-A<u>GGU</u>AUGGAGGUGG<u>C</u>UUUUAUUCaa-3' (SEQ ID NO: 5138)

3'-<u>UCUCC</u>AUACCUCC<u>ACC</u>GAAAAUA<u>AGUU</u>-5' (SEQ ID NO: 7448)

C5-3889 Target:
5'-AGAGGTATGGAGGTGGCTTTTATTCAA-3' (SEQ ID NO: 9758)

5'-G<u>GU</u>AUGGAGGUGG<u>C</u>UUUUAUUCAac-3' (SEQ ID NO: 5139)

3'-<u>CUCC</u>AUACCUCCACC<u>G</u>AAAAUAAGUUG-5' (SEQ ID NO: 7449)

C5-3890 Target:
5'-GAGGTATGGAGGTGGCTTTTATTCAAC-3' (SEQ ID NO: 9759)

5'-G<u>U</u>AUGGAGGUGGC<u>U</u>UUUAUUCAAcc-3' (SEQ ID NO: 5140)

3'-<u>UCC</u>AUACCUCCACC<u>G</u>AAAAUAAGUUGG-5' (SEQ ID NO: 7450)

TABLE 7-continued

Human Anti-C5 DsiRNAs Predicted to have >50% Knockdown Efficacy (Asymmetrics)

C5-3891 Target:
5'-AGGTATGGAGGTGGCTTTTATTCAACC-3' (SEQ ID NO: 9760)

5'-<u>UA</u>UGGAGGUGGCU<u>UUU</u>AUUCAACcc-3' (SEQ ID NO: 5141)

3'-<u>CCA</u>UACCUCCACCG<u>AAAA</u>UAAGUU<u>GGG</u>-5' (SEQ ID NO: 7451)

C5-3892 Target:
5'-GGTATGGAGGTGGCTTTTATTCAACCC-3' (SEQ ID NO: 9761)

5'-A<u>U</u>GGAGGUGGCUUU<u>U</u>AUUCAACCca-3' (SEQ ID NO: 5142)

3'-<u>CA</u>UACCUCCACCG<u>AAAA</u>UAAGUU<u>GGGU</u>-5' (SEQ ID NO: 7452)

C5-3893 Target:
5'-GTATGGAGGTGGCTTTTATTCAACCCA-3' (SEQ ID NO: 9762)

5'-U<u>GG</u>AGGUGGCUUUU<u>A</u>UUCAACCCag-3' (SEQ ID NO: 5143)

3'-<u>AU</u>ACCUCCACCGAAAAUAAGUUGGG<u>UC</u>-5' (SEQ ID NO: 7453)

C5-3894 Target:
5'-TATGGAGGTGGCTTTTATTCAACCCAG-3' (SEQ ID NO: 9763)

5'-G<u>GA</u>GGUGGCUUUUA<u>UU</u>CAACCCAgg-3' (SEQ ID NO: 5144)

3'-<u>U</u>ACCUCCACCGAAAAUAAGUUGGG<u>UCC</u>-5' (SEQ ID NO: 7454)

C5-3895 Target:
5'-ATGGAGGTGGCTTTTATTCAACCCAGG-3' (SEQ ID NO: 9764)

5'-G<u>A</u>GGUGGCUUUUA<u>UU</u>CAACCCAGga-3' (SEQ ID NO: 5145)

3'-<u>ACC</u>UCCACCGAAAAUAAGUUGGG<u>UCCU</u>-5' (SEQ ID NO: 7455)

C5-3896 Target:
5'-TGGAGGTGGCTTTTATTCAACCCAGGA-3' (SEQ ID NO: 9765)

5'-<u>A</u>GGUGGCUUUUAUU<u>C</u>AACCCAGGac-3' (SEQ ID NO: 5146)

3'-<u>CC</u>UCCACCGAAAAU<u>AAG</u>UUGGGU<u>CCUG</u>-5' (SEQ ID NO: 7456)

C5-3897 Target:
5'-GGAGGTGGCTTTTATTCAACCCAGGAC-3' (SEQ ID NO: 9766)

5'-GG<u>U</u>GGCUUUUAUUC<u>A</u>ACCCAGGAca-3' (SEQ ID NO: 5147)

3'-<u>CUCC</u>ACCGAAAAU<u>AAG</u>UUGGGUC<u>CUGU</u>-5' (SEQ ID NO: 7457)

C5-3898 Target:
5'-GAGGTGGCTTTTATTCAACCCAGGACA-3' (SEQ ID NO: 9767)

5'-GU<u>GG</u>CUUUUAUUC<u>AA</u>CCCAGGACac-3' (SEQ ID NO: 5148)

3'-<u>UCC</u>ACCGAAAAUAAGUUGGGUC<u>CUGUG</u>-5' (SEQ ID NO: 7458)

C5-3899 Target:
5'-AGGTGGCTTTTATTCAACCCAGGACAC-3' (SEQ ID NO: 9768)

5'-A<u>AU</u>AUUCACUCCUG<u>GU</u>UAAACAAct-3' (SEQ ID NO: 5149)

3'-<u>CCU</u>UAUAAGUGAGG<u>ACC</u>AAUUUGUUGA-5' (SEQ ID NO: 7459)

C5-3950 Target:
5'-GGAATATTCACTCCTGGTTAAACAACT-3' (SEQ ID NO: 9769)

5'-A<u>UA</u>UUCACUCCUG<u>GUU</u>AAACAACtc-3' (SEQ ID NO: 5150)

3'-<u>CUU</u>UAUAAGUGAGG<u>ACC</u>AAUUUGUUGAG-5' (SEQ ID NO: 7460)

C5-3951 Target:
5'-GAATATTCACTCCTGGTTAAACAACTC-3' (SEQ ID NO: 9770)

5'-U<u>AU</u>UCACUCCUG<u>GUU</u>AAACAACUcc-3' (SEQ ID NO: 5151)

3'-<u>UUAUA</u>AGUGAGGACC<u>A</u>AUUUGUU<u>GAGG</u>-5' (SEQ ID NO: 7461)

TABLE 7-continued

Human Anti-C5 DsiRNAs Predicted to have >50% Knockdown Efficacy (Asymmetrics)

```
C5-3952 Target:
5'-AATATTCACTCCTGGTTAAACAACTCC-3' (SEQ ID NO: 9771)

5'-AUUCACUCCUGGUUAAACAACUCCg-3' (SEQ ID NO: 5152)

3'-UAUAAGUGAGGACCAAUUUGUUGAGGC-5' (SEQ ID NO: 7462)

C5-3953 Target:
5'-ATATTCACTCCTGGTTAAACAACTCCG-3' (SEQ ID NO: 9772)

5'-CUUACAUAAUUAUAAAAUGACAGAc-3' (SEQ ID NO: 5153)

3'-CGGAAUGUAUUAAUAUUUUACUGUCUG-5' (SEQ ID NO: 7463)

C5-4020 Target:
5'-GCCTTACATAATTATAAAATGACAGAC-3' (SEQ ID NO: 9773)

5'-UUACAUAAUUAUAAAAUGACAGACa-3' (SEQ ID NO: 5154)

3'-GGAAUGUAUUAAUAUUUUACUGUCUGU-5' (SEQ ID NO: 7464)

C5-4021 Target:
5'-CCTTACATAATTATAAAATGACAGACA-3' (SEQ ID NO: 9774)

5'-UACAUAAUUAUAAAAUGACAGACaa-3' (SEQ ID NO: 5155)

3'-GAAUGUAUUAAUAUUUUACUGUCUGUU-5' (SEQ ID NO: 7465)

C5-4022 Target:
5'-CTTACATAATTATAAAATGACAGACAA-3' (SEQ ID NO: 9775)

5'-ACAUAAUUAUAAAAUGACAGACAag-3' (SEQ ID NO: 5156)

3'-AAUGUAUUAAUAUUUUACUGUCUGUUC-5' (SEQ ID NO: 7466)

C5-4023 Target:
5'-TTACATAATTATAAAATGACAGACAAG-3' (SEQ ID NO: 9776)

5'-CAUAAUUAUAAAAUGACAGACAAga-3' (SEQ ID NO: 5157)

3'-AUGUAUUAAUAUUUUACUGUCUGUUCU-5' (SEQ ID NO: 7467)

C5-4024 Target:
5'-TACATAATTATAAAATGACAGACAAGA-3' (SEQ ID NO: 9777)

5'-AUAAUUAUAAAAUGACAGACAAGaa-3' (SEQ ID NO: 5158)

3'-UGUAUUAAUAUUUUACUGUCUGUUCUU-5' (SEQ ID NO: 7468)

C5-4025 Target:
5'-ACATAATTATAAAATGACAGACAAGAA-3' (SEQ ID NO: 9778)

5'-UAAUUAUAAAAUGACAGACAAGAat-3' (SEQ ID NO: 5159)

3'-GUAUUAAUAUUUUACUGUCUGUUCUUA-5' (SEQ ID NO: 7469)

C5-4026 Target:
5'-CATAATTATAAAATGACAGACAAGAAT-3' (SEQ ID NO: 9779)

5'-AAUUAUAAAAUGACAGACAAGAAtt-3' (SEQ ID NO: 5160)

3'-UAUUAAUAUUUUACUGUCUGUUCUUAA-5' (SEQ ID NO: 7470)

C5-4027 Target:
5'-ATAATTATAAAATGACAGACAAGAATT-3' (SEQ ID NO: 9780)

5'-AUUAUAAAAUGACAGACAAGAAUtt-3' (SEQ ID NO: 5161)

3'-AUUAAUAUUUUACUGUCUGUUCUUAAA-5' (SEQ ID NO: 7471)

C5-4028 Target:
5'-TAATTATAAAATGACAGACAAGAATTT-3' (SEQ ID NO: 9781)

5'-UUAUAAAAUGACAGACAAGAAUUtc-3' (SEQ ID NO: 5162)

3'-UUAAUAUUUUACUGUCUGUUCUUAAAG-5' (SEQ ID NO: 7472)

C5-4029 Target:
5'-AATTATAAAATGACAGACAAGAATTTC-3' (SEQ ID NO: 9782)

5'-UAUAAAAUGACAGACAAGAAUUUcc-3' (SEQ ID NO: 5163)

3'-UAAUAUUUUACUGUCUGUUCUUAAAGG-5' (SEQ ID NO: 7473)

C5-4030 Target:
5'-ATTATAAAATGACAGACAAGAATTTCC-3' (SEQ ID NO: 9783)

5'-AUAAAAUGACAGACAAGAAUUUCct-3' (SEQ ID NO: 5164)

3'-AAUAUUUUACUGUCUGUUCUUAAAGGA-5' (SEQ ID NO: 7474)

C5-4031 Target:
5'-TTATAAAATGACAGACAAGAATTTCCT-3' (SEQ ID NO: 9784)

5'-UAAAAUGACAGACAAGAAUUUCCtt-3' (SEQ ID NO: 5165)

3'-AUAUUUUACUGUCUGUUCUUAAAGGAA-5' (SEQ ID NO: 7475)

C5-4032 Target:
5'-TATAAAATGACAGACAAGAATTTCCTT-3' (SEQ ID NO: 9785)

5'-AAAAUGACAGACAAGAAUUUCCUtg-3' (SEQ ID NO: 5166)

3'-UAUUUUACUGUCUGUUCUUAAAGGAAC-5' (SEQ ID NO: 7476)

C5-4033 Target:
5'-ATAAAATGACAGACAAGAATTTCCTTG-3' (SEQ ID NO: 9786)

5'-AAAUGACAGACAAGAAUUUCCUUgg-3' (SEQ ID NO: 5167)

3'-AUUUUACUGUCUGUUCUUAAAGGAACC-5' (SEQ ID NO: 7477)

C5-4034 Target:
5'-TAAAATGACAGACAAGAATTTCCTTGG-3' (SEQ ID NO: 9787)

5'-AAUGACAGACAAGAAUUUCCUUGgg-3' (SEQ ID NO: 5168)

3'-UUUUACUGUCUGUUCUUAAAGGAACCC-5' (SEQ ID NO: 7478)

C5-4035 Target:
5'-AAAATGACAGACAAGAATTTCCTTGGG-3' (SEQ ID NO: 9788)

5'-AUGACAGACAAGAAUUUCCUUGGga-3' (SEQ ID NO: 5169)

3'-UUUACUGUCUGUUCUUAAAGGAACCCU-5' (SEQ ID NO: 7479)

C5-4036 Target:
5'-AAATGACAGACAAGAATTTCCTTGGGA-3' (SEQ ID NO: 9789)

5'-UGACAGACAAGAAUUUCCUUGGGag-3' (SEQ ID NO: 5170)

3'-UUACUGUCUGUUCUUAAAGGAACCCUC-5' (SEQ ID NO: 7480)

C5-4037 Target:
5'-AATGACAGACAAGAATTTCCTTGGGAG-3' (SEQ ID NO: 9790)

5'-GACAGACAAGAAUUUCCUUGGGAgg-3' (SEQ ID NO: 5171)

3'-UACUGUCUGUUCUUAAAGGAACCCUCC-5' (SEQ ID NO: 7481)

C5-4038 Target:
5'-ATGACAGACAAGAATTTCCTTGGGAGG-3' (SEQ ID NO: 9791)

5'-ACAGACAAGAAUUUCCUUGGGAGgc-3' (SEQ ID NO: 5172)

3'-ACUGUCUGUUCUUAAAGGAACCCUCCG-5' (SEQ ID NO: 7482)

C5-4039 Target:
5'-TGACAGACAAGAATTTCCTTGGGAGGC-3' (SEQ ID NO: 9792)

5'-CAGACAAGAAUUUCCUUGGGAGGcc-3' (SEQ ID NO: 5173)

3'-CUGUCUGUUCUUAAAGGAACCCUCCGG-5' (SEQ ID NO: 7483)
```

TABLE 7-continued

Human Anti-C5 DsiRNAs Predicted to have >50% Knockdown Efficacy (Asymmetrics)

C5-4040 Target:
5'-GACAGACAAGAATTTCCTTGGGAGGCC-3' (SEQ ID NO: 9793)

5'-A<u>GAC</u>AAGAAUUUCC<u>UU</u>GGGAGGCca-3' (SEQ ID NO: 5174)

3'-<u>UGU</u>CUGUUCUUAAA<u>GG</u>AACCCUCC<u>GG</u>U-5' (SEQ ID NO: 7484)

C5-4041 Target:
5'-ACAGACAAGAATTTCCTTGGGAGGCCA-3' (SEQ ID NO: 9794)

5'-G<u>AC</u>AAGAAUUUCC<u>UU</u>GGGAGGCCag-3' (SEQ ID NO: 5175)

3'-<u>GUC</u>UGUUCUUAAAGG<u>A</u>ACCCUCC<u>GG</u>UC-5' (SEQ ID NO: 7485)

C5-4042 Target:
5'-CAGACAAGAATTTCCTTGGGAGGCCAG-3' (SEQ ID NO: 9795)

5'-<u>AC</u>AAGAAUUUCC<u>UU</u>GGGAGGCCAgt-3' (SEQ ID NO: 5176)

3'-<u>UC</u>UGUUCUUAAAGG<u>A</u>ACCCUCCGGUCA-5' (SEQ ID NO: 7486)

C5-4043 Target:
5'-AGACAAGAATTTCCTTGGGAGGCCAGT-3' (SEQ ID NO: 9796)

5'-C<u>A</u>AGAAUUUCC<u>UU</u>GGG<u>A</u>GGCCAGta-3' (SEQ ID NO: 5177)

3'-<u>CU</u>GUUCUUAAAGG<u>A</u>ACCCUCCGGUC<u>AU</u>-5' (SEQ ID NO: 7487)

C5-4044 Target:
5'-GACAAGAATTTCCTTGGGAGGCCAGTA-3' (SEQ ID NO: 9797)

5'-A<u>A</u>GAAUUUCC<u>U</u>UGGG<u>A</u>GGCCAGU<u>A</u>g-3' (SEQ ID NO: 5178)

3'-<u>UG</u>UUC<u>U</u>UAAAGGAA<u>CCC</u>UCCGGU<u>CAU</u>C-5' (SEQ ID NO: 7488)

C5-4045 Target:
5'-ACAAGAATTTCCTTGGGAGGCCAGTAG-3' (SEQ ID NO: 9798)

5'-A<u>G</u>AAUUUCC<u>UU</u>GGG<u>A</u>GGCCAGU<u>A</u>ga-3' (SEQ ID NO: 5179)

3'-<u>GU</u>UC<u>U</u>UAAAGGAA<u>CC</u>CUCCGGUC<u>AU</u>CU-5' (SEQ ID NO: 7489)

C5-4046 Target:
5'-CAAGAATTTCCTTGGGAGGCCAGTAGA-3' (SEQ ID NO: 9799)

5'-G<u>A</u>AUUUCC<u>UU</u>GGG<u>A</u>GGCCAGU<u>A</u>Gag-3' (SEQ ID NO: 5180)

3'-<u>UU</u>C<u>U</u>UAAAGGAACC<u>C</u>UCCGGUC<u>AU</u>CUC-5' (SEQ ID NO: 7490)

C5-4047 Target:
5'-AAGAATTTCCTTGGGAGGCCAGTAGAG-3' (SEQ ID NO: 9800)

5'-C<u>UU</u>GGG<u>A</u>GGCCAGU<u>A</u>GAGGUGCUtc-3' (SEQ ID NO: 5181)

3'-<u>A</u>GG<u>AA</u>CCCUCCGGUC<u>A</u>UCUCCACG<u>A</u>AG-5' (SEQ ID NO: 7491)

C5-4054 Target:
5'-TCCTTGGGAGGCCAGTAGAGGTGCTTC-3' (SEQ ID NO: 9801)

5'-GGG<u>A</u>GGCC<u>A</u>GU<u>A</u>GAG<u>G</u>UGCUUCU<u>C</u>a-3' (SEQ ID NO: 5182)

3'-<u>AACC</u>CUCCGGUCAU<u>C</u>UC<u>C</u>ACGAAG<u>A</u>GU-5' (SEQ ID NO: 7492)

C5-4057 Target:
5'-TTGGGAGGCCAGTAGAGGTGCTTCTCA-3' (SEQ ID NO: 9802)

5'-GG<u>A</u>GGCC<u>A</u>GU<u>A</u>GA<u>GG</u>UGCUUCUCaa-3' (SEQ ID NO: 5183)

3'-<u>A</u>CC<u>C</u>UCCGGUCAUC<u>U</u>C<u>C</u>ACGAAG<u>A</u>GUU-5' (SEQ ID NO: 7493)

C5-4058 Target:
5'-TGGGAGGCCAGTAGAGGTGCTTCTCAA-3' (SEQ ID NO: 9803)

5'-G<u>A</u>GGCCAGUAG<u>A</u>GG<u>U</u>GCUUCUCAat-3' (SEQ ID NO: 5184)

3'-<u>CCC</u>UCCGGUCAUC<u>U</u>C<u>C</u>ACGAAGAGUUA-5' (SEQ ID NO: 7494)

C5-4059 Target:
5'-GGGAGGCCAGTAGAGGTGCTTCTCAAT-3' (SEQ ID NO: 9804)

5'-<u>A</u>GGCCAGUAGAGG<u>UG</u>C<u>UU</u>CUCAAtg-3' (SEQ ID NO: 5185)

3'-<u>CC</u>UCCGGUCAUCUCC<u>A</u>CGAAGAGUUAC-5' (SEQ ID NO: 7495)

C5-4060 Target:
5'-GGAGGCCAGTAGAGGTGCTTCTCAATG-3' (SEQ ID NO: 9805)

5'-GG<u>CC</u>AGUAGAGG<u>UG</u>C<u>UU</u>CUCAAUga-3' (SEQ ID NO: 5186)

3'-<u>C</u>UCCGGUCAUCUCC<u>A</u>CGAAGAGUU<u>A</u>CU-5' (SEQ ID NO: 7496)

C5-4061 Target:
5'-GAGGCCAGTAGAGGTGCTTCTCAATGA-3' (SEQ ID NO: 9806)

5'-GC<u>C</u>AGUAGAGGUGC<u>UU</u>CUCAAUGat-3' (SEQ ID NO: 5187)

3'-<u>U</u>CCGGUCAUCUCC<u>A</u>CGAAGAGUU<u>A</u>CUA-5' (SEQ ID NO: 7497)

C5-4062 Target:
5'-AGGCCAGTAGAGGTGCTTCTCAATGAT-3' (SEQ ID NO: 9807)

5'-<u>CC</u>A<u>G</u>UAGAGGUGC<u>UU</u>C<u>U</u>CAAUGAtg-3' (SEQ ID NO: 5188)

3'-<u>CC</u>GGUCAUCUCCAC<u>G</u>AAGAGUU<u>A</u>CUAC-5' (SEQ ID NO: 7498)

C5-4063 Target:
5'-GGCCAGTAGAGGTGCTTCTCAATGATG-3' (SEQ ID NO: 9808)

5'-C<u>A</u>GUAGAGGUGC<u>UU</u>C<u>U</u>CAAUGAUga-3' (SEQ ID NO: 5189)

3'-<u>CG</u>GUCAUCUCCACG<u>AA</u>GAGUUACU<u>A</u>CU-5' (SEQ ID NO: 7499)

C5-4064 Target:
5'-GCCAGTAGAGGTGCTTCTCAATGATGA-3' (SEQ ID NO: 9809)

5'-<u>A</u>GUAGAGGUGCUU<u>C</u>U<u>C</u>AAUGAUGac-3' (SEQ ID NO: 5190)

3'-<u>GG</u>UC<u>A</u>UCUCCACG<u>AA</u>GAGUUACU<u>A</u>CUG-5' (SEQ ID NO: 7500)

C5-4065 Target:
5'-CCAGTAGAGGTGCTTCTCAATGATGAC-3' (SEQ ID NO: 9810)

5'-G<u>U</u>AGAGGUGCUUC<u>U</u>C<u>A</u>AUGAUGAcc-3' (SEQ ID NO: 5191)

3'-<u>G</u>UC<u>A</u>UCUCCACGAAG<u>A</u>GUUACUACUGG-5' (SEQ ID NO: 7501)

C5-4066 Target:
5'-CAGTAGAGGTGCTTCTCAATGATGACC-3' (SEQ ID NO: 9811)

5'-<u>U</u>AGAGGUGCUUCUC<u>A</u>AUGAUGACct-3' (SEQ ID NO: 5192)

3'-<u>UCA</u>UCUCCACGAAG<u>A</u>GUUACUACUGGA-5' (SEQ ID NO: 7502)

C5-4067 Target:
5'-AGTAGAGGTGCTTCTCAATGATGACCT-3' (SEQ ID NO: 9812)

5'-<u>A</u>GAGGUGCUUCUC<u>A</u>AUGAUGACCtc-3' (SEQ ID NO: 5193)

3'-<u>CA</u>UCUCCACGAAGAGUUACUACUGGAG-5' (SEQ ID NO: 7503)

C5-4068 Target:
5'-GTAGAGGTGCTTCTCAATGATGACCTC-3' (SEQ ID NO: 9813)

5'-G<u>A</u>GGUGCUUCUC<u>A</u>AU<u>G</u>AUGACCUca-3' (SEQ ID NO: 5194)

3'-<u>A</u>UCUCCACGAAGAGUU<u>A</u>CUACUGGAGU-5' (SEQ ID NO: 7504)

C5-4069 Target:
5'-TAGAGGTGCTTCTCAATGATGACCTCA-3' (SEQ ID NO: 9814)

5'-<u>A</u>GGUGCUUCUC<u>A</u>AU<u>G</u>AUGACCUCat-3' (SEQ ID NO: 5195)

3'-<u>U</u>CUCCACGAAGAGUU<u>A</u>CUACUGG<u>A</u>GUA-5' (SEQ ID NO: 7505)

TABLE 7-continued

Human Anti-C5 DsiRNAs Predicted to have >50% Knockdown Efficacy (Asymmetrics)

C5-4070 Target:
5'-AGAGGTGCTTCTCAATGATGACCTCAT-3' (SEQ ID NO: 9815)

5'-GGUGCUUCUCAAUGAUGACCUCAtt-3' (SEQ ID NO: 5196)

3'-CUCCACGAAGAGUUACUACUGGAGUAA-5' (SEQ ID NO: 7506)

C5-4071 Target:
5'-GAGGTGCTTCTCAATGATGACCTCATT-3' (SEQ ID NO: 9816)

5'-GUGCUUCUCAAUGAUGACCUCAUtg-3' (SEQ ID NO: 5197)

3'-UCCACGAAGAGUUACUACUGGAGUAAC-5' (SEQ ID NO: 7507)

C5-4072 Target:
5'-AGGTGCTTCTCAATGATGACCTCATTG-3' (SEQ ID NO: 9817)

5'-UGCUUCUCAAUGAUGACCUCAUUgt-3' (SEQ ID NO: 5198)

3'-CCACGAAGAGUUACUACUGGAGUAACA-5' (SEQ ID NO: 7508)

C5-4073 Target:
5'-GGTGCTTCTCAATGATGACCTCATTGT-3' (SEQ ID NO: 9818)

5'-GCUUCUCAAUGAUGACCUCAUUGtc-3' (SEQ ID NO: 5199)

3'-CACGAAGAGUUACUACUGGAGUAACAG-5' (SEQ ID NO: 7509)

C5-4074 Target:
5'-GTGCTTCTCAATGATGACCTCATTGTC-3' (SEQ ID NO: 9819)

5'-UUGUCAGUACAGGAUUUGGCAGUgg-3' (SEQ ID NO: 5200)

3'-GUAACAGUCAUGUCCUAAACCGUCACC-5' (SEQ ID NO: 7510)

C5-4094 Target:
5'-CATTGTCAGTACAGGATTTGGCAGTGG-3' (SEQ ID NO: 9820)

5'-UGUCAGUACAGGAUUUGGCAGUGgc-3' (SEQ ID NO: 5201)

3'-UAACAGUCAUGUCCUAAACCGUCACCG-5' (SEQ ID NO: 7511)

C5-4095 Target:
5'-ATTGTCAGTACAGGATTTGGCAGTGGC-3' (SEQ ID NO: 9821)

5'-GUCAGUACAGGAUUUGGCAGUGGct-3' (SEQ ID NO: 5202)

3'-AACAGUCAUGUCCUAAACCGUCACCGA-5' (SEQ ID NO: 7512)

C5-4096 Target:
5'-TTGTCAGTACAGGATTTGGCAGTGGCT-3' (SEQ ID NO: 9822)

5'-UCAGUACAGGAUUUGGCAGUGGCtt-3' (SEQ ID NO: 5203)

3'-ACAGUCAUGUCCUAAACCGUCACCGAA-5' (SEQ ID NO: 7513)

C5-4097 Target:
5'-TGTCAGTACAGGATTTGGCAGTGGCTT-3' (SEQ ID NO: 9823)

5'-CAGUACAGGAUUUGGCAGUGGCUtg-3' (SEQ ID NO: 5204)

3'-CAGUCAUGUCCUAAACCGUCACCGAAC-5' (SEQ ID NO: 7514)

C5-4098 Target:
5'-GTCAGTACAGGATTTGGCAGTGGCTTG-3' (SEQ ID NO: 9824)

5'-AGUACAGGAUUUGGCAGUGGCUUgg-3' (SEQ ID NO: 5205)

3'-AGUCAUGUCCUAAACCGUCACCGAACC-5' (SEQ ID NO: 7515)

C5-4099 Target:
5'-TCAGTACAGGATTTGGCAGTGGCTTGG-3' (SEQ ID NO: 9825)

5'-GUACAGGAUUUGGCAGUGGCUUGgc-3' (SEQ ID NO: 5206)

3'-GUCAUGUCCUAAACCGUCACCGAACCG-5' (SEQ ID NO: 7516)

C5-4100 Target:
5'-CAGTACAGGATTTGGCAGTGGCTTGGC-3' (SEQ ID NO: 9826)

5'-UACAGGAUUUGGCAGUGGCUUGGct-3' (SEQ ID NO: 5207)

3'-UCAUGUCCUAAACCGUCACCGAACCGA-5' (SEQ ID NO: 7517)

C5-4101 Target:
5'-AGTACAGGATTTGGCAGTGGCTTGGCT-3' (SEQ ID NO: 9827)

5'-ACAGGAUUUGGCAGUGGCUUGGCta-3' (SEQ ID NO: 5208)

3'-CAUGUCCUAAACCGUCACCGAACCGAU-5' (SEQ ID NO: 7518)

C5-4102 Target:
5'-GTACAGGATTTGGCAGTGGCTTGGCTA-3' (SEQ ID NO: 9828)

5'-CAGGAUUUGGCAGUGGCUUGGCUac-3' (SEQ ID NO: 5209)

3'-AUGUCCUAAACCGUCACCGAACCGAUG-5' (SEQ ID NO: 7519)

C5-4103 Target:
5'-TACAGGATTTGGCAGTGGCTTGGCTAC-3' (SEQ ID NO: 9829)

5'-AGGAUUUGGCAGUGGCUUGGCUAca-3' (SEQ ID NO: 5210)

3'-UGUCCUAAACCGUCACCGAACCGAUGU-5' (SEQ ID NO: 7520)

C5-4104 Target:
5'-ACAGGATTTGGCAGTGGCTTGGCTACA-3' (SEQ ID NO: 9830)

5'-GAUUUGGCAGUGGCUUGGCUACAgt-3' (SEQ ID NO: 5211)

3'-UCCUAAACCGUCACCGAACCGAUGUCA-5' (SEQ ID NO: 7521)

C5-4106 Target:
5'-AGGATTTGGCAGTGGCTTGGCTACAGT-3' (SEQ ID NO: 9831)

5'-AUUUGGCAGUGGCUUGGCUACAGta-3' (SEQ ID NO: 5212)

3'-CCUAAACCGUCACCGAACCGAUGUCAU-5' (SEQ ID NO: 7522)

C5-4107 Target:
5'-GGATTTGGCAGTGGCTTGGCTACAGTA-3' (SEQ ID NO: 9832)

5'-UUUGGCAGUGGCUUGGCUACAGUac-3' (SEQ ID NO: 5213)

3'-CUAAACCGUCACCGAACCGAUGUCAUG-5' (SEQ ID NO: 7523)

C5-4108 Target:
5'-GATTTGGCAGTGGCTTGGCTACAGTAC-3' (SEQ ID NO: 9833)

5'-UUGGCAGUGGCUUGGCUACAGUAca-3' (SEQ ID NO: 5214)

3'-UAAACCGUCACCGAACCGAUGUCAUGU-5' (SEQ ID NO: 7524)

C5-4109 Target:
5'-ATTTGGCAGTGGCTTGGCTACAGTACA-3' (SEQ ID NO: 9834)

5'-GUACAUGUAACAACUGUAGUUCAca-3' (SEQ ID NO: 5215)

3'-GUCAUGUACAUUGUUGACAUCAAGUGU-5' (SEQ ID NO: 7525)

C5-4129 Target:
5'-CAGTACATGTAACAACTGTAGTTCACA-3' (SEQ ID NO: 9835)

5'-UACAUGUAACAACUGUAGUUCACaa-3' (SEQ ID NO: 5216)

3'-UCAUGUACAUUGUUGACAUCAAGUGUU-5' (SEQ ID NO: 7526)

C5-4130 Target:
5'-AGTACATGTAACAACTGTAGTTCACAA-3' (SEQ ID NO: 9836)

5'-ACAUGUAACAACUGUAGUUCACAaa-3' (SEQ ID NO: 5217)

3'-CAUGUACAUUGUUGACAUCAAGUGUU-5' (SEQ ID NO: 7527)

TABLE 7-continued

Human Anti-C5 DsiRNAs Predicted to have >50% Knockdown Efficacy (Asymmetrics)

C5-4131 Target:
5'-GTACATGTAACAACTGTAGTTCACAAA-3' (SEQ ID NO: 9837)

5'-AUGUAACAACUGUAGUUCACAAAac-3' (SEQ ID NO: 5218)

3'-UGUACAUUGUUGACAUCAAGUGUUUUG-5' (SEQ ID NO: 7528)

C5-4133 Target:
5'-ACATGTAACAACTGTAGTTCACAAAAC-3' (SEQ ID NO: 9838)

5'-UGUAACAACUGUAGUUCACAAAAcc-3' (SEQ ID NO: 5219)

3'-GUACAUUGUUGACAUCAAGUGUUUUGG-5' (SEQ ID NO: 7529)

C5-4134 Target:
5'-CATGTAACAACTGTAGTTCACAAAACC-3' (SEQ ID NO: 9839)

5'-GUAACAACUGUAGUUCACAAAACca-3' (SEQ ID NO: 5220)

3'-UACAUUGUUGACAUCAAGUGUUUUGGU-5' (SEQ ID NO: 7530)

C5-4135 Target:
5'-ATGTAACAACTGTAGTTCACAAAACCA-3' (SEQ ID NO: 9840)

5'-UAACAACUGUAGUUCACAAAACCag-3' (SEQ ID NO: 5221)

3'-ACAUUGUUGACAUCAAGUGUUUUGGUC-5' (SEQ ID NO: 7531)

C5-4136 Target:
5'-TGTAACAACTGTAGTTCACAAAACCAG-3' (SEQ ID NO: 9841)

5'-AACAACUGUAGUUCACAAAACCAgt-3' (SEQ ID NO: 5222)

3'-CAUUGUUGACAUCAAGUGUUUUGGUCA-5' (SEQ ID NO: 7532)

C5-4137 Target:
5'-GTAACAACTGTAGTTCACAAAACCAGT-3' (SEQ ID NO: 9842)

5'-ACAACUGUAGUUCACAAAACCAGta-3' (SEQ ID NO: 5223)

3'-AUUGUUGACAUCAAGUGUUUUGGUCAU-5' (SEQ ID NO: 7533)

C5-4138 Target:
5'-TAACAACTGTAGTTCACAAAACCAGTA-3' (SEQ ID NO: 9843)

5'-CAACUGUAGUUCACAAAACCAGUac-3' (SEQ ID NO: 5224)

3'-UUGUUGACAUCAAGUGUUUUGGUCAUG-5' (SEQ ID NO: 7534)

C5-4139 Target:
5'-AACAACTGTAGTTCACAAAACCAGTAC-3' (SEQ ID NO: 9844)

5'-AACUGUAGUUCACAAAACCAGUAcc-3' (SEQ ID NO: 5225)

3'-UGUUGACAUCAAGUGUUUUGGUCAUGG-5' (SEQ ID NO: 7535)

C5-4140 Target:
5'-ACAACTGTAGTTCACAAAACCAGTACC-3' (SEQ ID NO: 9845)

5'-ACUGUAGUUCACAAAACCAGUACct-3' (SEQ ID NO: 5226)

3'-GUUGACAUCAAGUGUUUUGGUCAUGGA-5' (SEQ ID NO: 7536)

C5-4141 Target:
5'-CAACTGTAGTTCACAAAACCAGTACCT-3' (SEQ ID NO: 9846)

5'-CUGUAGUUCACAAAACCAGUACCtc-3' (SEQ ID NO: 5227)

3'-UUGACAUCAAGUGUUUUGGUCAUGGAG-5' (SEQ ID NO: 7537)

C5-4142 Target:
5'-AACTGTAGTTCACAAAACCAGTACCTC-3' (SEQ ID NO: 9847)

5'-UGUAGUUCACAAAACCAGUACCUct-3' (SEQ ID NO: 5228)

3'-UGACAUCAAGUGUUUUGGUCAUGGAGA-5' (SEQ ID NO: 7538)

C5-4143 Target:
5'-ACTGTAGTTCACAAAACCAGTACCTCT-3' (SEQ ID NO: 9848)

5'-GUAGUUCACAAAACCAGUACCUCtg-3' (SEQ ID NO: 5229)

3'-GACAUCAAGUGUUUUGGUCAUGGAGAC-5' (SEQ ID NO: 7539)

C5-4144 Target:
5'-CTGTAGTTCACAAAACCAGTACCTCTG-3' (SEQ ID NO: 9849)

5'-UAGUUCACAAAACCAGUACCUCUga-3' (SEQ ID NO: 5230)

3'-ACAUCAAGUGUUUUGGUCAUGGAGACU-5' (SEQ ID NO: 7540)

C5-4145 Target:
5'-TGTAGTTCACAAAACCAGTACCTCTGA-3' (SEQ ID NO: 9850)

5'-AGUUCACAAAACCAGUACCUCUGag-3' (SEQ ID NO: 5231)

3'-CAUCAAGUGUUUUGGUCAUGGAGACUC-5' (SEQ ID NO: 7541)

C5-4146 Target:
5'-GTAGTTCACAAAACCAGTACCTCTGAG-3' (SEQ ID NO: 9851)

5'-GUUCACAAAACCAGUACCUCUGAgg-3' (SEQ ID NO: 5232)

3'-AUCAAGUGUUUUGGUCAUGGAGACUCC-5' (SEQ ID NO: 7542)

C5-4147 Target:
5'-TAGTTCACAAAACCAGTACCTCTGAGG-3' (SEQ ID NO: 9852)

5'-UUCACAAAACCAGUACCUCUGAGga-3' (SEQ ID NO: 5233)

3'-UCAAGUGUUUUGGUCAUGGAGACUCCU-5' (SEQ ID NO: 7543)

C5-4148 Target:
5'-AGTTCACAAAACCAGTACCTCTGAGGA-3' (SEQ ID NO: 9853)

5'-UCACAAAACCAGUACCUCUGAGGaa-3' (SEQ ID NO: 5234)

3'-CAAGUGUUUUGGUCAUGGAGACUCCUU-5' (SEQ ID NO: 7544)

C5-4149 Target:
5'-GTTCACAAAACCAGTACCTCTGAGGAA-3' (SEQ ID NO: 9854)

5'-CACAAAACCAGUACCUCUGAGGAag-3' (SEQ ID NO: 5235)

3'-AAGUGUUUUGGUCAUGGAGACUCCUUC-5' (SEQ ID NO: 7545)

C5-4150 Target:
5'-TTCACAAAACCAGTACCTCTGAGGAAG-3' (SEQ ID NO: 9855)

5'-ACAAAACCAGUACCUCUGAGGAAgt-3' (SEQ ID NO: 5236)

3'-AGUGUUUUGGUCAUGGAGACUCCUUCA-5' (SEQ ID NO: 7546)

C5-4151 Target:
5'-TCACAAAACCAGTACCTCTGAGGAAGT-3' (SEQ ID NO: 9856)

5'-CAAAACCAGUACCUCUGAGGAAGtt-3' (SEQ ID NO: 5237)

3'-GUGUUUUGGUCAUGGAGACUCCUUCAA-5' (SEQ ID NO: 7547)

C5-4152 Target:
5'-CACAAAACCAGTACCTCTGAGGAAGTT-3' (SEQ ID NO: 9857)

5'-AAAACCAGUACCUCUGAGGAAGUtt-3' (SEQ ID NO: 5238)

3'-UGUUUUGGUCAUGGAGACUCCUUCAAA-5' (SEQ ID NO: 7548)

C5-4153 Target:
5'-ACAAAACCAGTACCTCTGAGGAAGTTT-3' (SEQ ID NO: 9858)

5'-AAACCAGUACCUCUGAGGAAGUUtg-3' (SEQ ID NO: 5239)

3'-GUUUUGGUCAUGGAGACUCCUUCAAAC-5' (SEQ ID NO: 7549)

TABLE 7-continued

Human Anti-C5 DsiRNAs Predicted to have >50% Knockdown Efficacy (Asymmetrics)

C5-4154 Target:
5'-CAAAACCAGTACCTCTGAGGAAGTTTG-3' (SEQ ID NO: 9859)

5'-A<u>CC</u>AGUACCUCUG<u>A</u>GGAAGUUUGc-3' (SEQ ID NO: 5240)

3'-<u>UUU</u>G<u>G</u>UCAUGGAGA<u>C</u>U<u>CC</u>UUCA<u>A</u>ACG-5' (SEQ ID NO: 7550)

C5-4155 Target:
5'-AAAACCAGTACCTCTGAGGAAGTTTGC-3' (SEQ ID NO: 9860)

5'-A<u>CC</u>AGUACCUCUGA<u>G</u>GAAGUUUGca-3' (SEQ ID NO: 5241)

3'-<u>UUU</u>GGUCAUGGAGA<u>CU</u>CCUUCAA<u>ACGU</u>-5' (SEQ ID NO: 7551)

C5-4156 Target:
5'-AAACCAGTACCTCTGAGGAAGTTTGCA-3' (SEQ ID NO: 9861)

5'-C<u>CA</u>GUACCUCUGAGG<u>A</u>AGUUUGCag-3' (SEQ ID NO: 5242)

3'-<u>UUG</u>GUCAUGGAGACU<u>CC</u>UUCAAACGUC-5' (SEQ ID NO: 7552)

C5-4157 Target:
5'-AACCAGTACCTCTGAGGAAGTTTGCAG-3' (SEQ ID NO: 9862)

5'-C<u>AG</u>UACCUCUGAGG<u>AA</u>GUUUGCAgc-3' (SEQ ID NO: 5243)

3'-<u>UGG</u>U<u>C</u>AUGGAGACU<u>CC</u>UUCAAACGUCG-5' (SEQ ID NO: 7553)

C5-4158 Target:
5'-ACCAGTACCTCTGAGGAAGTTTGCAGC-3' (SEQ ID NO: 9863)

5'-A<u>GU</u>ACCUCUGAGGA<u>A</u>GUUUGCAgct-3' (SEQ ID NO: 5244)

3'-<u>GGU</u>C<u>A</u>UGGAGACUCC<u>UU</u>CAAACGUCGA-5' (SEQ ID NO: 7554)

C5-4159 Target:
5'-CCAGTACCTCTGAGGAAGTTTGCAGCT-3' (SEQ ID NO: 9864)

5'-<u>GU</u>A<u>C</u>CUCUGAGGAA<u>G</u>UUUGCAGCtt-3' (SEQ ID NO: 5245)

3'-<u>GUC</u>AUGGAGACUCC<u>UU</u>CAAACGUCGAA-5' (SEQ ID NO: 7555)

C5-4160 Target:
5'-CAGTACCTCTGAGGAAGTTTGCAGCTT-3' (SEQ ID NO: 9865)

5'-U<u>AC</u>CUCUGAGGAAG<u>U</u>UUGCAGCUtt-3' (SEQ ID NO: 5246)

3'-<u>UCA</u>UGGAGACUCCUU<u>C</u>AAACGUCGAAA-5' (SEQ ID NO: 7556)

C5-4161 Target:
5'-AGTACCTCTGAGGAAGTTTGCAGCTTT-3' (SEQ ID NO: 9866)

5'-A<u>CC</u>UCUGAGGAAG<u>UUU</u>GCAGCUUtt-3' (SEQ ID NO: 5247)

3'-<u>CAU</u>G<u>G</u>AGACUCCUU<u>C</u>AAACGUCG<u>AAAA</u>-5' (SEQ ID NO: 7557)

C5-4162 Target:
5'-GTACCTCTGAGGAAGTTTGCAGCTTTT-3' (SEQ ID NO: 9867)

5'-C<u>CU</u>CUGAGGAAGU<u>UU</u>GCAGCUUUta-3' (SEQ ID NO: 5248)

3'-<u>AUG</u>GAGACUCCUUC<u>AA</u>ACGUCGA<u>AAAU</u>-5' (SEQ ID NO: 7558)

C5-4163 Target:
5'-TACCTCTGAGGAAGTTTGCAGCTTTTA-3' (SEQ ID NO: 9868)

5'-C<u>UC</u>UGAGGAAGUUUG<u>C</u>AGCUUUUat-3' (SEQ ID NO: 5249)

3'-<u>UGG</u>AGACUCCUUC<u>AA</u>CGUCGAA<u>AAUA</u>-5' (SEQ ID NO: 7559)

C5-4164 Target:
5'-ACCTCTGAGGAAGTTTGCAGCTTTTAT-3' (SEQ ID NO: 9869)

5'-U<u>CU</u>GAGGAAGUUUGC<u>AG</u>CUUUUAtt-3' (SEQ ID NO: 5250)

3'-<u>GGAGA</u>CUCCUUCAA<u>AC</u>GUCGAAA<u>AUAA</u>-5' (SEQ ID NO: 7560)

C5-4165 Target:
5'-CCTCTGAGGAAGTTTGCAGCTTTTATT-3' (SEQ ID NO: 9870)

5'-C<u>UG</u>AGGAAGUUUG<u>CAG</u>CUUUUAUtt-3' (SEQ ID NO: 5251)

3'-<u>GAGA</u>CUCCUUCAAA<u>C</u>GUCGAAAA<u>UAAA</u>-5' (SEQ ID NO: 7561)

C5-4166 Target:
5'-CTCTGAGGAAGTTTGCAGCTTTTATTT-3' (SEQ ID NO: 9871)

5'-U<u>G</u>AGGAAGUUUGC<u>AG</u>CUUUUAUtg-3' (SEQ ID NO: 5252)

3'-<u>AGA</u>CUCCUUCAAACGUCGAAAAU<u>AAAC</u>-5' (SEQ ID NO: 7562)

C5-4167 Target:
5'-TCTGAGGAAGTTTGCAGCTTTTATTTG-3' (SEQ ID NO: 9872)

5'-U<u>UGC</u>AGCUUUUAUU<u>UG</u>AAAAUCGat-3' (SEQ ID NO: 5253)

3'-<u>CAAA</u>CGUCGAAAAUA<u>AA</u>CUUUUA<u>GCUA</u>-5' (SEQ ID NO: 7563)

C5-4176 Target:
5'-GTTTGCAGCTTTTATTTGAAAATCGAT-3' (SEQ ID NO: 9873)

5'-U<u>GCAG</u>CUUUUAUUU<u>G</u>AAAAUCGata-3' (SEQ ID NO: 5254)

3'-<u>AAAC</u>GUCGAAAAUAAA<u>C</u>UUUUAGCUAU-5' (SEQ ID NO: 7564)

C5-4177 Target:
5'-TTTGCAGCTTTTATTTGAAAATCGATA-3' (SEQ ID NO: 9874)

5'-GAU<u>A</u>CUCAGGAUA<u>UU</u>GAAGCAUCcc-3' (SEQ ID NO: 5255)

3'-<u>AGCUA</u>UGAGUCCUAU<u>AA</u>CUUCGU<u>AGGG</u>-5' (SEQ ID NO: 7565)

C5-4198 Target:
5'-TCGATACTCAGGATATTGAAGCATCCC-3' (SEQ ID NO: 9875)

5'-<u>UAC</u>UCAGGAUAUUG<u>A</u>AGCAUCCCac-3' (SEQ ID NO: 5256)

3'-<u>CUAU</u>GAGUCCUAU<u>AA</u>CUUCGUAGGGUG-5' (SEQ ID NO: 7566)

C5-4200 Target:
5'-GATACTCAGGATATTGAAGCATCCCAC-3' (SEQ ID NO: 9876)

5'-A<u>CU</u>CAGGAUAUUG<u>A</u>AGCAUCCCAct-3' (SEQ ID NO: 5257)

3'-<u>UAUG</u>AGUCCUAUAA<u>CU</u>UCGUAGG<u>GUGA</u>-5' (SEQ ID NO: 7567)

C5-4201 Target:
5'-ATACTCAGGATATTGAAGCATCCCACT-3' (SEQ ID NO: 9877)

5'-C<u>UC</u>AGGAUAUUG<u>AA</u>GCAUCCCACta-3' (SEQ ID NO: 5258)

3'-<u>AUGA</u>GUCCUAUAAC<u>UU</u>CGUAGGGUGAU-5' (SEQ ID NO: 7568)

C5-4202 Target:
5'-TACTCAGGATATTGAAGCATCCCACTA-3' (SEQ ID NO: 9878)

5'-U<u>CA</u>GGAUAUUGAAGC<u>A</u>UCCCACUac-3' (SEQ ID NO: 5259)

3'-<u>UGAG</u>UCCUAUAACUU<u>C</u>GUAGGGUGAUG-5' (SEQ ID NO: 7569)

C5-4203 Target:
5'-ACTCAGGATATTGAAGCATCCCACTAC-3' (SEQ ID NO: 9879)

5'-A<u>GG</u>AUAUUGAAGC<u>AU</u>CCCACUACag-3' (SEQ ID NO: 5260)

3'-<u>AGU</u>CCUAUAACUUCGUAGGGUGA<u>UGUC</u>-5' (SEQ ID NO: 7570)

C5-4205 Target:
5'-TCAGGATATTGAAGCATCCCACTACAG-3' (SEQ ID NO: 9880)

5'-GG<u>A</u>UAUUGAAGCAU<u>CC</u>CACUACAga-3' (SEQ ID NO: 5261)

3'-<u>GUC</u>CUAUAACUUCGUAGGGUGAU<u>GUCU</u>-5' (SEQ ID NO: 7571)

TABLE 7-continued

Human Anti-C5 DsiRNAs Predicted to have >50% Knockdown Efficacy (Asymmetrics)

C5-4206 Target:
5'-CAGGATATTGAAGCATCCCACTACAGA-3' (SEQ ID NO: 9881)

5'-GAUAUUGAAGCAUCCCACUACAGAg-3' (SEQ ID NO: 5262)

3'-UCCUAUAACUUCGUAGGGUGAUGUCUC-5' (SEQ ID NO: 7572)

C5-4207 Target:
5'-AGGATATTGAAGCATCCCACTACAGAG-3' (SEQ ID NO: 9882)

5'-AUAUUGAAGCAUCCCACUACAGAgg-3' (SEQ ID NO: 5263)

3'-CCUAUAACUUCGUAGGGUGAUGUCUCC-5' (SEQ ID NO: 7573)

C5-4208 Target:
5'-GGATATTGAAGCATCCCACTACAGAGG-3' (SEQ ID NO: 9883)

5'-UAUUGAAGCAUCCCACUACAGAGgc-3' (SEQ ID NO: 5264)

3'-CUAUAACUUCGUAGGGUGAUGUCUCCG-5' (SEQ ID NO: 7574)

C5-4209 Target:
5'-GATATTGAAGCATCCCACTACAGAGGC-3' (SEQ ID NO: 9884)

5'-AUUGAAGCAUCCCACUACAGAGGct-3' (SEQ ID NO: 5265)

3'-UAUAACUUCGUAGGGUGAUGUCUCCGA-5' (SEQ ID NO: 7575)

C5-4210 Target:
5'-ATATTGAAGCATCCCACTACAGAGGCT-3' (SEQ ID NO: 9885)

5'-UUGAAGCAUCCCACUACAGAGGCta-3' (SEQ ID NO: 5266)

3'-AUAACUUCGUAGGGUGAUGUCUCCGAU-5' (SEQ ID NO: 7576)

C5-4211 Target:
5'-TATTGAAGCATCCCACTACAGAGGCTA-3' (SEQ ID NO: 9886)

5'-UGAAGCAUCCCACUACAGAGGCUac-3' (SEQ ID NO: 5267)

3'-UAACUUCGUAGGGUGAUGUCUCCGAUG-5' (SEQ ID NO: 7577)

C5-4212 Target:
5'-ATTGAAGCATCCCACTACAGAGGCTAC-3' (SEQ ID NO: 9887)

5'-GAAGCAUCCCACUACAGAGGCUAcg-3' (SEQ ID NO: 5268)

3'-AACUUCGUAGGGUGAUGUCUCCGAUGC-5' (SEQ ID NO: 7578)

C5-4213 Target:
5'-TTGAAGCATCCCACTACAGAGGCTACG-3' (SEQ ID NO: 9888)

5'-AAGCAUCCCACUACAGAGGCUACgg-3' (SEQ ID NO: 5269)

3'-ACUUCGUAGGGUGAUGUCUCCGAUGCC-5' (SEQ ID NO: 7579)

C5-4214 Target:
5'-TGAAGCATCCCACTACAGAGGCTACGG-3' (SEQ ID NO: 9889)

5'-AGCAUCCCACUACAGAGGCUACGga-3' (SEQ ID NO: 5270)

3'-CUUCGUAGGGUGAUGUCUCCGAUGCCU-5' (SEQ ID NO: 7580)

C5-4215 Target:
5'-GAAGCATCCCACTACAGAGGCTACGGA-3' (SEQ ID NO: 9890)

5'-GCAUCCCACUACAGAGGCUACGGaa-3' (SEQ ID NO: 5271)

3'-UUCGUAGGGUGAUGUCUCCGAUGCCUU-5' (SEQ ID NO: 7581)

C5-4216 Target:
5'-AAGCATCCCACTACAGAGGCTACGGAA-3' (SEQ ID NO: 9891)

5'-CAUCCCACUACAGAGGCUACGGAaa-3' (SEQ ID NO: 5272)

3'-UCGUAGGGUGAUGUCUCCGAUGCCUUU-5' (SEQ ID NO: 7582)

C5-4217 Target:
5'-AGCATCCCACTACAGAGGCTACGGAAA-3' (SEQ ID NO: 9892)

5'-AUCCCACUACAGAGGCUACGGAAac-3' (SEQ ID NO: 5273)

3'-CGUAGGGUGAUGUCUCCGAUGCCUUUG-5' (SEQ ID NO: 7583)

C5-4218 Target:
5'-GCATCCCACTACAGAGGCTACGGAAAC-3' (SEQ ID NO: 9893)

5'-UCCCACUACAGAGGCUACGGAAACt-3' (SEQ ID NO: 5274)

3'-GUAGGGUGAUGUCUCCGAUGCCUUUGA-5' (SEQ ID NO: 7584)

C5-4219 Target:
5'-CATCCCACTACAGAGGCTACGGAAACT-3' (SEQ ID NO: 9894)

5'-CCCACUACAGAGGCUACGGAAACtc-3' (SEQ ID NO: 5275)

3'-UAGGGUGAUGUCUCCGAUGCCUUUGAG-5' (SEQ ID NO: 7585)

C5-4220 Target:
5'-ATCCCACTACAGAGGCTACGGAAACTC-3' (SEQ ID NO: 9895)

5'-CCACUACAGAGGCUACGGAAACUct-3' (SEQ ID NO: 5276)

3'-AGGGUGAUGUCUCCGAUGCCUUUGAGA-5' (SEQ ID NO: 7586)

C5-4221 Target:
5'-TCCCACTACAGAGGCTACGGAAACTCT-3' (SEQ ID NO: 9896)

5'-CACUACAGAGGCUACGGAAACUCtg-3' (SEQ ID NO: 5277)

3'-GGGUGAUGUCUCCGAUGCCUUUGAGAC-5' (SEQ ID NO: 7587)

C5-4222 Target:
5'-CCCACTACAGAGGCTACGGAAACTCTG-3' (SEQ ID NO: 9897)

5'-ACUACAGAGGCUACGGAAACUCUga-3' (SEQ ID NO: 5278)

3'-GGUGAUGUCUCCGAUGCCUUUGAGACU-5' (SEQ ID NO: 7588)

C5-4223 Target:
5'-CCACTACAGAGGCTACGGAAACTCTGA-3' (SEQ ID NO: 9898)

5'-CUACAGAGGCUACGGAAACUCUGat-3' (SEQ ID NO: 5279)

3'-GUGAUGUCUCCGAUGCCUUUGAGACUA-5' (SEQ ID NO: 7589)

C5-4224 Target:
5'-CACTACAGAGGCTACGGAAACTCTGAT-3' (SEQ ID NO: 9899)

5'-UACAGAGGCUACGGAAACUCUGAtt-3' (SEQ ID NO: 5280)

3'-UGAUGUCUCCGAUGCCUUUGAGACUAA-5' (SEQ ID NO: 7590)

C5-4225 Target:
5'-ACTACAGAGGCTACGGAAACTCTGATT-3' (SEQ ID NO: 9900)

5'-ACAGAGGCUACGGAAACUCUGAUta-3' (SEQ ID NO: 5281)

3'-GAUGUCUCCGAUGCCUUUGAGACUAAU-5' (SEQ ID NO: 7591)

C5-4226 Target:
5'-CTACAGAGGCTACGGAAACTCTGATTA-3' (SEQ ID NO: 9901)

5'-CAGAGGCUACGGAAACUCUGAUUac-3' (SEQ ID NO: 5282)

3'-AUGUCUCCGAUGCCUUUGAGACUAAUG-5' (SEQ ID NO: 7592)

C5-4227 Target:
5'-TACAGAGGCTACGGAAACTCTGATTAC-3' (SEQ ID NO: 9902)

5'-AGAGGCUACGGAAACUCUGAUUAca-3' (SEQ ID NO: 5283)

3'-UGUCUCCGAUGCCUUUGAGACUAAUGU-5' (SEQ ID NO: 7593)

TABLE 7-continued

Human Anti-C5 DsiRNAs Predicted to have >50% Knockdown Efficacy (Asymmetrics)

C5-4228 Target:
5'-ACAGAGGCTACGGAAACTCTGATTACA-3' (SEQ ID NO: 9903)

5'-G<u>AGG</u>CUACGGAAAC<u>UC</u>UGAUUACAaa-3' (SEQ ID NO: 5284)

3'-<u>GUCUC</u>CGAUGCCUUU<u>GA</u>GACUAA<u>UGUU</u>-5' (SEQ ID NO: 7594)

C5-4229 Target:
5'-CAGAGGCTACGGAAACTCTGATTACAA-3' (SEQ ID NO: 9904)

5'-A<u>GG</u>CUACGGAAAC<u>UC</u>UGAUUACAaa-3' (SEQ ID NO: 5285)

3'-<u>UCUCC</u>GAUGCCUUU<u>GA</u>GACUAA<u>UGUU</u>-5' (SEQ ID NO: 7595)

C5-4230 Target:
5'-AGAGGCTACGGAAACTCTGATTACAAA-3' (SEQ ID NO: 9905)

5'-G<u>GC</u>UACGGAAACUC<u>U</u>GAUUACAaac-3' (SEQ ID NO: 5286)

3'-<u>CUCC</u>GAUGCCUUU<u>GA</u>GACUAA<u>UGUUUG</u>-5' (SEQ ID NO: 7596)

C5-4231 Target:
5'-GAGGCTACGGAAACTCTGATTACAAAC-3' (SEQ ID NO: 9906)

5'-G<u>CU</u>ACGGAAACUCUG<u>A</u>UUACAAAcg-3' (SEQ ID NO: 5287)

3'-<u>UCCG</u>AUGCCUUU<u>GA</u>GACUAA<u>UGUUUGC</u>-5' (SEQ ID NO: 7597)

C5-4232 Target:
5'-AGGCTACGGAAACTCTGATTACAAACG-3' (SEQ ID NO: 9907)

5'-C<u>UA</u>CGGAAACUCUG<u>A</u>UUACAAACgc-3' (SEQ ID NO: 5288)

3'-<u>CCGA</u>UGCCUUUGAG<u>AC</u>UAAUGUUUGCG-5' (SEQ ID NO: 7598)

C5-4233 Target:
5'-GGCTACGGAAACTCTGATTACAAACGC-3' (SEQ ID NO: 9908)

5'-<u>UA</u>CGGAAACUCUGA<u>U</u>UACAAACGca-3' (SEQ ID NO: 5289)

3'-<u>CGAU</u>GCCUUUGAG<u>AC</u>UAAUGUUUGCGU-5' (SEQ ID NO: 7599)

C5-4234 Target:
5'-GCTACGGAAACTCTGATTACAAACGCA-3' (SEQ ID NO: 9909)

5'-<u>A</u>CGGAAACUCUGAU<u>U</u>ACAAACGCat-3' (SEQ ID NO: 5290)

3'-<u>GAUG</u>CCUUUGAGACU<u>AA</u>UGUUUGCGUA-5' (SEQ ID NO: 7600)

C5-4235 Target:
5'-CTACGGAAACTCTGATTACAAACGCAT-3' (SEQ ID NO: 9910)

5'-C<u>GG</u>AAACUCUGAUU<u>A</u>CAAACGCAta-3' (SEQ ID NO: 5291)

3'-<u>AUGC</u>CUUUGAGACU<u>AA</u>UGUUUGCGUAU-5' (SEQ ID NO: 7601)

C5-4236 Target:
5'-TACGGAAACTCTGATTACAAACGCATA-3' (SEQ ID NO: 9911)

5'-G<u>GA</u>AACUCUGAUUA<u>C</u>AAACGCAUag-3' (SEQ ID NO: 5292)

3'-<u>UGCC</u>UUUGAGACUA<u>AU</u>GUUUGCGUAUC-5' (SEQ ID NO: 7602)

C5-4237 Target:
5'-ACGGAAACTCTGATTACAAACGCATAG-3' (SEQ ID NO: 9912)

5'-G<u>AAA</u>CUCUGAUUAC<u>AAA</u>CGCAUAgt-3' (SEQ ID NO: 5293)

3'-<u>GCC</u>UUUGAGACUAA<u>U</u>GUUUGCGUAUCA-5' (SEQ ID NO: 7603)

C5-4238 Target:
5'-CGGAAACTCTGATTACAAACGCATAGT-3' (SEQ ID NO: 9913)

5'-A<u>AA</u>CUCUGAUUACA<u>AA</u>CGCAUAGta-3' (SEQ ID NO: 5294)

3'-<u>CCU</u>UUGAGACUAAU<u>GU</u>UUGCGUAU<u>CAU</u>-5' (SEQ ID NO: 7604)

TABLE 7-continued

Human Anti-C5 DsiRNAs Predicted to have >50% Knockdown Efficacy (Asymmetrics)

C5-4239 Target:
5'-GGAAACTCTGATTACAAACGCATAGTA-3' (SEQ ID NO: 9914)

5'-<u>AA</u>CUCUGAUUACA<u>AA</u>CGCAUAGUag-3' (SEQ ID NO: 5295)

3'-<u>CUU</u>UGAGACUAAUG<u>UU</u>UGCGUAU<u>CAUC</u>-5' (SEQ ID NO: 7605)

C5-4240 Target:
5'-GAAACTCTGATTACAAACGCATAGTAG-3' (SEQ ID NO: 9915)

5'-A<u>CU</u>CUGAUUACAAA<u>C</u>GCAUAGUAgc-3' (SEQ ID NO: 5296)

3'-<u>UUU</u>GAGACUAAUGU<u>UU</u>GCGUAU<u>CAUCG</u>-5' (SEQ ID NO: 7606)

C5-4241 Target:
5'-AAACTCTGATTACAAACGCATAGTAGC-3' (SEQ ID NO: 9916)

5'-C<u>UC</u>UGAUUACAAA<u>CG</u>CAUAGUAGca-3' (SEQ ID NO: 5297)

3'-<u>UUG</u>AGACUAAUGUU<u>U</u>GCGUAU<u>CAUCGU</u>-5' (SEQ ID NO: 7607)

C5-4242 Target:
5'-AACTCTGATTACAAACGCATAGTAGCA-3' (SEQ ID NO: 9917)

5'-<u>UCU</u>GAUUACAAACG<u>CA</u>UAGUAGCat-3' (SEQ ID NO: 5298)

3'-<u>UGA</u>GACUAAUGUUU<u>GC</u>GUAU<u>CAUCGUA</u>-5' (SEQ ID NO: 7608)

C5-4243 Target:
5'-ACTCTGATTACAAACGCATAGTAGCAT-3' (SEQ ID NO: 9918)

5'-<u>CUG</u>AUUACAAACGC<u>AU</u>AGUAGCAtg-3' (SEQ ID NO: 5299)

3'-<u>GAGA</u>CUAAUGUUUGCG<u>U</u>AUCAUC<u>GUAC</u>-5' (SEQ ID NO: 7609)

C5-4244 Target:
5'-CTCTGATTACAAACGCATAGTAGCATG-3' (SEQ ID NO: 9919)

5'-<u>UGA</u>UUACAAACGC<u>AU</u>AGUAGCAUgt-3' (SEQ ID NO: 5300)

3'-<u>AGAC</u>UAAUGUUUGCG<u>U</u>AUCAUC<u>GUACA</u>-5' (SEQ ID NO: 7610)

C5-4245 Target:
5'-TCTGATTACAAACGCATAGTAGCATGT-3' (SEQ ID NO: 9920)

5'-G<u>AUU</u>ACAAACGCAU<u>A</u>GUAGCAUGtg-3' (SEQ ID NO: 5301)

3'-<u>GACU</u>AAUGUUUGCGU<u>AU</u>CAUC<u>GUACAC</u>-5' (SEQ ID NO: 7611)

C5-4246 Target:
5'-CTGATTACAAACGCATAGTAGCATGTG-3' (SEQ ID NO: 9921)

5'-<u>AUU</u>ACAAACGCAU<u>AGU</u>AGCAUGUgc-3' (SEQ ID NO: 5302)

3'-<u>ACUA</u>AUGUUUGCGU<u>AU</u>CAUCGU<u>ACACG</u>-5' (SEQ ID NO: 7612)

C5-4247 Target:
5'-TGATTACAAACGCATAGTAGCATGTGC-3' (SEQ ID NO: 9922)

5'-<u>UUA</u>CAAACGCAUA<u>GU</u>AGCAUGUGcc-3' (SEQ ID NO: 5303)

3'-<u>CUAA</u>UGUUUGCGUAU<u>C</u>AUCGUAC<u>ACGG</u>-5' (SEQ ID NO: 7613)

C5-4248 Target:
5'-GATTACAAACGCATAGTAGCATGTGCC-3' (SEQ ID NO: 9923)

5'-<u>UAC</u>AAACGCAUAG<u>UA</u>GCAUGUGCca-3' (SEQ ID NO: 5304)

3'-<u>UAAU</u>GUUUGCGUAU<u>C</u>AUCGUAC<u>ACGGU</u>-5' (SEQ ID NO: 7614)

C5-4249 Target:
5'-ATTACAAACGCATAGTAGCATGTGCCA-3' (SEQ ID NO: 9924)

5'-<u>AC</u>AAACGCAUAGU<u>A</u>GCAUGUGCCag-3' (SEQ ID NO: 5305)

3'-<u>AAUG</u>UUUGCGUAUC<u>AU</u>CGUACAC<u>GGUC</u>-5' (SEQ ID NO: 7615)

TABLE 7-continued

Human Anti-C5 DsiRNAs Predicted to have >50% Knockdown Efficacy (Asymmetrics)

C5-4250 Target:
5'-TTACAAACGCATAGTAGCATGTGCCAG-3' (SEQ ID NO: 9925)

5'-C<u>AAA</u>CGC<u>A</u>U<u>A</u>GU<u>A</u>G<u>C</u>A<u>U</u>GUGCCAgc-3' (SEQ ID NO: 5306)

3'-<u>A</u>UGUUUGCGU<u>A</u>UC<u>A</u>UC<u>G</u>U<u>A</u>CACGGU<u>CG</u>-5' (SEQ ID NO: 7616)

C5-4251 Target:
5'-TACAAACGCATAGTAGCATGTGCCAGC-3' (SEQ ID NO: 9926)

5'-A<u>AA</u>CGC<u>A</u>U<u>A</u>GUAG<u>C</u>A<u>U</u>GUGCC<u>A</u>Gct-3' (SEQ ID NO: 5307)

3'-<u>U</u>GUUUGCGU<u>A</u>UC<u>A</u>UC<u>G</u>U<u>A</u>CACGGUCG<u>A</u>-5' (SEQ ID NO: 7617)

C5-4252 Target:
5'-ACAAACGCATAGTAGCATGTGCCAGCT-3' (SEQ ID NO: 9927)

5'-A<u>AC</u>GC<u>A</u>U<u>A</u>GU<u>A</u>GC<u>A</u>U<u>G</u>UGCCAGCta-3' (SEQ ID NO: 5308)

3'-<u>G</u>UUUGCGU<u>A</u>UC<u>A</u>UC<u>G</u>U<u>A</u>CACGGUCG<u>A</u>U-5' (SEQ ID NO: 7618)

C5-4253 Target:
5'-CAAACGCATAGTAGCATGTGCCAGCTA-3' (SEQ ID NO: 9928)

5'-A<u>CG</u>C<u>A</u>U<u>A</u>GU<u>A</u>GC<u>A</u>U<u>G</u>UGCCAGCU<u>A</u>c-3' (SEQ ID NO: 5309)

3'-<u>U</u>UUGCGU<u>A</u>UC<u>A</u>UCGU<u>A</u>CACGGUCG<u>A</u>UG-5' (SEQ ID NO: 7619)

C5-4254 Target:
5'-AAACGCATAGTAGCATGTGCCAGCTAC-3' (SEQ ID NO: 9929)

5'-C<u>GC</u>AU<u>A</u>GUAGC<u>A</u>U<u>G</u>UGCC<u>A</u>GCU<u>A</u>ca-3' (SEQ ID NO: 5310)

3'-<u>U</u>UGCGU<u>A</u>UC<u>A</u>UCGU<u>AC</u>ACGGUCG<u>A</u>UGU-5' (SEQ ID NO: 7620)

C5-4255 Target:
5'-AACGCATAGTAGCATGTGCCAGCTACA-3' (SEQ ID NO: 9930)

5'-G<u>C</u>AU<u>A</u>GU<u>A</u>GC<u>A</u>U<u>G</u>UGCCAGCU<u>A</u>Caa-3' (SEQ ID NO: 5311)

3'-<u>U</u>GCGU<u>A</u>UC<u>A</u>UCGU<u>AC</u>ACGGUCG<u>A</u>UGUU-5' (SEQ ID NO: 7621)

C5-4256 Target:
5'-ACGCATAGTAGCATGTGCCAGCTACAA-3' (SEQ ID NO: 9931)

5'-C<u>A</u>U<u>A</u>GU<u>A</u>GC<u>A</u>U<u>G</u>UGCCAGCU<u>A</u>C<u>A</u>ag-3' (SEQ ID NO: 5312)

3'-<u>G</u>CGU<u>A</u>UC<u>A</u>UCGU<u>AC</u>ACGGUCG<u>A</u>UGUUC-5' (SEQ ID NO: 7622)

C5-4257 Target:
5'-CGCATAGTAGCATGTGCCAGCTACAAG-3' (SEQ ID NO: 9932)

5'-A<u>U</u>A<u>G</u>U<u>A</u>GC<u>A</u>UGUGCC<u>A</u>GCU<u>A</u>C<u>A</u>AGc-3' (SEQ ID NO: 5313)

3'-<u>C</u>GU<u>A</u>UC<u>A</u>UCGU<u>AC</u>ACGGUCG<u>A</u>UGUUCG-5' (SEQ ID NO: 7623)

C5-4258 Target:
5'-GCATAGTAGCATGTGCCAGCTACAAGC-3' (SEQ ID NO: 9933)

5'-U<u>A</u>GU<u>A</u>GC<u>A</u>UGUGCC<u>A</u>GCU<u>A</u>C<u>A</u>AGcc-3' (SEQ ID NO: 5314)

3'-<u>G</u>U<u>A</u>UC<u>A</u>UCGU<u>A</u>C<u>A</u>CGGUCG<u>A</u>UGUU<u>C</u>GG-5' (SEQ ID NO: 7624)

C5-4259 Target:
5'-CATAGTAGCATGTGCCAGCTACAAGCC-3' (SEQ ID NO: 9934)

5'-A<u>G</u>U<u>A</u>GC<u>A</u>UGUGCC<u>A</u>GCU<u>A</u>C<u>A</u>AGCcc-3' (SEQ ID NO: 5315)

3'-<u>U</u>A<u>U</u>C<u>A</u>UCGU<u>A</u>C<u>A</u>CGGUCG<u>A</u>UGUUCGG<u>U</u>-5' (SEQ ID NO: 7625)

C5-4260 Target:
5'-ATAGTAGCATGTGCCAGCTACAAGCCC-3' (SEQ ID NO: 9935)

5'-G<u>U</u>A<u>G</u>C<u>A</u>UGUGCC<u>A</u>GC<u>U</u>AC<u>A</u>AGCCca-3' (SEQ ID NO: 5316)

3'-<u>A</u>UC<u>A</u>UCGU<u>A</u>C<u>A</u>CGGUCG<u>A</u>UGUUCGGG<u>U</u>-5' (SEQ ID NO: 7626)

TABLE 7-continued

Human Anti-C5 DsiRNAs Predicted to have >50% Knockdown Efficacy (Asymmetrics)

C5-4261 Target:
5'-TAGTAGCATGTGCCAGCTACAAGCCCA-3' (SEQ ID NO: 9936)

5'-G<u>UG</u>A<u>U</u>GG<u>A</u>C<u>A</u>UCU<u>CC</u>UUGCCU<u>A</u>Ctg-3' (SEQ ID NO: 5317)

3'-<u>GCC</u>ACU<u>A</u>CCGU<u>A</u>G<u>AGG</u>AACGG<u>A</u>UG<u>A</u>C-5' (SEQ ID NO: 7627)

C5-4321 Target:
5'-CGGTGATGGACATCTCCTTGCCTACTG-3' (SEQ ID NO: 9937)

5'-U<u>G</u>A<u>U</u>GG<u>A</u>C<u>A</u>UCU<u>CC</u>UUGCCU<u>A</u>CUgg-3' (SEQ ID NO: 5318)

3'-<u>CC</u>ACU<u>A</u>CCUGU<u>A</u>G<u>AGGA</u>ACGG<u>A</u>UG<u>A</u>CC-5' (SEQ ID NO: 7628)

C5-4322 Target:
5'-GGTGATGGACATCTCCTTGCCTACTGG-3' (SEQ ID NO: 9938)

5'-G<u>A</u>U<u>G</u>G<u>A</u>C<u>A</u>UCUCCUU<u>G</u>CCU<u>A</u>CUGga-3' (SEQ ID NO: 5319)

3'-<u>C</u>ACU<u>A</u>CCUGU<u>A</u>G<u>AGGA</u>ACGG<u>A</u>UG<u>A</u>CCU-5' (SEQ ID NO: 7629)

C5-4323 Target:
5'-GTGATGGACATCTCCTTGCCTACTGGA-3' (SEQ ID NO: 9939)

5'-A<u>U</u>G<u>G</u>A<u>C</u>AUCUCCUU<u>GCC</u>U<u>A</u>CUGGaa-3' (SEQ ID NO: 5320)

3'-<u>A</u>CU<u>A</u>CCUGU<u>A</u>G<u>AGGA</u>ACGG<u>A</u>UG<u>A</u>CCUU-5' (SEQ ID NO: 7630)

C5-4324 Target:
5'-TGATGGACATCTCCTTGCCTACTGGAA-3' (SEQ ID NO: 9940)

5'-U<u>G</u>G<u>A</u>CAUCUCCUU<u>GCC</u>U<u>A</u>CUGG<u>A</u>at-3' (SEQ ID NO: 5321)

3'-<u>C</u>U<u>A</u>CCUGU<u>A</u>G<u>AGGA</u>ACGG<u>A</u>UG<u>A</u>CC<u>UUA</u>-5' (SEQ ID NO: 7631)

C5-4325 Target:
5'-GATGGACATCTCCTTGCCTACTGGAAT-3' (SEQ ID NO: 9941)

5'-G<u>GA</u>C<u>A</u>UCUCCUU<u>GCC</u>U<u>A</u>CUGG<u>AA</u>tc-3' (SEQ ID NO: 5322)

3'-<u>UA</u>CCUGU<u>A</u>G<u>AGGAA</u>CGG<u>A</u>UG<u>A</u>CC<u>UUAG</u>-5' (SEQ ID NO: 7632)

C5-4326 Target:
5'-ATGGACATCTCCTTGCCTACTGGAATC-3' (SEQ ID NO: 9942)

5'-G<u>AC</u>AUCUCCUUGC<u>CU</u>A<u>C</u>UGG<u>AA</u>Uca-3' (SEQ ID NO: 5323)

3'-<u>A</u>CCUGU<u>A</u>G<u>AGGA</u>ACGG<u>A</u>UG<u>A</u>CC<u>UUA</u>GU-5' (SEQ ID NO: 7633)

C5-4327 Target:
5'-TGGACATCTCCTTGCCTACTGGAATCA-3' (SEQ ID NO: 9943)

5'-A<u>C</u>AUCUCCUUGCC<u>UA</u>CUGG<u>AA</u>UCag-3' (SEQ ID NO: 5324)

3'-<u>CC</u>UGU<u>A</u>G<u>AGGAA</u>CGG<u>A</u>UG<u>A</u>CCUU<u>A</u>GUC-5' (SEQ ID NO: 7634)

C5-4328 Target:
5'-GGACATCTCCTTGCCTACTGGAATCAG-3' (SEQ ID NO: 9944)

5'-C<u>A</u>U<u>C</u>UCCUUGCC<u>U</u>A<u>C</u>UGG<u>AA</u>UC<u>A</u>gt-3' (SEQ ID NO: 5325)

3'-<u>C</u>UGU<u>A</u>G<u>AGGAA</u>CGG<u>A</u>UG<u>A</u>CC<u>UUA</u>G<u>U</u>CA-5' (SEQ ID NO: 7635)

C5-4329 Target:
5'-GACATCTCCTTGCCTACTGGAATCAGT-3' (SEQ ID NO: 9945)

5'-A<u>U</u>CUCCUUGCCU<u>AC</u>UGG<u>AA</u>UC<u>A</u>Gtg-3' (SEQ ID NO: 5326)

3'-<u>U</u>GU<u>A</u>G<u>AGGAA</u>CGG<u>A</u>UG<u>A</u>CC<u>UUA</u>GUC<u>A</u>C-5' (SEQ ID NO: 7636)

C5-4330 Target:
5'-ACATCTCCTTGCCTACTGGAATCAGTG-3' (SEQ ID NO: 9946)

5'-U<u>C</u>U<u>CC</u>UUGCCU<u>A</u>CUGG<u>AA</u>UC<u>A</u>GUgc-3' (SEQ ID NO: 5327)

3'-<u>G</u>U<u>A</u>G<u>AGGAA</u>CGG<u>A</u>UG<u>A</u>CC<u>UUA</u>GUC<u>ACG</u>-5' (SEQ ID NO: 7637)

TABLE 7-continued

Human Anti-C5 DsiRNAs Predicted to have >50% Knockdown Efficacy (Asymmetrics)

C5-4331 Target:
5'-CATCTCCTTGCCTACTGGAATCAGTGC-3' (SEQ ID NO: 9947)

5'-CUCCUUGCCUACUGGAAUCAGUGca-3' (SEQ ID NO: 5328)

3'-UAGAGGAACGGAUGACCUUAGUCACGU-5' (SEQ ID NO: 7638)

C5-4332 Target:
5'-ATCTCCTTGCCTACTGGAATCAGTGCA-3' (SEQ ID NO: 9948)

5'-UCCUUGCCUACUGGAAUCAGUGCaa-3' (SEQ ID NO: 5329)

3'-AGAGGAACGGAUGACCUUAGUCACGUU-5' (SEQ ID NO: 7639)

C5-4333 Target:
5'-TCTCCTTGCCTACTGGAATCAGTGCAA-3' (SEQ ID NO: 9949)

5'-UGCAAAUGAAGAAGACUUAAAAGcc-3' (SEQ ID NO: 5330)

3'-UCACGUUUACUUCUUCUGAAUUUUCGG-5' (SEQ ID NO: 7640)

C5-4353 Target:
5'-AGTGCAAATGAAGAAGACTTAAAAGCC-3' (SEQ ID NO: 9950)

5'-GCAAAUGAAGAAGACUUAAAAGCcc-3' (SEQ ID NO: 5331)

3'-CACGUUUACUUCUUCUGAAUUUUCGGG-5' (SEQ ID NO: 7641)

C5-4354 Target:
5'-GTGCAAATGAAGAAGACTTAAAAGCCC-3' (SEQ ID NO: 9951)

5'-CAAAUGAAGAAGACUUAAAAGCCct-3' (SEQ ID NO: 5332)

3'-ACGUUUACUUCUUCUGAAUUUUCGGGA-5' (SEQ ID NO: 7642)

C5-4355 Target:
5'-TGCAAATGAAGAAGACTTAAAAGCCCT-3' (SEQ ID NO: 9952)

5'-AAAUGAAGAAGACUUAAAAGCCCtt-3' (SEQ ID NO: 5333)

3'-CGUUUACUUCUUCUGAAUUUUCGGGAA-5' (SEQ ID NO: 7643)

C5-4356 Target:
5'-GCAAATGAAGAAGACTTAAAAGCCCTT-3' (SEQ ID NO: 9953)

5'-AAUGAAGAAGACUUAAAAGCCCUtg-3' (SEQ ID NO: 5334)

3'-GUUUACUUCUUCUGAAUUUUCGGGAAC-5' (SEQ ID NO: 7644)

C5-4357 Target:
5'-CAAATGAAGAAGACTTAAAAGCCCTTG-3' (SEQ ID NO: 9954)

5'-AUGAAGAAGACUUAAAAGCCCUUgt-3' (SEQ ID NO: 5335)

3'-UUUACUUCUUCUGAAUUUUCGGGAACA-5' (SEQ ID NO: 7645)

C5-4358 Target:
5'-AAATGAAGAAGACTTAAAAGCCCTTGT-3' (SEQ ID NO: 9955)

5'-CUUGUGGAAGGGUGGAUCAACUat-3' (SEQ ID NO: 5336)

3'-GGGAACACCUUCCCCACCUAGUUGAUA-5' (SEQ ID NO: 7646)

C5-4378 Target:
5'-CCCTTGTGGAAGGGTGGATCAACTAT-3' (SEQ ID NO: 9956)

5'-UUGUGGAAGGGUGGAUCAACUAtt-3' (SEQ ID NO: 5337)

3'-GGAACACCUUCCCCACCUAGUUGAUAA-5' (SEQ ID NO: 7647)

C5-4379 Target:
5'-CCTTGTGGAAGGGTGGATCAACTATT-3' (SEQ ID NO: 9957)

5'-CUAUUCACUGAUUACCAAAUCAAag-3' (SEQ ID NO: 5338)

3'-UUGAUAAGUGACUAAUGGUUUAGUUUC-5' (SEQ ID NO: 7648)

TABLE 7-continued

Human Anti-C5 DsiRNAs Predicted to have >50% Knockdown Efficacy (Asymmetrics)

C5-4399 Target:
5'-AACTATTCACTGATTACCAAATCAAAG-3' (SEQ ID NO: 9958)

5'-UAUUCACUGAUUACCAAAUCAAga-3' (SEQ ID NO: 5339)

3'-UGAUAAGUGACUAAUGGUUUAGUUUCU-5' (SEQ ID NO: 7649)

C5-4400 Target:
5'-ACTATTCACTGATTACCAAATCAAAGA-3' (SEQ ID NO: 9959)

5'-AAAGAUGGACAUGUUAUUCUGCAac-3' (SEQ ID NO: 5340)

3'-AGUUUCUACCUGUACAAUAAGACGUUG-5' (SEQ ID NO: 7650)

C5-4420 Target:
5'-TCAAAGATGGACATGTTATTCTGCAAC-3' (SEQ ID NO: 9960)

5'-AAGAUGGACAUGUUAUUCUGCAAct-3' (SEQ ID NO: 5341)

3'-GUUUCUACCUGUACAAUAAGACGUUGA-5' (SEQ ID NO: 7651)

C5-4421 Target:
5'-CAAAGATGGACATGTTATTCTGCAACT-3' (SEQ ID NO: 9961)

5'-AGAUGGACAUGUUAUUCUGCAACtg-3' (SEQ ID NO: 5342)

3'-UUUCUACCUGUACAAUAAGACGUUGAC-5' (SEQ ID NO: 7652)

C5-4422 Target:
5'-AAAGATGGACATGTTATTCTGCAACTG-3' (SEQ ID NO: 9962)

5'-UGGACAUGUUAUUCUGCAACUGAat-3' (SEQ ID NO: 5343)

3'-CUACCUGUACAAUAAGACGUUGACUUA-5' (SEQ ID NO: 7653)

C5-4425 Target:
5'-GATGGACATGTTATTCTGCAACTGAAT-3' (SEQ ID NO: 9963)

5'-GACAUGUUAUUCUGCAACUGAAUtc-3' (SEQ ID NO: 5344)

3'-ACCUGUACAAUAAGACGUUGACUUAAG-5' (SEQ ID NO: 7654)

C5-4427 Target:
5'-TGGACATGTTATTCTGCAACTGAATTC-3' (SEQ ID NO: 9964)

5'-UGUUAUUCUGCAACUGAAUUCGAtt-3' (SEQ ID NO: 5345)

3'-GUACAAUAAGACGUUGACUUAAGCUAA-5' (SEQ ID NO: 7655)

C5-4431 Target:
5'-CATGTTATTCTGCAACTGAATTCGATT-3' (SEQ ID NO: 9965)

5'-GUUAUUCUGCAACUGAAUUCGAUtc-3' (SEQ ID NO: 5346)

3'-UACAAUAAGACGUUGACUUAAGCUAAG-5' (SEQ ID NO: 7656)

C5-4432 Target:
5'-ATGTTATTCTGCAACTGAATTCGATTC-3' (SEQ ID NO: 9966)

5'-UUAUUCUGCAACUGAAUUCGAUUcc-3' (SEQ ID NO: 5347)

3'-ACAAUAAGACGUUGACUUAAGCUAAGG-5' (SEQ ID NO: 7657)

C5-4433 Target:
5'-TGTTATTCTGCAACTGAATTCGATTCC-3' (SEQ ID NO: 9967)

5'-UAUUCUGCAACUGAAUUCGAUUCcc-3' (SEQ ID NO: 5348)

3'-CAAUAAGACGUUGACUUAAGCUAAGGG-5' (SEQ ID NO: 7658)

C5-4434 Target:
5'-GTTATTCTGCAACTGAATTCGATTCCC-3' (SEQ ID NO: 9968)

5'-UUUGAACUCUUUGAAGUUGGGUUtc-3' (SEQ ID NO: 5349)

3'-AUAACUUGAGAAACUUCAACCCAAAG-5' (SEQ ID NO: 7659)

TABLE 7-continued

Human Anti-C5 DsiRNAs Predicted to have >50% Knockdown Efficacy (Asymmetrics)

C5-4492 Target:
5'-TATTTGAACTCTTTGAAGTTGGGTTTC-3' (SEQ ID NO: 9969)

5'-UUGAACUCUUUGAAGUUGGGUUUct-3' (SEQ ID NO: 5350)

3'-UAAACUUGAGAAACUUCAACCCAAAGA-5' (SEQ ID NO: 7660)

C5-4493 Target:
5'-ATTTGAACTCTTTGAAGTTGGGTTTCT-3' (SEQ ID NO: 9970)

5'-UGAACUCUUUGAAGUUGGGUUUCtc-3' (SEQ ID NO: 5351)

3'-AAACUUGAGAAACUUCAACCCAAAGAG-5' (SEQ ID NO: 7661)

C5-4494 Target:
5'-TTTGAACTCTTTGAAGTTGGGTTTCTC-3' (SEQ ID NO: 9971)

5'-GAACUCUUUGAAGUUGGGUUUCUca-3' (SEQ ID NO: 5352)

3'-AACUUGAGAAACUUCAACCCAAAGAGU-5' (SEQ ID NO: 7662)

C5-4495 Target:
5'-TTGAACTCTTTGAAGTTGGGTTTCTCA-3' (SEQ ID NO: 9972)

5'-AACUCUUUGAAGUUGGGUUUCUCag-3' (SEQ ID NO: 5353)

3'-ACUUGAGAAACUUCAACCCAAAGAGUC-5' (SEQ ID NO: 7663)

C5-4496 Target:
5'-TGAACTCTTTGAAGTTGGGTTTCTCAG-3' (SEQ ID NO: 9973)

5'-ACUCUUUGAAGUUGGGUUUCUCAgt-3' (SEQ ID NO: 5354)

3'-CUUGAGAAACUUCAACCCAAAGAGUCA-5' (SEQ ID NO: 7664)

C5-4497 Target:
5'-GAACTCTTTGAAGTTGGGTTTCTCAGT-3' (SEQ ID NO: 9974)

5'-CUCUUUGAAGUUGGGUUUCUCAGtc-3' (SEQ ID NO: 5355)

3'-UUGAGAAACUUCAACCCAAAGAGUCAG-5' (SEQ ID NO: 7665)

C5-4498 Target:
5'-AACTCTTTGAAGTTGGGTTTCTCAGTC-3' (SEQ ID NO: 9975)

5'-UCUUUGAAGUUGGGUUUCUCAGUcc-3' (SEQ ID NO: 5356)

3'-UGAGAAACUUCAACCCAAAGAGUCAGG-5' (SEQ ID NO: 7666)

C5-4499 Target:
5'-ACTCTTTGAAGTTGGGTTTCTCAGTCC-3' (SEQ ID NO: 9976)

5'-AGUCCUGCCACUUUCACAGUGUACg-3' (SEQ ID NO: 5357)

3'-AGUCAGGACGGUGAAAGUGUCACAUGC-5' (SEQ ID NO: 7667)

C5-4519 Target:
5'-TCAGTCCTGCCACTTTCACAGTGTACG-3' (SEQ ID NO: 9977)

5'-GUCCUGCCACUUUCACAGUGUACga-3' (SEQ ID NO: 5358)

3'-GUCAGGACGGUGAAAGUGUCACAUGCU-5' (SEQ ID NO: 7668)

C5-4520 Target:
5'-CAGTCCTGCCACTTTCACAGTGTACGA-3' (SEQ ID NO: 9978)

5'-UCCUGCCACUUUCACAGUGUACGaa-3' (SEQ ID NO: 5359)

3'-UCAGGACGGUGAAAGUGUCACAUGCUU-5' (SEQ ID NO: 7669)

C5-4521 Target:
5'-AGTCCTGCCACTTTCACAGTGTACGAA-3' (SEQ ID NO: 9979)

5'-CCUGCCACUUUCACAGUGUACGAat-3' (SEQ ID NO: 5360)

3'-CAGGACGGUGAAAGUGUCACAUGCUUA-5' (SEQ ID NO: 7670)

TABLE 7-continued

Human Anti-C5 DsiRNAs Predicted to have >50% Knockdown Efficacy (Asymmetrics)

C5-4522 Target:
5'-GTCCTGCCACTTTCACAGTGTACGAAT-3' (SEQ ID NO: 9980)

5'-CUGCCACUUUCACAGUGUACGAAta-3' (SEQ ID NO: 5361)

3'-AGGACGGUGAAAGUGUCACAUGCUUAU-5' (SEQ ID NO: 7671)

C5-4523 Target:
5'-TCCTGCCACTTTCACAGTGTACGAATA-3' (SEQ ID NO: 9981)

5'-GAAUACCACAGACCAGAUAAACAgt-3' (SEQ ID NO: 5362)

3'-UGCUUAUGGUGUCUGGUCUAUUUGUCA-5' (SEQ ID NO: 7672)

C5-4543 Target:
5'-ACGAATACCACAGACCAGATAAACAGT-3' (SEQ ID NO: 9982)

5'-AAUACCACAGACCAGAUAAACAGtg-3' (SEQ ID NO: 5363)

3'-GCUUAUGGUGUCUGGUCUAUUUGUCAC-5' (SEQ ID NO: 7673)

C5-4544 Target:
5'-CGAATACCACAGACCAGATAAACAGTG-3' (SEQ ID NO: 9983)

5'-AUACCACAGACCAGAUAAACAGUgt-3' (SEQ ID NO: 5364)

3'-CUUAUGGUGUCUGGUCUAUUUGUCACA-5' (SEQ ID NO: 7674)

C5-4545 Target:
5'-GAATACCACAGACCAGATAAACAGTGT-3' (SEQ ID NO: 9984)

5'-UACCACAGACCAGAUAAACAGUGta-3' (SEQ ID NO: 5365)

3'-UUAUGGUGUCUGGUCUAUUUGUCACAU-5' (SEQ ID NO: 7675)

C5-4546 Target:
5'-AATACCACAGACCAGATAAACAGTGTA-3' (SEQ ID NO: 9985)

5'-ACCACAGACCAGAUAAACAGUGUac-3' (SEQ ID NO: 5366)

3'-UAUGGUGUCUGGUCUAUUUGUCACAUG-5' (SEQ ID NO: 7676)

C5-4547 Target:
5'-ATACCACAGACCAGATAAACAGTGTAC-3' (SEQ ID NO: 9986)

5'-CCACAGACCAGAUAAACAGUGUAcc-3' (SEQ ID NO: 5367)

3'-AUGGUGUCUGGUCUAUUUGUCACAUGG-5' (SEQ ID NO: 7677)

C5-4548 Target:
5'-TACCACAGACCAGATAAACAGTGTACC-3' (SEQ ID NO: 9987)

5'-CACAGACCAGAUAAACAGUGUACca-3' (SEQ ID NO: 5368)

3'-UGGUGUCUGGUCUAUUUGUCACAUGGU-5' (SEQ ID NO: 7678)

C5-4549 Target:
5'-ACCACAGACCAGATAAACAGTGTACCA-3' (SEQ ID NO: 9988)

5'-ACAGACCAGAUAAACAGUGUACCat-3' (SEQ ID NO: 5369)

3'-GGUGUCUGGUCUAUUUGUCACAUGGUA-5' (SEQ ID NO: 7679)

C5-4550 Target:
5'-CCACAGACCAGATAAACAGTGTACCAT-3' (SEQ ID NO: 9989)

5'-CAGACCAGAUAAACAGUGUACCAtg-3' (SEQ ID NO: 5370)

3'-GUGUCUGGUCUAUUUGUCACAUGGUAC-5' (SEQ ID NO: 7680)

C5-4551 Target:
5'-CACAGACCAGATAAACAGTGTACCATG-3' (SEQ ID NO: 9990)

5'-AGACCAGAUAAACAGUGUACCAUgt-3' (SEQ ID NO: 5371)

3'-UGUCUGGUCUAUUUGUCACAUGGUACA-5' (SEQ ID NO: 7681)

TABLE 7-continued

Human Anti-C5 DsiRNAs Predicted to have >50% Knockdown Efficacy (Asymmetrics)

C5-4552 Target:
5'-ACAGACCAGATAAACAGTGTACCATGT-3' (SEQ ID NO: 9991)

5'-GA<u>CC</u>AGAUAAACA<u>GU</u>GUACCAUGtt-3' (SEQ ID NO: 5372)

3'-<u>GUCUGG</u>UCUAUUUGU<u>CAC</u>AUGGUA<u>ACAA</u>-5' (SEQ ID NO: 7682)

C5-4553 Target:
5'-CAGACCAGATAAACAGTGTACCATGTT-3' (SEQ ID NO: 9992)

5'-A<u>CC</u>AGAUAAACAGUGU<u>A</u>CCAUGUtt-3' (SEQ ID NO: 5373)

3'-<u>UCUGG</u>UCUAUUUGU<u>CAC</u>AUGGUA<u>CAAA</u>-5' (SEQ ID NO: 7683)

C5-4554 Target:
5'-AGACCAGATAAACAGTGTACCATGTTT-3' (SEQ ID NO: 9993)

5'-C<u>CA</u>GAUAAACAGUG<u>UA</u>CCAUGUUtt-3' (SEQ ID NO: 5374)

3'-<u>CUGG</u>UCUAUUUGUC<u>AC</u>AUGGUACA<u>AAAA</u>-5' (SEQ ID NO: 7684)

C5-4555 Target:
5'-GACCAGATAAACAGTGTACCATGTTTT-3' (SEQ ID NO: 9994)

5'-C<u>A</u>GAUAAACAGUGU<u>A</u>CCAUGUUUta-3' (SEQ ID NO: 5375)

3'-<u>UGGU</u>CUAUUUGUCA<u>C</u>AUGGUACA<u>AAAU</u>-5' (SEQ ID NO: 7685)

C5-4556 Target:
5'-ACCAGATAAACAGTGTACCATGTTTTA-3' (SEQ ID NO: 9995)

5'-A<u>G</u>AUAAACAGUGU<u>ACC</u>AUGUUUUat-3' (SEQ ID NO: 5376)

3'-<u>GGU</u>CUAUUUGUCA<u>C</u>AUGGUACAA<u>AAUA</u>-5' (SEQ ID NO: 7686)

C5-4557 Target:
5'-CCAGATAAACAGTGTACCATGTTTTAT-3' (SEQ ID NO: 9996)

5'-U<u>AAA</u>CAGUGUACC<u>A</u>UGUUUUAUAgc-3' (SEQ ID NO: 5377)

3'-<u>CU</u>AUUUGUCACAUGG<u>U</u>ACAAAAUA<u>UCG</u>-5' (SEQ ID NO: 7687)

C5-4560 Target:
5'-GATAAACAGTGTACCATGTTTTATAGC-3' (SEQ ID NO: 9997)

5'-A<u>A</u>CAGUGUACCAUG<u>UU</u>UUAUAGCac-3' (SEQ ID NO: 5378)

3'-<u>AUU</u>UGUCACAUGGUA<u>C</u>AAAAUAUC<u>GUG</u>-5' (SEQ ID NO: 7688)

C5-4562 Target:
5'-TAAACAGTGTACCATGTTTTATAGCAC-3' (SEQ ID NO: 9998)

5'-C<u>A</u>GUGUACCAUGU<u>UUU</u>AUAGCACtt-3' (SEQ ID NO: 5379)

3'-<u>UUGU</u>CACAUGGUAC<u>AAAA</u>UAUCGUGAA-5' (SEQ ID NO: 7689)

C5-4564 Target:
5'-AACAGTGTACCATGTTTTATAGCACTT-3' (SEQ ID NO: 9999)

5'-A<u>GU</u>GUACCAUGUUU<u>U</u>AUAGCACUtc-3' (SEQ ID NO: 5380)

3'-<u>UGUC</u>ACAUGGUACA<u>AAA</u>UAUCGU<u>GAAG</u>-5' (SEQ ID NO: 7690)

C5-4565 Target:
5'-ACAGTGTACCATGTTTTATAGCACTTC-3' (SEQ ID NO: 10000)

5'-G<u>UGU</u>ACCAUGUUUU<u>A</u>UAGCACUUcc-3' (SEQ ID NO: 5381)

3'-<u>GUC</u>ACAUGGUACAA<u>AA</u>UAUCGUGA<u>AGG</u>-5' (SEQ ID NO: 7691)

TABLE 7-continued

Human Anti-C5 DsiRNAs Predicted to have >50% Knockdown Efficacy (Asymmetrics)

C5-4566 Target:
5'-CAGTGTACCATGTTTTATAGCACTTCC-3' (SEQ ID NO: 10001)

5'-U<u>GUA</u>CCAUGUUUU<u>AU</u>AGCACUUCca-3' (SEQ ID NO: 5382)

3'-<u>UCAC</u>AUGGUACAAAA<u>U</u>AUCGUGA<u>AGGU</u>-5' (SEQ ID NO: 7692)

C5-4567 Target:
5'-AGTGTACCATGTTTTATAGCACTTCCA-3' (SEQ ID NO: 10002)

5'-G<u>UA</u>CCAUGUUUUA<u>U</u>AGCACUUCCaa-3' (SEQ ID NO: 5383)

3'-<u>CAC</u>AUGGUACAAAAU<u>A</u>UCGUGA<u>AGGUU</u>-5' (SEQ ID NO: 7693)

C5-4568 Target:
5'-GTGTACCATGTTTTATAGCACTTCCAA-3' (SEQ ID NO: 10003)

5'-U<u>ACC</u>AUGUUUUAU<u>AGC</u>ACUUCCAat-3' (SEQ ID NO: 5384)

3'-<u>ACA</u>UGGUACAAAAU<u>A</u>UCGUGAAG<u>GUUA</u>-5' (SEQ ID NO: 7694)

C5-4569 Target:
5'-TGTACCATGTTTTATAGCACTTCCAAT-3' (SEQ ID NO: 10004)

5'-A<u>CC</u>AUGUUUUAU<u>GC</u>A<u>C</u>UUCCAAta-3' (SEQ ID NO: 5385)

3'-<u>C</u>AUGGUACAAAAUA<u>U</u>CGUGAAGG<u>UUAU</u>-5' (SEQ ID NO: 7695)

C5-4570 Target:
5'-GTACCATGTTTTATAGCACTTCCAATA-3' (SEQ ID NO: 10005)

5'-C<u>CA</u>UGUUUUAUAGC<u>A</u>CUUCCAAUat-3' (SEQ ID NO: 5386)

3'-<u>A</u>UGGUACAAAAUAUC<u>G</u>UGAAGGU<u>UAUA</u>-5' (SEQ ID NO: 7696)

C5-4571 Target:
5'-TACCATGTTTTATAGCACTTCCAATAT-3' (SEQ ID NO: 10006)

5'-C<u>AU</u>GUUUUAUAGC<u>AC</u>U<u>U</u>CCAUAtc-3' (SEQ ID NO: 5387)

3'-<u>UGG</u>UACAAAAUAUCG<u>U</u>GAAGGUU<u>AUAG</u>-5' (SEQ ID NO: 7697)

C5-4572 Target:
5'-ACCATGTTTTATAGCACTTCCAATATC-3' (SEQ ID NO: 10007)

5'-A<u>UG</u>UUUUAUAGCAC<u>U</u>U<u>C</u>CAAUAUca-3' (SEQ ID NO: 5388)

3'-<u>GGU</u>ACAAAAUAUCGU<u>G</u>AAGGUUA<u>UAGU</u>-5' (SEQ ID NO: 7698)

C5-4573 Target:
5'-CCATGTTTTATAGCACTTCCAATATCA-3' (SEQ ID NO: 10008)

5'-U<u>GU</u>UUUAUAGCACU<u>UCC</u>AAUAUCaa-3' (SEQ ID NO: 5389)

3'-<u>GUAC</u>AAAAUAUCGUGA<u>A</u>GGUUAU<u>AGUU</u>-5' (SEQ ID NO: 7699)

C5-4574 Target:
5'-CATGTTTTATAGCACTTCCAATATCAA-3' (SEQ ID NO: 10009)

5'-G<u>UUU</u>UAUAGCACU<u>UCC</u>AAUAUCAaa-3' (SEQ ID NO: 5390)

3'-<u>UACA</u>AAAUAUCGUGA<u>AGG</u>UUAUA<u>GUUU</u>-5' (SEQ ID NO: 7700)

TABLE 7-continued

Human Anti-C5 DsiRNAs Predicted to have >50% Knockdown Efficacy (Asymmetrics)

C5-4575 Target:
5'-ATGTTTTATAGCACTTCCAATATCAAA-3'
(SEQ ID NO: 10010)

5'-U<u>UUU</u>AUAGCACUU<u>CC</u>A<u>AU</u>AUCAAaa-3' (SEQ ID NO: 5391)

3'-<u>ACAAA</u>AUAUCGUGA<u>AGG</u>UUAUAGU<u>UUU</u>-5' (SEQ ID NO: 7701)

C5-4576 Target:
5'-TGTTTTATAGCACTTCCAATATCAAAA-3'
(SEQ ID NO: 10011)

5'-U<u>UU</u>AUAGCACUU<u>CC</u>A<u>AU</u>AUCAAAat-3' (SEQ ID NO: 5392)

3'-<u>CAAA</u>AUAUCGUGA<u>AGG</u>UUAUAGU<u>UUUA</u>-5' (SEQ ID NO: 7702)

C5-4577 Target:
5'-GTTTTATAGCACTTCCAATATCAAAAT-3'
(SEQ ID NO: 10012)

5'-U<u>U</u>AUAGCACUUCC<u>A</u>AUAUCAAAAtt-3' (SEQ ID NO: 5393)

3'-<u>AAAA</u>UAUCGUGAAGG<u>U</u>UAUAGUU<u>UUAA</u>-5' (SEQ ID NO: 7703)

C5-4578 Target:
5'-TTTTATAGCACTTCCAATATCAAAATT-3'
(SEQ ID NO: 10013)

5'-U<u>AU</u>AGCACUUCCA<u>AU</u>AUCAAAAUtc-3' (SEQ ID NO: 5394)

3'-<u>AAA</u>UAUCGUGAAGG<u>UU</u>AUAGUUUUAAG-5' (SEQ ID NO: 7704)

C5-4579 Target:
5'-TTTATAGCACTTCCAATATCAAAATTC-3'
(SEQ ID NO: 10014)

5'-U<u>AGC</u>ACUUCCAAU<u>AU</u>CAAAAUUCag-3' (SEQ ID NO: 5395)

3'-<u>AUAUC</u>GUGAAGGUU<u>AU</u>AGUUUUA<u>AGUC</u>-5' (SEQ ID NO: 7705)

C5-4581 Target:
5'-TATAGCACTTCCAATATCAAAATTCAG-3'
(SEQ ID NO: 10015)

5'-A<u>GC</u>ACUUCCAAUAU<u>C</u>AAAAUUCAga-3' (SEQ ID NO: 5396)

3'-<u>UAUC</u>GUGAAGGUUAU<u>A</u>GUUUUAAG<u>UCU</u>-5' (SEQ ID NO: 7706)

C5-4582 Target:
5'-ATAGCACTTCCAATATCAAAATTCAGA-3'
(SEQ ID NO: 10016)

5'-G<u>CA</u>CUUCCAAUAU<u>C</u>A<u>A</u>AAUUCAGaa-3' (SEQ ID NO: 5397)

3'-<u>AUC</u>GUGAAGGUUAU<u>A</u>GUUUUAAGU<u>CUU</u>-5' (SEQ ID NO: 7707)

C5-4583 Target:
5'-TAGCACTTCCAATATCAAAATTCAGAA-3'
(SEQ ID NO: 10017)

5'-C<u>AC</u>UUCCAAUAUC<u>A</u>A<u>A</u>AUUCAGAaa-3' (SEQ ID NO: 5398)

3'-<u>UCGUG</u>AAGGUUAUAG<u>U</u>UUUAAGU<u>CUUU</u>-5' (SEQ ID NO: 7708)

C5-4584 Target:
5'-AGCACTTCCAATATCAAAATTCAGAAA-3'
(SEQ ID NO: 10018)

5'-A<u>C</u>UUCCAAUAUCA<u>AAA</u>UUCAGAAag-3' (SEQ ID NO: 5399)

3'-<u>CGUGA</u>AGGUUAUAGU<u>UUU</u>AAGUCUUUC-5' (SEQ ID NO: 7709)

C5-4585 Target:
5'-GCACTTCCAATATCAAAATTCAGAAAG-3'
(SEQ ID NO: 10019)

5'-C<u>UU</u>CCAAUAUCAAA<u>AU</u>UCAGAAAgt-3' (SEQ ID NO: 5400)

3'-<u>GUGA</u>AGGUUAUAGUUUU<u>A</u>AGUCU<u>UUCA</u>-5' (SEQ ID NO: 7710)

C5-4586 Target:
5'-CACTTCCAATATCAAAATTCAGAAAGT-3'
(SEQ ID NO: 10020)

5'-U<u>UCC</u>AAUAUCAAA<u>A</u>UUCAGAAAGtc-3' (SEQ ID NO: 5401)

3'-<u>UGAA</u>GGUUAUAGUUUU<u>A</u>AGUCUUU<u>CAG</u>-5' (SEQ ID NO: 7711)

C5-4587 Target:
5'-ACTTCCAATATCAAAATTCAGAAAGTC-3'
(SEQ ID NO: 10021)

5'-U<u>CC</u>AAUAUCAAAA<u>U</u>UCAGAAAGUct-3' (SEQ ID NO: 5402)

3'-<u>GAAG</u>GUUAUAGUUUUA<u>A</u>GUCUUU<u>CAGA</u>-5' (SEQ ID NO: 7712)

C5-4588 Target:
5'-CTTCCAATATCAAAATTCAGAAAGTCT-3'
(SEQ ID NO: 10022)

5'-C<u>CA</u>AUAUCAAAAU<u>U</u>CAGAAAGUCtg-3' (SEQ ID NO: 5403)

3'-<u>AAGG</u>UUAUAGUUUUA<u>A</u>GUCUUUC<u>AGAC</u>-5' (SEQ ID NO: 7713)

C5-4589 Target:
5'-TTCCAATATCAAAATTCAGAAAGTCTG-3'
(SEQ ID NO: 10023)

5'-C<u>AA</u>UAUCAAAAUU<u>C</u>AGAAAGUCUgt-3' (SEQ ID NO: 5404)

3'-<u>AGG</u>UUAUAGUUUUA<u>A</u>GUCUUUC<u>AGACA</u>-5' (SEQ ID NO: 7714)

C5-4590 Target:
5'-TCCAATATCAAAATTCAGAAAGTCTGT-3'
(SEQ ID NO: 10024)

5'-A<u>AU</u>AUCAAAAUUC<u>AG</u>AAAGUCUGtg-3' (SEQ ID NO: 5405)

3'-<u>GG</u>UUAUAGUUUUAAGU<u>C</u>UUUCAG<u>ACAC</u>-5' (SEQ ID NO: 7715)

C5-4591 Target:
5'-CCAATATCAAAATTCAGAAAGTCTGTG-3'
(SEQ ID NO: 10025)

5'-A<u>UAU</u>CAAAAUUCAG<u>AA</u>AGUCUGUga-3' (SEQ ID NO: 5406)

3'-<u>G</u>UUA<u>U</u>AGUUUUAAGUC<u>U</u>UUCAG<u>ACACU</u>-5' (SEQ ID NO: 7716)

C5-4592 Target:
5'-CAATATCAAAATTCAGAAAGTCTGTGA-3'
(SEQ ID NO: 10026)

5'-U<u>AU</u>CAAAAUUCAG<u>AAA</u>GUCUGUGaa-3' (SEQ ID NO: 5407)

3'-<u>UUA</u>UAGUUUUAAGU<u>C</u>UUUCAGAC<u>ACUU</u>-5' (SEQ ID NO: 7717)

C5-4593 Target:
5'-AATATCAAAATTCAGAAAGTCTGTGAA-3'
(SEQ ID NO: 10027)

5'-A<u>UC</u>AAAAUUCAGA<u>AA</u>GUCUGUGAag-3' (SEQ ID NO: 5408)

3'-<u>UAUAG</u>UUUUAAGUCU<u>UU</u>CAGACA<u>CUUC</u>-5' (SEQ ID NO: 7718)

TABLE 7-continued

Human Anti-C5 DsiRNAs Predicted to have >50% Knockdown Efficacy (Asymmetrics)

C5-4594 Target:
5'-ATATCAAAATTCAGAAAGTCTGTGAAG-3'
(SEQ ID NO: 10028)

5'-UCAAAAUUCAGAAAGUCUGUGAAgg-3' (SEQ ID NO: 5409)

3'-AUAGUUUUAAGUCUUUCAGACACUUCC-5' (SEQ ID NO: 7719)

C5-4595 Target:
5'-TATCAAAATTCAGAAAGTCTGTGAAGG-3'
(SEQ ID NO: 10029)

5'-CAAAAUUCAGAAAGUCUGUGAAGga-3' (SEQ ID NO: 5410)

3'-UAGUUUUAAGUCUUUCAGACACUUCCU-5' (SEQ ID NO: 7720)

C5-4596 Target:
5'-ATCAAAATTCAGAAAGTCTGTGAAGGA-3'
(SEQ ID NO: 10030)

5'-AAAAUUCAGAAAGUCUGUGAAGGag-3' (SEQ ID NO: 5411)

3'-AGUUUUAAGUCUUUCAGACACUUCCUC-5' (SEQ ID NO: 7721)

C5-4597 Target:
5'-TCAAAATTCAGAAAGTCTGTGAAGGAG-3'
(SEQ ID NO: 10031)

5'-AAAUUCAGAAAGUCUGUGAAGGAgc-3' (SEQ ID NO: 5412)

3'-GUUUUAAGUCUUUCAGACACUUCCUCG-5' (SEQ ID NO: 7722)

C5-4598 Target:
5'-CAAAATTCAGAAAGTCTGTGAAGGAGC-3'
(SEQ ID NO: 10032)

5'-AAUUCAGAAAGUCUGUGAAGGAGcc-3' (SEQ ID NO: 5413)

3'-UUUUAAGUCUUUCAGACACUUCCUCGG-5' (SEQ ID NO: 7723)

C5-4599 Target:
5'-AAAATTCAGAAAGTCTGTGAAGGAGCC-3'
(SEQ ID NO: 10033)

5'-AUUCAGAAAGUCUGUGAAGGAGCcg-3' (SEQ ID NO: 5414)

3'-UUUAAGUCUUUCAGACACUUCCUCGGC-5' (SEQ ID NO: 7724)

C5-4600 Target:
5'-AAATTCAGAAAGTCTGTGAAGGAGCCG-3'
(SEQ ID NO: 10034)

5'-GAAAGUCUGUGAAGGAGCCGCGUgc-3' (SEQ ID NO: 5415)

3'-GUCUUUCAGACACUUCCUCGGCGCACG-5' (SEQ ID NO: 7725)

C5-4605 Target:
5'-CAGAAAGTCTGTGAAGGAGCCGCGTGC-3'
(SEQ ID NO: 10035)

5'-UAGAAGCUGAUUGUGGGCAAAUGca-3' (SEQ ID NO: 5416)

3'-ACAUCUUCGACUAACACCCGUUUACGU-5' (SEQ ID NO: 7726)

C5-4637 Target:
5'-TGTAGAAGCTGATTGTGGGCAAATGCA-3'
(SEQ ID NO: 10036)

5'-AGAAGCUGAUUGUGGGCAAAUGCag-3' (SEQ ID NO: 5417)

3'-CAUCUUCGACUAACACCCGUUUACGUC-5' (SEQ ID NO: 7727)

C5-4638 Target:
5'-GTAGAAGCTGATTGTGGGCAAATGCAG-3'
(SEQ ID NO: 10037)

5'-GAAGCUGAUUGUGGGCAAAUGCAgg-3' (SEQ ID NO: 5418)

3'-AUCUUCGACUAACACCCGUUUACGUCC-5' (SEQ ID NO: 7728)

C5-4639 Target:
5'-TAGAAGCTGATTGTGGGCAAATGCAGG-3'
(SEQ ID NO: 10038)

5'-AAGCUGAUUGUGGGCAAAUGCAGga-3' (SEQ ID NO: 5419)

3'-UCUUCGACUAACACCCGUUUACGUCCU-5' (SEQ ID NO: 7729)

C5-4640 Target:
5'-AGAAGCTGATTGTGGGCAAATGCAGGA-3'
(SEQ ID NO: 10039)

5'-AGCUGAUUGUGGGCAAAUGCAGGaa-3' (SEQ ID NO: 5420)

3'-CUUCGACUAACACCCGUUUACGUCCUU-5' (SEQ ID NO: 7730)

C5-4641 Target:
5'-GAAGCTGATTGTGGGCAAATGCAGGAA-3'
(SEQ ID NO: 10040)

5'-GCUGAUUGUGGGCAAAUGCAGGAag-3' (SEQ ID NO: 5421)

3'-UUCGACUAACACCCGUUUACGUCCUUC-5' (SEQ ID NO: 7731)

C5-4642 Target:
5'-AAGCTGATTGTGGGCAAATGCAGGAAG-3'
(SEQ ID NO: 10041)

5'-CUGAUUGUGGGCAAAUGCAGGAAga-3' (SEQ ID NO: 5422)

3'-UCGACUAACACCCGUUUACGUCCUUCU-5' (SEQ ID NO: 7732)

C5-4643 Target:
5'-AGCTGATTGTGGGCAAATGCAGGAAGA-3'
(SEQ ID NO: 10042)

5'-UGAUUGUGGGCAAAUGCAGGAAGaa-3' (SEQ ID NO: 5423)

3'-CGACUAACACCCGUUUACGUCCUUCUU-5' (SEQ ID NO: 7733)

C5-4644 Target:
5'-GCTGATTGTGGGCAAATGCAGGAAGAA-3'
(SEQ ID NO: 10043)

5'-AAGAAUUGGAUCUGACAAUCUCUgc-3' (SEQ ID NO: 5424)

3'-CCUUCUUAACCUAGACUGUUAGAGACG-5' (SEQ ID NO: 7734)

C5-4664 Target:
5'-GGAAGAATTGGATCTGACAATCTCTGC-3'
(SEQ ID NO: 10044)

5'-AGAAUUGGAUCUGACAAUCUCUGca-3' (SEQ ID NO: 5425)

3'-CUUCUUAACCUAGACUGUUAGAGACGU-5' (SEQ ID NO: 7735)

C5-4665 Target:
5'-GAAGAATTGGATCTGACAATCTCTGCA-3'
(SEQ ID NO: 10045)

5'-GAAUUGGAUCUGACAAUCUCUGCag-3' (SEQ ID NO: 5426)

3'-UUCUUAACCUAGACUGUUAGAGACGUC-5' (SEQ ID NO: 7736)

TABLE 7-continued

Human Anti-C5 DsiRNAs Predicted to have >50% Knockdown Efficacy (Asymmetrics)

C5-4666 Target:
5'-AAGAATTGGATCTGACAATCTCTGCAG-3'
(SEQ ID NO: 10046)

5'-A<u>A</u>UUGG<u>A</u>UCUGACA<u>A</u>UCUCUGCAga-3' (SEQ ID NO: 5427)

3'-<u>UCUUA</u>ACCUAGACUG<u>UU</u>AGAGAC<u>GUCU</u>-5' (SEQ ID NO: 7737)

C5-4667 Target:
5'-AGAATTGGATCTGACAATCTCTGCAGA-3'
(SEQ ID NO: 10047)

5'-A<u>U</u>UGGAUCUGACA<u>AU</u>CUCUGCAGag-3' (SEQ ID NO: 5428)

3'-<u>CUUAA</u>CCUAGACUGUU<u>A</u>GAGACGUC<u>UC</u>-5' (SEQ ID NO: 7738)

C5-4668 Target:
5'-GAATTGGATCTGACAATCTCTGCAGAG-3'
(SEQ ID NO: 10048)

5'-<u>UU</u>GG<u>A</u>UCUGACA<u>AU</u>C<u>U</u>CUGCAGaga-3' (SEQ ID NO: 5429)

3'-<u>UUAA</u>CCUAGACUGUU<u>A</u>GAGACGU<u>CUCU</u>-5' (SEQ ID NO: 7739)

C5-4669 Target:
5'-AATTGGATCTGACAATCTCTGCAGAGA-3'
(SEQ ID NO: 10049)

5'-<u>UGG</u>A<u>U</u>CUGACAAUC<u>U</u>CUGCAGAGac-3' (SEQ ID NO: 5430)

3'-<u>UAAC</u>CUAGACUGUU<u>A</u>GAGACGUC<u>UCUG</u>-5' (SEQ ID NO: 7740)

C5-4670 Target:
5'-ATTGGATCTGACAATCTCTGCAGAGAC-3'
(SEQ ID NO: 10050)

5'-<u>GG</u>A<u>U</u>CUGACAAUC<u>U</u>CUGCAGAGAca-3' (SEQ ID NO: 5431)

3'-<u>AA</u>CCUAGACUGUU<u>A</u>G<u>A</u>GACGUCUC<u>UGU</u>-5' (SEQ ID NO: 7741)

C5-4671 Target:
5'-TTGGATCTGACAATCTCTGCAGAGACA-3'
(SEQ ID NO: 10051)

5'-G<u>AU</u>CUGACAAUCUC<u>U</u>GCAGAGACaa-3' (SEQ ID NO: 5432)

3'-<u>ACCU</u>AGACUGUUAG<u>A</u>GACGUCUC<u>UGUU</u>-5' (SEQ ID NO: 7742)

C5-4672 Target:
5'-TGGATCTGACAATCTCTGCAGAGACAA-3'
(SEQ ID NO: 10052)

5'-<u>AU</u>CUGACAAUCUCUGCAGAGACAag-3' (SEQ ID NO: 5433)

3'-<u>CC</u>UAGACUGUUAGAG<u>A</u>CGUCUCU<u>GUUC</u>-5' (SEQ ID NO: 7743)

C5-4673 Target:
5'-GGATCTGACAATCTCTGCAGAGACAAG-3'
(SEQ ID NO: 10053)

5'-<u>U</u>CUGACAAUCUCUG<u>C</u>AGAGACAAga-3' (SEQ ID NO: 5434)

3'-<u>CUAGA</u>CUGUUAGAGA<u>C</u>GUCUCUGUU<u>CU</u>-5' (SEQ ID NO: 7744)

C5-4674 Target:
5'-GATCTGACAATCTCTGCAGAGACAAGA-3'
(SEQ ID NO: 10054)

5'-CUGACAAUCUCUGC<u>A</u>GAGACAAGaa-3' (SEQ ID NO: 5435)

3'-<u>UAGA</u>CUGUUAGAGAC<u>G</u>UCUCUGUU<u>UCUU</u>-5' (SEQ ID NO: 7745)

TABLE 7-continued

Human Anti-C5 DsiRNAs Predicted to have >50% Knockdown Efficacy (Asymmetrics)

C5-4675 Target:
5'-ATCTGACAATCTCTGCAGAGACAAGAA-3'
(SEQ ID NO: 10055)

5'-UG<u>A</u>CAAUCUCUGC<u>AGA</u>GACAAGAaa-3' (SEQ ID NO: 5436)

3'-<u>AGA</u>CUGUUAGAGACG<u>U</u>CUCUGUU<u>CUUU</u>-5' (SEQ ID NO: 7746)

C5-4676 Target:
5'-TCTGACAATCTCTGCAGAGACAAGAAA-3'
(SEQ ID NO: 10056)

5'-AG<u>AAA</u>ACAAACAGC<u>A</u>UGUAAACCag-3' (SEQ ID NO: 5437)

3'-<u>GUU</u>CUUUUGUUUGUC<u>G</u>UACAUUUG<u>GUC</u>-5' (SEQ ID NO: 7747)

C5-4696 Target:
5'-CAAGAAAACAAACAGCATGTAAACCAG-3'
(SEQ ID NO: 10057)

5'-G<u>AAA</u>ACAAACAGC<u>A</u>UGUAAACCAga-3' (SEQ ID NO: 5438)

3'-<u>UUC</u>UUUUGUUUGUC<u>GU</u>ACAUUUG<u>UCU</u>-5' (SEQ ID NO: 7748)

C5-4697 Target:
5'-AAGAAAACAAACAGCATGTAAACCAGA-3'
(SEQ ID NO: 10058)

5'-G<u>AU</u>UGCAUAUGCUU<u>A</u>U<u>A</u>AAGUUAgc-3' (SEQ ID NO: 5439)

3'-<u>CUC</u>UAACGUAUACG<u>AA</u>UAUUUCA<u>AUCG</u>-5' (SEQ ID NO: 7749)

C5-4722 Target:
5'-GAGATTGCATATGCTTATAAAGTTAGC-3'
(SEQ ID NO: 10059)

5'-A<u>UU</u>GCAUAUGCUU<u>A</u>U<u>A</u>AAGUUAGca-3' (SEQ ID NO: 5440)

3'-<u>UCU</u>AACGUAUACGA<u>A</u>UAUUUCA<u>AUCGU</u>-5' (SEQ ID NO: 7750)

C5-4723 Target:
5'-AGATTGCATATGCTTATAAAGTTAGCA-3'
(SEQ ID NO: 10060)

5'-UU<u>GC</u>AUAUGCUUA<u>U</u>A<u>AAA</u>GUUAGCat-3' (SEQ ID NO: 5441)

3'-<u>CUAA</u>CGUAUACGAAU<u>A</u>UUUCAAU<u>CGUA</u>-5' (SEQ ID NO: 7751)

C5-4724 Target:
5'-GATTGCATATGCTTATAAAGTTAGCAT-3'
(SEQ ID NO: 10061)

5'-UGC<u>A</u>UAUGCUUAU<u>A</u>A<u>A</u>GUUAGCAtc-3' (SEQ ID NO: 5442)

3'-<u>UAAC</u>GUAUACGAAUA<u>U</u>UUCAAUC<u>GUAG</u>-5' (SEQ ID NO: 7752)

C5-4725 Target:
5'-ATTGCATATGCTTATAAAGTTAGCATC-3'
(SEQ ID NO: 10062)

5'-GC<u>A</u>UAUGCUUAUA<u>AA</u>GUUAGCAUca-3' (SEQ ID NO: 5443)

3'-<u>AAC</u>GUAUACGAAUAU<u>U</u>UCAAUCGUAGU-5' (SEQ ID NO: 7753)

C5-4726 Target:
5'-TTGCATATGCTTATAAAGTTAGCATCA-3'
(SEQ ID NO: 10063)

5'-A<u>U</u>GUUUUGUCA<u>A</u>GU<u>A</u>CAAGGCAac-3' (SEQ ID NO: 5444)

3'-<u>UUU</u>ACAAAACAGUUC<u>A</u>UGUUCC<u>GUUG</u>-5' (SEQ ID NO: 7754)

TABLE 7-continued

Human Anti-C5 DsiRNAs Predicted to have >50% Knockdown Efficacy (Asymmetrics)

C5-4769 Target:
5'-AAATGTTTTTGTCAAGTACAAGGCAAC-3'
(SEQ ID NO: 10064)

5'-UGUUUUGUCAAGUACAAGGCAAcc-3' (SEQ ID NO: 5445)

3'-UUACAAAAACAGUUCAUGUUCCGUUGG-5' (SEQ ID NO: 7755)

C5-4770 Target:
5'-AATGTTTTTGTCAAGTACAAGGCAACC-3'
(SEQ ID NO: 10065)

5'-GUUUUGUCAAGUACAAGGCAACcc-3' (SEQ ID NO: 5446)

3'-UACAAAAACAGUUCAUGUUCCGUUGGG-5' (SEQ ID NO: 7756)

C5-4771 Target:
5'-ATGTTTTTGTCAAGTACAAGGCAACCC-3'
(SEQ ID NO: 10066)

5'-UUUUUGUCAAGUACAAGGCAACCct-3' (SEQ ID NO: 5447)

3'-ACAAAAACAGUUCAUGUUCCGUUGGGA-5' (SEQ ID NO: 7757)

C5-4772 Target:
5'-TGTTTTTGTCAAGTACAAGGCAACCCT-3'
(SEQ ID NO: 10067)

5'-UUUUGUCAAGUACAAGGCAACCCtt-3' (SEQ ID NO: 5448)

3'-CAAAAACAGUUCAUGUUCCGUUGGGAA-5' (SEQ ID NO: 7758)

C5-4773 Target:
5'-GTTTTTGTCAAGTACAAGGCAACCCTT-3'
(SEQ ID NO: 10068)

5'-UUUGUCAAGUACAAGGCAACCCUtc-3' (SEQ ID NO: 5449)

3'-AAAAACAGUUCAUGUUCCGUUGGGAAG-5' (SEQ ID NO: 7759)

C5-4774 Target:
5'-TTTTTGTCAAGTACAAGGCAACCCTTC-3'
(SEQ ID NO: 10069)

5'-UUGUCAAGUACAAGGCAACCCUUct-3' (SEQ ID NO: 5450)

3'-AAAACAGUUCAUGUUCCGUUGGGAAGA-5' (SEQ ID NO: 7760)

C5-4775 Target:
5'-TTTTGTCAAGTACAAGGCAACCCTTCT-3'
(SEQ ID NO: 10070)

5'-UGUCAAGUACAAGGCAACCCUUCtg-3' (SEQ ID NO: 5451)

3'-AAACAGUUCAUGUUCCGUUGGGAAGAC-5' (SEQ ID NO: 7761)

C5-4776 Target:
5'-TTTGTCAAGTACAAGGCAACCCTTCTG-3'
(SEQ ID NO: 10071)

5'-GUCAAGUACAAGGCAACCCUUCUgg-3' (SEQ ID NO: 5452)

3'-AACAGUUCAUGUUCCGUUGGGAAGACC-5' (SEQ ID NO: 7762)

C5-4777 Target:
5'-TTGTCAAGTACAAGGCAACCCTTCTGG-3'
(SEQ ID NO: 10072)

5'-UCAAGUACAAGGCAACCCUUCUGga-3' (SEQ ID NO: 5453)

3'-ACAGUUCAUGUUCCGUUGGGAAGACCU-5' (SEQ ID NO: 7763)

TABLE 7-continued

Human Anti-C5 DsiRNAs Predicted to have >50% Knockdown Efficacy (Asymmetrics)

C5-4778 Target:
5'-TGTCAAGTACAAGGCAACCCTTCTGGA-3'
(SEQ ID NO: 10073)

5'-CAAGUACAAGGCAACCCUUCUGGat-3' (SEQ ID NO: 5454)

3'-CAGUUCAUGUUCCGUUGGGAAGACCUA-5' (SEQ ID NO: 7764)

C5-4779 Target:
5'-GTCAAGTACAAGGCAACCCTTCTGGAT-3'
(SEQ ID NO: 10074)

5'-AAGUACAAGGCAACCCUUCUGGAta-3' (SEQ ID NO: 5455)

3'-AGUUCAUGUUCCGUUGGGAAGACCUAU-5' (SEQ ID NO: 7765)

C5-4780 Target:
5'-TCAAGTACAAGGCAACCCTTCTGGATA-3'
(SEQ ID NO: 10075)

5'-AGUACAAGGCAACCCUUCUGGAUat-3' (SEQ ID NO: 5456)

3'-GUUCAUGUUCCGUUGGGAAGACCUAUA-5' (SEQ ID NO: 7766)

C5-4781 Target:
5'-CAAGTACAAGGCAACCCTTCTGGATAT-3'
(SEQ ID NO: 10076)

5'-GUACAAGGCAACCCUUCUGGAUAtc-3' (SEQ ID NO: 5457)

3'-UUCAUGUUCCGUUGGGAAGACCUAUAG-5' (SEQ ID NO: 7767)

C5-4782 Target:
5'-AAGTACAAGGCAACCCTTCTGGATATC-3'
(SEQ ID NO: 10077)

5'-UACAAGGCAACCCUUCUGGAUAUct-3' (SEQ ID NO: 5458)

3'-UCAUGUUCCGUUGGGAAGACCUAUAGA-5' (SEQ ID NO: 7768)

C5-4783 Target:
5'-AGTACAAGGCAACCCTTCTGGATATCT-3'
(SEQ ID NO: 10078)

5'-ACAAGGCAACCCUUCUGGAUAUCta-3' (SEQ ID NO: 5459)

3'-CAUGUUCCGUUGGGAAGACCUAUAGAU-5' (SEQ ID NO: 7769)

C5-4784 Target:
5'-GTACAAGGCAACCCTTCTGGATATCTA-3'
(SEQ ID NO: 10079)

5'-CAAGGCAACCCUUCUGGAUAUCUac-3' (SEQ ID NO: 5460)

3'-AUGUUCCGUUGGGAAGACCUAUAGAUG-5' (SEQ ID NO: 7770)

C5-4785 Target:
5'-TACAAGGCAACCCTTCTGGATATCTAC-3'
(SEQ ID NO: 10080)

5'-AAGGCAACCCUUCUGGAUAUCUAca-3' (SEQ ID NO: 5461)

3'-UGUUCCGUUGGGAAGACCUAUAGAUGU-5' (SEQ ID NO: 7771)

C5-4786 Target:
5'-ACAAGGCAACCCTTCTGGATATCTACA-3'
(SEQ ID NO: 10081)

5'-AGGCAACCCUUCUGGAUAUCUACaa-3' (SEQ ID NO: 5462)

3'-GUUCCGUUGGGAAGACCUAUAGAUGUU-5' (SEQ ID NO: 7772)

TABLE 7-continued

Human Anti-C5 DsiRNAs Predicted to have >50%
Knockdown Efficacy (Asymmetrics)

C5-4787 Target:
5'-CAAGGCAACCCTTCTGGATATCTACAA-3'
(SEQ ID NO: 10082)

5'-GGCAACCCUUCUGGAUAUCUACAaa-3' (SEQ ID NO: 5463)

3'-UUCCGUUGGGAAGACCUAUAGAUGUUU-5' (SEQ ID NO: 7773)

C5-4788 Target:
5'-AAGGCAACCCTTCTGGATATCTACAAA-3'
(SEQ ID NO: 10083)

5'-GCAACCCUUCUGGAUAUCUACAAAaa-3' (SEQ ID NO: 5464)

3'-UCCGUUGGGAAGACCUAUAGAUGUUUU-5' (SEQ ID NO: 7774)

C5-4789 Target:
5'-AGGCAACCCTTCTGGATATCTACAAAA-3'
(SEQ ID NO: 10084)

5'-CAACCCUUCUGGAUAUCUACAAAac-3' (SEQ ID NO: 5465)

3'-CCGUUGGGAAGACCUAUAGAUGUUUUG-5' (SEQ ID NO: 7775)

C5-4790 Target:
5'-GGCAACCCTTCTGGATATCTACAAAAC-3'
(SEQ ID NO: 10085)

5'-AACCCUUCUGGAUAUCUACAAAAct-3' (SEQ ID NO: 5466)

3'-CGUUGGGAAGACCUAUAGAUGUUUUGA-5' (SEQ ID NO: 7776)

C5-4791 Target:
5'-GCAACCCTTCTGGATATCTACAAAACT-3'
(SEQ ID NO: 10086)

5'-ACCCUUCUGGAUAUCUACAAAACtg-3' (SEQ ID NO: 5467)

3'-GUUGGGAAGACCUAUAGAUGUUUUGAC-5' (SEQ ID NO: 7777)

C5-4792 Target:
5'-CAACCCTTCTGGATATCTACAAAACTG-3'
(SEQ ID NO: 10087)

5'-CCCUUCUGGAUAUCUACAAAACUgg-3' (SEQ ID NO: 5468)

3'-UUGGGAAGACCUAUAGAUGUUUUGACC-5' (SEQ ID NO: 7778)

C5-4793 Target:
5'-AACCCTTCTGGATATCTACAAAACTGG-3'
(SEQ ID NO: 10088)

5'-CCUUCUGGAUAUCUACAAAACUGgg-3' (SEQ ID NO: 5469)

3'-UGGGAAGACCUAUAGAUGUUUUGACCC-5' (SEQ ID NO: 7779)

C5-4794 Target:
5'-ACCCTTCTGGATATCTACAAAACTGGG-3'
(SEQ ID NO: 10089)

5'-CUUCUGGAUAUCUACAAAACUGGga-3' (SEQ ID NO: 5470)

3'-GGGAAGACCUAUAGAUGUUUUGACCCC-5' (SEQ ID NO: 7780)

C5-4795 Target:
5'-CCCTTCTGGATATCTACAAAACTGGGG-3'
(SEQ ID NO: 10090)

5'-UUCUGGAUAUCUACAAAACUGGGga-3' (SEQ ID NO: 5471)

3'-GGAAGACCUAUAGAUGUUUUGACCCCU-5' (SEQ ID NO: 7781)

C5-4796 Target:
5'-CCTTCTGGATATCTACAAAACTGGGGA-3'
(SEQ ID NO: 10091)

5'-UCUGGAUAUCUACAAAACUGGGGaa-3' (SEQ ID NO: 5472)

3'-GAAGACCUAUAGAUGUUUUGACCCCUU-5' (SEQ ID NO: 7782)

C5-4797 Target:
5'-CTTCTGGATATCTACAAAACTGGGGAA-3'
(SEQ ID NO: 10092)

5'-CUGGAUAUCUACAAAACUGGGGAag-3' (SEQ ID NO: 5473)

3'-AAGACCUAUAGAUGUUUUGACCCCUUC-5' (SEQ ID NO: 7783)

C5-4798 Target:
5'-TTCTGGATATCTACAAAACTGGGGAAG-3'
(SEQ ID NO: 10093)

5'-UGGAUAUCUACAAAACUGGGGAAgc-3' (SEQ ID NO: 5474)

3'-AGACCUAUAGAUGUUUUGACCCCUUCG-5' (SEQ ID NO: 7784)

C5-4799 Target:
5'-TCTGGATATCTACAAAACTGGGGAAGC-3'
(SEQ ID NO: 10094)

5'-GGAUAUCUACAAAACUGGGGAAGct-3' (SEQ ID NO: 5475)

3'-GACCUAUAGAUGUUUUGACCCCUUCGA-5' (SEQ ID NO: 7785)

C5-4800 Target:
5'-CTGGATATCTACAAAACTGGGGAAGCT-3'
(SEQ ID NO: 10095)

5'-GAUAUCUACAAAACUGGGGAAGCtg-3' (SEQ ID NO: 5476)

3'-ACCUAUAGAUGUUUUGACCCCUUCGAC-5' (SEQ ID NO: 7786)

C5-4801 Target:
5'-TGGATATCTACAAAACTGGGGAAGCTG-3'
(SEQ ID NO: 10096)

5'-AUAUCUACAAAACUGGGGAAGCUgt-3' (SEQ ID NO: 5477)

3'-CCUAUAGAUGUUUUGACCCCUUCGACA-5' (SEQ ID NO: 7787)

C5-4802 Target:
5'-GGATATCTACAAAACTGGGGAAGCTGT-3'
(SEQ ID NO: 10097)

5'-UAUCUACAAAACUGGGGAAGCUGtt-3' (SEQ ID NO: 5478)

3'-CUAUAGAUGUUUUGACCCCUUCGACAA-5' (SEQ ID NO: 7788)

C5-4803 Target:
5'-GATATCTACAAAACTGGGGAAGCTGTT-3'
(SEQ ID NO: 10098)

5'-AUCUACAAAACUGGGGAAGCUGUtg-3' (SEQ ID NO: 5479)

3'-UAUAGAUGUUUUGACCCCUUCGACAAC-5' (SEQ ID NO: 7789)

C5-4804 Target:
5'-ATATCTACAAAACTGGGGAAGCTGTTG-3'
(SEQ ID NO: 10099)

5'-UCUACAAAACUGGGGAAGCUGUUgc-3' (SEQ ID NO: 5480)

3'-AUAGAUGUUUUGACCCCUUCGACAACG-5' (SEQ ID NO: 7790)

TABLE 7-continued

Human Anti-C5 DsiRNAs Predicted to have >50% Knockdown Efficacy (Asymmetrics)

C5-4805 Target:
5'-TATCTACAAAACTGGGGAAGCTGTTGC-3'
(SEQ ID NO: 10100)

5'-CUACAAAACUGGGGAAGCUGUUGct-3' (SEQ ID NO: 5481)

3'-UAGAUGUUUUGACCCCUUCGACAACGA-5' (SEQ ID NO: 7791)

C5-4806 Target:
5'-ATCTACAAAACTGGGGAAGCTGTTGCT-3'
(SEQ ID NO: 10101)

5'-UACAAAACUGGGGAAGCUGUUGCtg-3' (SEQ ID NO: 5482)

3'-AGAUGUUUUGACCCCUUCGACAACGAC-5' (SEQ ID NO: 7792)

C5-4807 Target:
5'-TCTACAAAACTGGGGAAGCTGTTGCTG-3'
(SEQ ID NO: 10102)

5'-ACAAAACUGGGGAAGCUGUUGCUga-3' (SEQ ID NO: 5483)

3'-GAUGUUUUGACCCCUUCGACAACGACU-5' (SEQ ID NO: 7793)

C5-4808 Target:
5'-CTACAAAACTGGGGAAGCTGTTGCTGA-3'
(SEQ ID NO: 10103)

5'-CAAAACUGGGGAAGCUGUUGCUGag-3' (SEQ ID NO: 5484)

3'-AUGUUUUGACCCCUUCGACAACGACUC-5' (SEQ ID NO: 7794)

C5-4809 Target:
5'-TACAAAACTGGGGAAGCTGTTGCTGAG-3'
(SEQ ID NO: 10104)

5'-AAAACUGGGGAAGCUGUUGCUGAga-3' (SEQ ID NO: 5485)

3'-UGUUUUGACCCCUUCGACAACGACUCU-5' (SEQ ID NO: 7795)

C5-4810 Target:
5'-ACAAAACTGGGGAAGCTGTTGCTGAGA-3'
(SEQ ID NO: 10105)

5'-AAACUGGGGAAGCUGUUGCUGAGaa-3' (SEQ ID NO: 5486)

3'-GUUUUGACCCCUUCGACAACGACUCUU-5' (SEQ ID NO: 7796)

C5-4811 Target:
5'-CAAAACTGGGGAAGCTGTTGCTGAGAA-3'
(SEQ ID NO: 10106)

5'-AACUGGGGAAGCUGUUGCUGAGAaa-3' (SEQ ID NO: 5487)

3'-UUUUGACCCCUUCGACAACGACUCUUU-5' (SEQ ID NO: 7797)

C5-4812 Target:
5'-AAAACTGGGGAAGCTGTTGCTGAGAAA-3'
(SEQ ID NO: 10107)

5'-ACUGGGGAAGCUGUUGCUGAGAAag-3' (SEQ ID NO: 5488)

3'-UUUGACCCCUUCGACAACGACUCUUUC-5' (SEQ ID NO: 7798)

C5-4813 Target:
5'-AAACTGGGGAAGCTGTTGCTGAGAAAG-3'
(SEQ ID NO: 10108)

5'-CUGGGGAAGCUGUUGCUGAGAAAGa-3' (SEQ ID NO: 5489)

3'-UUGACCCCUUCGACAACGACUCUUUCU-5' (SEQ ID NO: 7799)

C5-4814 Target:
5'-AACTGGGGAAGCTGTTGCTGAGAAAGA-3'
(SEQ ID NO: 10109)

5'-ACCUUCAUUAAAAAGGUAACCUGta-3' (SEQ ID NO: 5490)

3'-AAUGGAAGUAAUUUUUCCAUUGGACAU-5' (SEQ ID NO: 7800)

C5-4849 Target:
5'-TTACCTTCATTAAAAAGGTAACCTGTA-3'
(SEQ ID NO: 10110)

5'-CCUUCAUUAAAAAGGUAACCUGUac-3' (SEQ ID NO: 5491)

3'-AUGGAAGUAAUUUUUCCAUUGGACAUG-5' (SEQ ID NO: 7801)

C5-4850 Target:
5'-TACCTTCATTAAAAAGGTAACCTGTAC-3'
(SEQ ID NO: 10111)

5'-CUUCAUUAAAAAGGUAACCUGUAct-3' (SEQ ID NO: 5492)

3'-UGGAAGUAAUUUUUCCAUUGGACAUGA-5' (SEQ ID NO: 7802)

C5-4851 Target:
5'-ACCTTCATTAAAAAGGTAACCTGTACT-3'
(SEQ ID NO: 10112)

5'-UUCAUUAAAAAGGUAACCUGUACta-3' (SEQ ID NO: 5493)

3'-GGAAGUAAUUUUUCCAUUGGACAUGAU-5' (SEQ ID NO: 7803)

C5-4852 Target:
5'-CCTTCATTAAAAAGGTAACCTGTACTA-3'
(SEQ ID NO: 10113)

5'-UCAUUAAAAAGGUAACCUGUACUaa-3' (SEQ ID NO: 5494)

3'-GAAGUAAUUUUUCCAUUGGACAUGAUU-5' (SEQ ID NO: 7804)

C5-4853 Target:
5'-CTTCATTAAAAAGGTAACCTGTACTAA-3'
(SEQ ID NO: 10114)

5'-AAAGGAAGACAGUACUUAAUUAUgg-3' (SEQ ID NO: 5495)

3'-AUUUUCCUUCUGUCAUGAAUUAAUACC-5' (SEQ ID NO: 7805)

C5-4891 Target:
5'-TAAAAGGAAGACAGTACTTAATTATGG-3'
(SEQ ID NO: 10115)

5'-AAGGAAGACAGUACUUAAUUAUGgg-3' (SEQ ID NO: 5496)

3'-UUUUCCUUCUGUCAUGAAUUAAUACCC-5' (SEQ ID NO: 7806)

C5-4892 Target:
5'-AAAAGGAAGACAGTACTTAATTATGGG-3'
(SEQ ID NO: 10116)

5'-AGGAAGACAGUACUUAAUUAUGGgt-3' (SEQ ID NO: 5497)

3'-UUUCCUUCUGUCAUGAAUUAAUACCCA-5' (SEQ ID NO: 7807)

C5-4893 Target:
5'-AAAGGAAGACAGTACTTAATTATGGGT-3'
(SEQ ID NO: 10117)

5'-GGAAGACAGUACUUAAUUAUGGGta-3' (SEQ ID NO: 5498)

3'-UUCCUUCUGUCAUGAAUUAAUACCCAU-5' (SEQ ID NO: 7808)

TABLE 7-continued

Human Anti-C5 DsiRNAs Predicted to have >50% Knockdown Efficacy (Asymmetrics)

C5-4894 Target:
5'-AAGGAAGACAGTACTTAATTATGGGTA-3'
(SEQ ID NO: 10118)

5'-G<u>A</u><u>AG</u>ACAGUACUUA<u>A</u>UUAUGGGUaa-3' (SEQ ID NO: 5499)

3'-<u>U</u>CC<u>UU</u>C<u>U</u>GUCAUGA<u>AU</u>UAAUACCC<u>C</u>AUU-5' (SEQ ID NO: 7809)

C5-4895 Target:
5'-AGGAAGACAGTACTTAATTATGGGTAA-3'
(SEQ ID NO: 10119)

5'-A<u>AG</u>ACAGUACUUA<u>A</u>UU<u>A</u>UGGGUAaa-3' (SEQ ID NO: 5500)

3'-<u>C</u>C<u>UU</u>C<u>U</u>GUCAUGAAUU<u>A</u>AUACCC<u>A</u>UUU-5' (SEQ ID NO: 7810)

C5-4896 Target:
5'-GGAAGACAGTACTTAATTATGGGTAAA-3'
(SEQ ID NO: 10120)

5'-<u>A</u>G<u>A</u>CAGUACUUA<u>A</u>UU<u>A</u>UGGGUAAag-3' (SEQ ID NO: 5501)

3'-<u>C</u>U<u>UC</u>U<u>G</u>UCAUGAAUU<u>A</u>AUACCC<u>A</u>UUUC-5' (SEQ ID NO: 7811)

C5-4897 Target:
5'-GAAGACAGTACTTAATTATGGGTAAAG-3'
(SEQ ID NO: 10121)

5'-G<u>A</u>CAGUACUUA<u>A</u>UU<u>A</u>UGGGUAAAga-3' (SEQ ID NO: 5502)

3'-<u>U</u>U<u>C</u>U<u>G</u>UCAUGAAUU<u>A</u>AUACCC<u>A</u>UUUCU-5' (SEQ ID NO: 7812)

C5-4898 Target:
5'-AAGACAGTACTTAATTATGGGTAAAGA-3'
(SEQ ID NO: 10122)

5'-<u>C</u>U<u>CC</u>AGAUAAAAU<u>A</u>C<u>A</u>AUUUCAGtt-3' (SEQ ID NO: 5503)

3'-<u>GGG</u>A<u>GG</u>UCUAUUUU<u>A</u>U<u>G</u>UUAAAG<u>U</u>CAA-5' (SEQ ID NO: 7813)

C5-4927 Target:
5'-CCCTCCAGATAAAATACAATTTCAGTT-3'
(SEQ ID NO: 10123)

5'-U<u>CC</u>AGAUAAAAUAC<u>A</u>AUUUCAGUtt-3' (SEQ ID NO: 5504)

3'-<u>GG</u>A<u>GG</u>UCUAUUUUAU<u>G</u>UUAAAGUC<u>A</u>AA-5' (SEQ ID NO: 7814)

C5-4928 Target:
5'-CCTCCAGATAAAATACAATTTCAGTTT-3'
(SEQ ID NO: 10124)

5'-<u>C</u>AGAUAAAAUAC<u>A</u>AU<u>U</u>UCAGUUUca-3' (SEQ ID NO: 5505)

3'-<u>AGG</u>U<u>C</u>UAUUUUAUG<u>U</u>UA<u>A</u>AGUCA<u>A</u>AGU-5' (SEQ ID NO: 7815)

C5-4930 Target:
5'-TCCAGATAAAATACAATTTCAGTTTCA-3'
(SEQ ID NO: 10125)

5'-<u>U</u>U<u>U</u>CAGGUACAUCU<u>A</u>CCCUUUAGat-3' (SEQ ID NO: 5506)

3'-<u>U</u>CAAAGUCCAUGUAG<u>A</u>UGGGAAAU<u>C</u>UA-5' (SEQ ID NO: 7816)

C5-4950 Target:
5'-AGTTTCAGGTACATCTACCCTTTAGAT-3'
(SEQ ID NO: 10126)

5'-<u>UU</u>C<u>A</u>GGUACAUCUA<u>CC</u>CUUUAGAtt-3' (SEQ ID NO: 5507)

3'-<u>C</u>AAAGUCCAUGUAGA<u>UGG</u>GAAAUCUAA-5' (SEQ ID NO: 7817)

TABLE 7-continued

Human Anti-C5 DsiRNAs Predicted to have >50% Knockdown Efficacy (Asymmetrics)

C5-4951 Target:
5'-GTTTCAGGTACATCTACCCTTTAGATT-3'
(SEQ ID NO: 10127)

5'-<u>U</u>C<u>A</u>GGUACAUCUA<u>CCC</u>UUUAGAUtc-3' (SEQ ID NO: 5508)

3'-<u>AAA</u>GUCCAUGUAGA<u>U</u>GGGAAAUC<u>U</u>AAG-5' (SEQ ID NO: 7818)

C5-4952 Target:
5'-TTTCAGGTACATCTACCCTTTAGATTC-3'
(SEQ ID NO: 10128)

5'-C<u>A</u>GGUACAUCUAC<u>CC</u>UUUAGAUUcc-3' (SEQ ID NO: 5509)

3'-<u>A</u>AGUCCAUGUAGAU<u>GGG</u>AAAUCU<u>A</u>AGG-5' (SEQ ID NO: 7819)

C5-4953 Target:
5'-TTCAGGTACATCTACCCTTTAGATTCC-3'
(SEQ ID NO: 10129)

5'-<u>A</u>GGUACAUCUACC<u>C</u>UUUAGAUUCct-3' (SEQ ID NO: 5510)

3'-<u>A</u>GUCCAUGUAGAUGG<u>G</u>AAAUCUA<u>A</u>GGA-5' (SEQ ID NO: 7820)

C5-4954 Target:
5'-TCAGGTACATCTACCCTTTAGATTCCT-3'
(SEQ ID NO: 10130)

5'-<u>GG</u>U<u>A</u>CAUCUACCC<u>U</u>UUAGAUUCCtt-3' (SEQ ID NO: 5511)

3'-<u>G</u>UC<u>C</u>AUGUAGAUGGG<u>A</u>AAUCUAAG<u>G</u>AA-5' (SEQ ID NO: 7821)

C5-4955 Target:
5'-CAGGTACATCTACCCTTTAGATTCCTT-3'
(SEQ ID NO: 10131)

5'-<u>G</u>U<u>A</u>CAUCUACCCU<u>UU</u>AGAUUCCUtg-3' (SEQ ID NO: 5512)

3'-<u>U</u>CC<u>A</u>UGUAGAUGGGA<u>A</u>AUCUAAGG<u>A</u>AC-5' (SEQ ID NO: 7822)

C5-4956 Target:
5'-AGGTACATCTACCCTTTAGATTCCTTG-3'
(SEQ ID NO: 10132)

5'-<u>U</u>AC<u>A</u>UCUACCCUU<u>U</u>AGAUUCCUUga-3' (SEQ ID NO: 5513)

3'-<u>CC</u>A<u>U</u>GUAGAUGGGA<u>A</u>AUCUAAGG<u>AAC</u>U-5' (SEQ ID NO: 7823)

C5-4957 Target:
5'-GGTACATCTACCCTTTAGATTCCTTGA-3'
(SEQ ID NO: 10133)

5'-<u>A</u>C<u>A</u>UCUACCCUUU<u>A</u>G<u>A</u>UUCCUUGac-3' (SEQ ID NO: 5514)

3'-<u>C</u>A<u>U</u>GUAGAUGGGAA<u>A</u>U<u>C</u>UAAGGAACUG-5' (SEQ ID NO: 7824)

C5-4958 Target:
5'-GTACATCTACCCTTTAGATTCCTTGAC-3'
(SEQ ID NO: 10134)

5'-<u>C</u>A<u>U</u>CUACCCUUUAG<u>A</u>UUCCUUGAcc-3' (SEQ ID NO: 5515)

3'-<u>A</u>UGUAGAUGGGAAAUCUAAGGAACUGG-5' (SEQ ID NO: 7825)

C5-4959 Target:
5'-TACATCTACCCTTTAGATTCCTTGACC-3'
(SEQ ID NO: 10135)

5'-<u>A</u>UCUACCCUUUAG<u>A</u>UUCCUUGACct-3' (SEQ ID NO: 5516)

3'-<u>U</u>GUAGAUGGGAAAUC<u>U</u>AAGGAACUGGA-5' (SEQ ID NO: 7826)

TABLE 7-continued

Human Anti-C5 DsiRNAs Predicted to have >50% Knockdown Efficacy (Asymmetrics)

C5-4960 Target:
5'-ACATCTACCCTTTAGATTCCTTGACCT-3'
(SEQ ID NO: 10136)

5'-UCUACCCUUUAGAUUCCUUGACCCtg-3' (SEQ ID NO: 5517)

3'-GUAGAUGGGAAAUCUAAGGAACUGGAC-5' (SEQ ID NO: 7827)

C5-4961 Target:
5'-CATCTACCCTTTAGATTCCTTGACCTG-3'
(SEQ ID NO: 10137)

5'-CUACCCUUUAGAUUCCUUGACCUgg-3' (SEQ ID NO: 5518)

3'-UAGAUGGGAAAUCUAAGGAACUGGACC-5' (SEQ ID NO: 7828)

C5-4962 Target:
5'-ATCTACCCTTTAGATTCCTTGACCTGG-3'
(SEQ ID NO: 10138)

5'-UACCCUUUAGAUUCCUUGACCUGga-3' (SEQ ID NO: 5519)

3'-AGAUGGGAAAUCUAAGGAACUGGACCU-5' (SEQ ID NO: 7829)

C5-4963 Target:
5'-TCTACCCTTTAGATTCCTTGACCTGGA-3'
(SEQ ID NO: 10139)

5'-ACCCUUUAGAUUCCUUGACCUGGat-3' (SEQ ID NO: 5520)

3'-GAUGGGAAAUCUAAGGAACUGGACCUA-5' (SEQ ID NO: 7830)

C5-4964 Target:
5'-CTACCCTTTAGATTCCTTGACCTGGAT-3'
(SEQ ID NO: 10140)

5'-CCCUUUAGAUUCCUUGACCUGGAtt-3' (SEQ ID NO: 5521)

3'-AUGGGAAAUCUAAGGAACUGGACCUAA-5' (SEQ ID NO: 7831)

C5-4965 Target:
5'-TACCCTTTAGATTCCTTGACCTGGATT-3'
(SEQ ID NO: 10141)

5'-CCUUUAGAUUCCUUGACCUGGAUtg-3' (SEQ ID NO: 5522)

3'-UGGGAAAUCUAAGGAACUGGACCUAAC-5' (SEQ ID NO: 7832)

C5-4966 Target:
5'-ACCCTTTAGATTCCTTGACCTGGATTG-3'
(SEQ ID NO: 10142)

5'-CUUUAGAUUCCUUGACCUGGAUUga-3' (SEQ ID NO: 5523)

3'-GGGAAAUCUAAGGAACUGGACCUAACU-5' (SEQ ID NO: 7833)

C5-4967 Target:
5'-CCCTTTAGATTCCTTGACCTGGATTGA-3'
(SEQ ID NO: 10143)

5'-UUUAGAUUCCUUGACCUGGAUUGaa-3' (SEQ ID NO: 5524)

3'-GGAAAUCUAAGGAACUGGACCUAACUU-5' (SEQ ID NO: 7834)

C5-4968 Target:
5'-CCTTTAGATTCCTTGACCTGGATTGAA-3'
(SEQ ID NO: 10144)

5'-UUAGAUUCCUUGACCUGGAUUGAat-3' (SEQ ID NO: 5525)

3'-GAAAUCUAAGGAACUGGACCUAACUUA-5' (SEQ ID NO: 7835)

C5-4969 Target:
5'-CTTTAGATTCCTTGACCTGGATTGAAT-3'
(SEQ ID NO: 10145)

5'-UAGAUUCCUUGACCUGGAUUGAAta-3' (SEQ ID NO: 5526)

3'-AAAUCUAAGGAACUGGACCUAACUUAU-5' (SEQ ID NO: 7836)

C5-4970 Target:
5'-TTTAGATTCCTTGACCTGGATTGAATA-3'
(SEQ ID NO: 10146)

5'-AGAUUCCUUGACCUGGAUUGAAUac-3' (SEQ ID NO: 5527)

3'-AAUCUAAGGAACUGGACCUAACUUAUG-5' (SEQ ID NO: 7837)

C5-4971 Target:
5'-TTAGATTCCTTGACCTGGATTGAATAC-3'
(SEQ ID NO: 10147)

5'-GAUUCCUUGACCUGGAUUGAAUAct-3' (SEQ ID NO: 5528)

3'-AUCUAAGGAACUGGACCUAACUUAUGA-5' (SEQ ID NO: 7838)

C5-4972 Target:
5'-TAGATTCCTTGACCTGGATTGAATACT-3'
(SEQ ID NO: 10148)

5'-AUUCCUUGACCUGGAUUGAAUACtg-3' (SEQ ID NO: 5529)

3'-UCUAAGGAACUGGACCUAACUUAUGAC-5' (SEQ ID NO: 7839)

C5-4973 Target:
5'-AGATTCCTTGACCTGGATTGAATACTG-3'
(SEQ ID NO: 10149)

5'-UUCCUUGACCUGGAUUGAAUACUgg-3' (SEQ ID NO: 5530)

3'-CUAAGGAACUGGACCUAACUUAUGACC-5' (SEQ ID NO: 7840)

C5-4974 Target:
5'-GATTCCTTGACCTGGATTGAATACTGG-3'
(SEQ ID NO: 10150)

5'-UCCUUGACCUGGAUUGAAUACUGgc-3' (SEQ ID NO: 5531)

3'-UAAGGAACUGGACCUAACUUAUGACCG-5' (SEQ ID NO: 7841)

C5-4975 Target:
5'-ATTCCTTGACCTGGATTGAATACTGGC-3'
(SEQ ID NO: 10151)

5'-CCUUGACCUGGAUUGAAUACUGGcc-3' (SEQ ID NO: 5532)

3'-AAGGAACUGGACCUAACUUAUGACCGG-5' (SEQ ID NO: 7842)

C5-4976 Target:
5'-TTCCTTGACCTGGATTGAATACTGGCC-3'
(SEQ ID NO: 10152)

5'-CUUGACCUGGAUUGAAUACUGGCct-3' (SEQ ID NO: 5533)

3'-AGGAACUGGACCUAACUUAUGACCGGA-5' (SEQ ID NO: 7843)

C5-4977 Target:
5'-TCCTTGACCTGGATTGAATACTGGCCT-3'
(SEQ ID NO: 10153)

5'-UUGACCUGGAUUGAAUACUGGCCta-3' (SEQ ID NO: 5534)

3'-GGAACUGGACCUAACUUAUGACCGGAU-5' (SEQ ID NO: 7844)

TABLE 7-continued

Human Anti-C5 DsiRNAs Predicted to have >50% Knockdown Efficacy (Asymmetrics)

C5-4978 Target:
5'-CCTTGACCTGGATTGAATACTGGCCTA-3'
(SEQ ID NO: 10154)

5'-UGACCUGGAUUGAAUACUGGCCUag-3' (SEQ ID NO: 5535)

3'-GAACUGGACCUAACUUAUGACCGGAUC-5' (SEQ ID NO: 7845)

C5-4979 Target:
5'-CTTGACCTGGATTGAATACTGGCCTAG-3'
(SEQ ID NO: 10155)

5'-GACCUGGAUUGAAUACUGGCCUAga-3' (SEQ ID NO: 5536)

3'-AACUGGACCUAACUUAUGACCGGAUCU-5' (SEQ ID NO: 7846)

C5-4980 Target:
5'-TTGACCTGGATTGAATACTGGCCTAGA-3'
(SEQ ID NO: 10156)

5'-ACCUGGAUUGAAUACUGGCCUAGag-3' (SEQ ID NO: 5537)

3'-ACUGGACCUAACUUAUGACCGGAUCUC-5' (SEQ ID NO: 7847)

C5-4981 Target:
5'-TGACCTGGATTGAATACTGGCCTAGAG-3'
(SEQ ID NO: 10157)

5'-CCUGGAUUGAAUACUGGCCUAGAga-3' (SEQ ID NO: 5538)

3'-CUGGACCUAACUUAUGACCGGAUCUCU-5' (SEQ ID NO: 7848)

C5-4982 Target:
5'-GACCTGGATTGAATACTGGCCTAGAGA-3'
(SEQ ID NO: 10158)

5'-CUGGAUUGAAUACUGGCCUAGAGac-3' (SEQ ID NO: 5539)

3'-UGGACCUAACUUAUGACCGGAUCUCUG-5' (SEQ ID NO: 7849)

C5-4983 Target:
5'-ACCTGGATTGAATACTGGCCTAGAGAC-3'
(SEQ ID NO: 10159)

5'-UGGAUUGAAUACUGGCCUAGAGAca-3' (SEQ ID NO: 5540)

3'-GGACCUAACUUAUGACCGGAUCUCUGU-5' (SEQ ID NO: 7850)

C5-4984 Target:
5'-CCTGGATTGAATACTGGCCTAGAGACA-3'
(SEQ ID NO: 10160)

5'-GGAUUGAAUACUGGCCUAGAGACac-3' (SEQ ID NO: 5541)

3'-GACCUAACUUAUGACCGGAUCUCUGUG-5' (SEQ ID NO: 7851)

C5-4985 Target:
5'-CTGGATTGAATACTGGCCTAGAGACAC-3'
(SEQ ID NO: 10161)

5'-CAACAUGUUCAUCGUGUCAAGCAUtt-3' (SEQ ID NO: 5542)

3'-GUGUUGUACAAGUAGCACAGUUCGUAA-5' (SEQ ID NO: 7852)

C5-5009 Target:
5'-CACAACATGTTCATCGTGTCAAGCATT-3'
(SEQ ID NO: 10162)

5'-AACAUGUUCAUCGUGUCAAGCAUtt-3' (SEQ ID NO: 5543)

3'-UGUUGUACAAGUAGCACAGUUCGUAAA-5' (SEQ ID NO: 7853)

C5-5010 Target:
5'-ACAACATGTTCATCGTGTCAAGCATTT-3'
(SEQ ID NO: 10163)

5'-ACAUGUUCAUCGUGUCAAGCAUUtt-3' (SEQ ID NO: 5544)

3'-GUUGUACAAGUAGCACAGUUCGUAAAA-5' (SEQ ID NO: 7854)

C5-5011 Target:
5'-CAACATGTTCATCGTGTCAAGCATTTT-3'
(SEQ ID NO: 10164)

5'-CAUGUUCAUCGUGUCAAGCAUUUtt-3' (SEQ ID NO: 5545)

3'-UUGUACAAGUAGCACAGUUCGUAAAAA-5' (SEQ ID NO: 7855)

C5-5012 Target:
5'-AACATGTTCATCGTGTCAAGCATTTTT-3'
(SEQ ID NO: 10165)

5'-UGUUCAUCGUGUCAAGCAUUUUUag-3' (SEQ ID NO: 5546)

3'-GUACAAGUAGCACAGUUCGUAAAAAUC-5' (SEQ ID NO: 7856)

C5-5014 Target:
5'-CATGTTCATCGTGTCAAGCATTTTTAG-3'
(SEQ ID NO: 10166)

5'-GUUCAUCGUGUCAAGCAUUUUUAgc-3' (SEQ ID NO: 5547)

3'-UACAAGUAGCACAGUUCGUAAAAAUCG-5' (SEQ ID NO: 7857)

C5-5015 Target:
5'-ATGTTCATCGTGTCAAGCATTTTTAGC-3'
(SEQ ID NO: 10167)

5'-UUCAUCGUGUCAAGCAUUUUUAGct-3' (SEQ ID NO: 5548)

3'-ACAAGUAGCACAGUUCGUAAAAAUCGA-5' (SEQ ID NO: 7858)

C5-5016 Target:
5'-TGTTCATCGTGTCAAGCATTTTTAGCT-3'
(SEQ ID NO: 10168)

5'-UCAUCGUGUCAAGCAUUUUUAGCta-3' (SEQ ID NO: 5549)

3'-CAAGUAGCACAGUUCGUAAAAAUCGAU-5' (SEQ ID NO: 7859)

C5-5017 Target:
5'-GTTCATCGTGTCAAGCATTTTTAGCTA-3'
(SEQ ID NO: 10169)

5'-AUCGUGUCAAGCAUUUUUAGCUAat-3' (SEQ ID NO: 5550)

3'-AGUAGCACAGUUCGUAAAAAUCGAUUA-5' (SEQ ID NO: 7860)

C5-5019 Target:
5'-TCATCGTGTCAAGCATTTTTAGCTAAT-3'
(SEQ ID NO: 10170)

5'-UCGUGUCAAGCAUUUUUAGCUAAtt-3' (SEQ ID NO: 5551)

3'-GUAGCACAGUUCGUAAAAAUCGAUUAA-5' (SEQ ID NO: 7861)

C5-5020 Target:
5'-CATCGTGTCAAGCATTTTTAGCTAATT-3'
(SEQ ID NO: 10171)

5'-CGUGUCAAGCAUUUUUAGCUAAUt-3' (SEQ ID NO: 5552)

3'-UAGCACAGUUCGUAAAAAUCGAUUAAA-5' (SEQ ID NO: 7862)

TABLE 7-continued

Human Anti-C5 DsiRNAs Predicted to have >50% Knockdown Efficacy (Asymmetrics)

C5-5021 Target:
5'-ATCGTGTCAAGCATTTTTAGCTAATTT-3'
(SEQ ID NO: 10172)

5'-UGUCAAGCAUUUUUAGCUAAUUUag-3' (SEQ ID NO: 5553)

3'-GCACAGUUCGUAAAAAUCGAUUAAAUC-5' (SEQ ID NO: 7863)

C5-5023 Target:
5'-CGTGTCAAGCATTTTTAGCTAATTTAG-3'
(SEQ ID NO: 10173)

5'-GUCAAGCAUUUUUAGCUAAUUUAga-3' (SEQ ID NO: 5554)

3'-CACAGUUCGUAAAAAUCGAUUAAAUCU-5' (SEQ ID NO: 7864)

C5-5024 Target:
5'-GTGTCAAGCATTTTTAGCTAATTTAGA-3'
(SEQ ID NO: 10174)

5'-UCAAGCAUUUUUAGCUAAUUUAGat-3' (SEQ ID NO: 5555)

3'-ACAGUUCGUAAAAAUCGAUUAAAUCUA-5' (SEQ ID NO: 7865)

C5-5025 Target:
5'-TGTCAAGCATTTTTAGCTAATTTAGAT-3'
(SEQ ID NO: 10175)

5'-CAAGCAUUUUUAGCUAAUUUAGAtg-3' (SEQ ID NO: 5556)

3'-CAGUUCGUAAAAAUCGAUUAAAUCUAC-5' (SEQ ID NO: 7866)

C5-5026 Target:
5'-GTCAAGCATTTTTAGCTAATTTAGATG-3'
(SEQ ID NO: 10176)

5'-AGCAUUUUUAGCUAAUUUAGAUGaa-3' (SEQ ID NO: 5557)

3'-GUUCGUAAAAAUCGAUUAAAUCUACUU-5' (SEQ ID NO: 7867)

C5-5028 Target:
5'-CAAGCATTTTTAGCTAATTTAGATGAA-3'
(SEQ ID NO: 10177)

5'-GCAUUUUUAGCUAAUUUAGAUGAat-3' (SEQ ID NO: 5558)

3'-UUCGUAAAAAUCGAUUAAAUCUACUUA-5' (SEQ ID NO: 7868)

C5-5029 Target:
5'-AAGCATTTTTAGCTAATTTAGATGAAT-3'
(SEQ ID NO: 10178)

5'-CAUUUUUAGCUAAUUUAGAUGAAtt-3' (SEQ ID NO: 5559)

3'-UCGUAAAAAUCGAUUAAAUCUACUUAA-5' (SEQ ID NO: 7869)

C5-5030 Target:
5'-AGCATTTTTAGCTAATTTAGATGAATT-3'
(SEQ ID NO: 10179)

5'-AUUUUUAGCUAAUUUAGAUGAAUtt-3' (SEQ ID NO: 5560)

3'-CGUAAAAAUCGAUUAAAUCUACUUAAA-5' (SEQ ID NO: 7870)

C5-5031 Target:
5'-GCATTTTTAGCTAATTTAGATGAATTT-3'
(SEQ ID NO: 10180)

5'-UUUUUAGCUAAUUUAGAUGAAUUtg-3' (SEQ ID NO: 5561)

3'-GUAAAAAUCGAUUAAAUCUACUUAAAC-5' (SEQ ID NO: 7871)

TABLE 7-continued

Human Anti-C5 DsiRNAs Predicted to have >50% Knockdown Efficacy (Asymmetrics)

C5-5032 Target:
5'-CATTTTTAGCTAATTTAGATGAATTTG-3'
(SEQ ID NO: 10181)

5'-UUUUAGCUAAUUUAGAUGAAUUUgc-3' (SEQ ID NO: 5562)

3'-UAAAAAUCGAUUAAAUCUACUUAAACG-5' (SEQ ID NO: 7872)

C5-5033 Target:
5'-ATTTTTAGCTAATTTAGATGAATTTGC-3'
(SEQ ID NO: 10182)

5'-UUUAGCUAAUUUAGAUGAAUUUGcc-3' (SEQ ID NO: 5563)

3'-AAAAAUCGAUUAAAUCUACUUAAACGG-5' (SEQ ID NO: 7873)

C5-5034 Target:
5'-TTTTTAGCTAATTTAGATGAATTTGCC-3'
(SEQ ID NO: 10183)

5'-UUAGCUAAUUUAGAUGAAUUUGCcg-3' (SEQ ID NO: 5564)

3'-AAAAUCGAUUAAAUCUACUUAAACGGC-5' (SEQ ID NO: 7874)

C5-5035 Target:
5'-TTTTAGCTAATTTAGATGAATTTGCCG-3'
(SEQ ID NO: 10184)

5'-UAGCUAAUUUAGAUGAAUUUGCCga-3' (SEQ ID NO: 5565)

3'-AAAUCGAUUAAAUCUACUUAAACGGCU-5' (SEQ ID NO: 7875)

C5-5036 Target:
5'-TTTAGCTAATTTAGATGAATTTGCCGA-3'
(SEQ ID NO: 10185)

5'-AGCUAAUUUAGAUGAAUUUGCCGaa-3' (SEQ ID NO: 5566)

3'-AAUCGAUUAAAUCUACUUAAACGGCUU-5' (SEQ ID NO: 7876)

C5-5037 Target:
5'-TTAGCTAATTTAGATGAATTTGCCGAA-3'
(SEQ ID NO: 10186)

5'-GCUAAUUUAGAUGAAUUUGCCGAag-3' (SEQ ID NO: 5567)

3'-AUCGAUUAAAUCUACUUAAACGGCUUC-5' (SEQ ID NO: 7877)

C5-5038 Target:
5'-TAGCTAATTTAGATGAATTTGCCGAAG-3'
(SEQ ID NO: 10187)

5'-CUAAUUUAGAUGAAUUUGCCGAAga-3' (SEQ ID NO: 5568)

3'-UCGAUUAAAUCUACUUAAACGGCUUCU-5' (SEQ ID NO: 7878)

C5-5039 Target:
5'-AGCTAATTTAGATGAATTTGCCGAAGA-3'
(SEQ ID NO: 10188)

5'-AUCUUUUUAAAUGGAUGCUAAAAtt-3' (SEQ ID NO: 5569)

3'-UAUAGAAAAAUUUACCUACGAUUUUAA-5' (SEQ ID NO: 7879)

C5-5065 Target:
5'-ATATCTTTTTAAATGGATGCTAAAATT-3'
(SEQ ID NO: 10189)

5'-UCUUUUUAAAUGGAUGCUAAAAUtc-3' (SEQ ID NO: 5570)

3'-AUAGAAAAAUUUACCUACGAUUUUAAG-5' (SEQ ID NO: 7880)

TABLE 7-continued

Human Anti-C5 DsiRNAs Predicted to have >50% Knockdown Efficacy (Asymmetrics)

C5-5066 Target:
5'-TATCTTTTTAAATGGATGCTAAAATTC-3'
(SEQ ID NO: 10190)

5'-CUUUUUAAAUGGAUGCUAAAAUUCcc-3' (SEQ ID NO: 5571)

3'-UAGAAAAAUUUACCUACGAUUUUAAGG-5' (SEQ ID NO: 7881)

C5-5067 Target:
5'-ATCTTTTTAAATGGATGCTAAAATTCC-3'
(SEQ ID NO: 10191)

5'-UUUUUAAAUGGAUGCUAAAAUUCct-3' (SEQ ID NO: 5572)

3'-AGAAAAAUUUACCUACGAUUUUAAGGA-5' (SEQ ID NO: 7882)

C5-5068 Target:
5'-TCTTTTTAAATGGATGCTAAAATTCCT-3'
(SEQ ID NO: 10192)

5'-UUUUAAAUGGAUGCUAAAAUUCCtg-3' (SEQ ID NO: 5573)

3'-GAAAAAUUUACCUACGAUUUUAAGGAC-5' (SEQ ID NO: 7883)

C5-5069 Target:
5'-CTTTTTAAATGGATGCTAAAATTCCTG-3'
(SEQ ID NO: 10193)

5'-UUUAAAUGGAUGCUAAAAUUCCUga-3' (SEQ ID NO: 5574)

3'-AAAAAUUUACCUACGAUUUUAAGGACU-5' (SEQ ID NO: 7884)

C5-5070 Target:
5'-TTTTTAAATGGATGCTAAAATTCCTGA-3'
(SEQ ID NO: 10194)

5'-UUAAAUGGAUGCUAAAAUUCCUGaa-3' (SEQ ID NO: 5575)

3'-AAAAUUUACCUACGAUUUUAAGGACUU-5' (SEQ ID NO: 7885)

C5-5071 Target:
5'-TTTTAAATGGATGCTAAAATTCCTGAA-3'
(SEQ ID NO: 10195)

5'-UAAAUGGAUGCUAAAAUUCCUGAag-3' (SEQ ID NO: 5576)

3'-AAAUUUACCUACGAUUUUAAGGACUUC-5' (SEQ ID NO: 7886)

C5-5072 Target:
5'-TTTAAATGGATGCTAAAATTCCTGAAG-3'
(SEQ ID NO: 10196)

5'-AAAUGGAUGCUAAAAUUCCUGAAgt-3' (SEQ ID NO: 5577)

3'-AAUUUACCUACGAUUUUAAGGACUUCA-5' (SEQ ID NO: 7887)

C5-5073 Target:
5'-TTAAATGGATGCTAAAATTCCTGAAGT-3'
(SEQ ID NO: 10197)

5'-AAUGGAUGCUAAAAUUCCUGAAGtt-3' (SEQ ID NO: 5578)

3'-AUUUACCUACGAUUUUAAGGACUUCAA-5' (SEQ ID NO: 7888)

C5-5074 Target:
5'-TAAATGGATGCTAAAATTCCTGAAGTT-3'
(SEQ ID NO: 10198)

5'-AUGGAUGcUAAAAUUCCUGAAGUtc-3' (SEQ ID NO: 5579)

3'-UUUACCUACGAUUUUAAGGACUUCAAG-5' (SEQ ID NO: 7889)

TABLE 7-continued

Human Anti-C5 DsiRNAs Predicted to have >50% Knockdown Efficacy (Asymmetrics)

C5-5075 Target:
5'-AAATGGATGCTAAAATTCCTGAAGTTC-3'
(SEQ ID NO: 10199)

5'-GGAUGCUAAAAUUCCUGAAGUUCag-3' (SEQ ID NO: 5580)

3'-UACCUACGAUUUUAAGGACUUCAAGUC-5' (SEQ ID NO: 7890)

C5-5077 Target:
5'-ATGGATGCTAAAATTCCTGAAGTTCAG-3'
(SEQ ID NO: 10200)

5'-GAUGCUAAAAUUCCUGAAGUUCAgc-3' (SEQ ID NO: 5581)

3'-ACCUACGAUUUUAAGGACUUCAAGUCG-5' (SEQ ID NO: 7891)

C5-5078 Target:
5'-TGGATGCTAAAATTCCTGAAGTTCAGC-3'
(SEQ ID NO: 10201)

5'-AUGCUAAAAUUCCUGAAGUUCAGct-3' (SEQ ID NO: 5582)

3'-CCUACGAUUUUAAGGACUUCAAGUCGA-5' (SEQ ID NO: 7892)

C5-5079 Target:
5'-GGATGCTAAAATTCCTGAAGTTCAGCT-3'
(SEQ ID NO: 10202)

5'-UGCUAAAAUUCCUGAAGUUCAGCtg-3' (SEQ ID NO: 5583)

3'-CUACGAUUUUAAGGACUUCAAGUCGAC-5' (SEQ ID NO: 7893)

C5-5080 Target:
5'-GATGCTAAAATTCCTGAAGTTCAGCTG-3'
(SEQ ID NO: 10203)

5'-GCUAAAAUUCCUGAAGUUCAGCUgc-3' (SEQ ID NO: 5584)

3'-UACGAUUUUAAGGACUUCAAGUCGACG-5' (SEQ ID NO: 7894)

C5-5081 Target:
5'-ATGCTAAAATTCCTGAAGTTCAGCTGC-3'
(SEQ ID NO: 10204)

5'-CUAAAAUUCCUGAAGUUCAGCUGca-3' (SEQ ID NO: 5585)

3'-ACGAUUUUAAGGACUUCAAGUCGACGU-5' (SEQ ID NO: 7895)

C5-5082 Target:
5'-TGCTAAAATTCCTGAAGTTCAGCTGCA-3'
(SEQ ID NO: 10205)

5'-UAAAAUUCCUGAAGUUCAGCUGCat-3' (SEQ ID NO: 5586)

3'-CGAUUUUAAGGACUUCAAGUCGACGUA-5' (SEQ ID NO: 7896)

C5-5083 Target:
5'-GCTAAAATTCCTGAAGTTCAGCTGCAT-3'
(SEQ ID NO: 10206)

5'-AAAAUUCCUGAAGUUCAGCUGCAta-3' (SEQ ID NO: 5587)

3'-GAUUUUAAGGACUUCAAGUCGACGUAU-5' (SEQ ID NO: 7897)

C5-5084 Target:
5'-CTAAAATTCCTGAAGTTCAGCTGCATA-3'
(SEQ ID NO: 10207)

5'-AAAUUCCUGAAGUUCAGCUGCAUac-3' (SEQ ID NO: 5588)

3'-AUUUUAAGGACUUCAAGUCGACGUAUG-5' (SEQ ID NO: 7898)

TABLE 7-continued

Human Anti-C5 DsiRNAs Predicted to have >50% Knockdown Efficacy (Asymmetrics)

C5-5085 Target:
5'-TAAAATTCCTGAAGTTCAGCTGCATAC-3'
(SEQ ID NO: 10208)

5'-A<u>AU</u>U<u>CC</u>UGAAGUU<u>C</u>AG<u>C</u>UGCAUAca-3' (SEQ ID NO: 5589)

3'-<u>UUUUA</u>AGGACUUC<u>AA</u>G<u>UC</u>GACGU<u>AUGU</u>-5' (SEQ ID NO: 7899)

C5-5086 Target:
5'-AAAATTCCTGAAGTTCAGCTGCATACA-3'
(SEQ ID NO: 10209)

5'-A<u>UU</u>C<u>C</u>UGAAGUUC<u>A</u>G<u>C</u>UGCAUACag-3' (SEQ ID NO: 5590)

3'-<u>UUUA</u>AGGACUUC<u>AA</u>G<u>UC</u>GACGUAUGU<u>C</u>-5' (SEQ ID NO: 7900)

C5-5087 Target:
5'-AAATTCCTGAAGTTCAGCTGCATACAG-3'
(SEQ ID NO: 10210)

5'-<u>UU</u>C<u>C</u>UGAAGUUC<u>A</u>G<u>C</u>UGCAUACAgt-3' (SEQ ID NO: 5591)

3'-<u>UU</u>A<u>A</u>GGACUUC<u>AA</u>G<u>UC</u>G<u>A</u>CGUAUG<u>U</u>C<u>A</u>-5' (SEQ ID NO: 7901)

C5-5088 Target:
5'-AATTCCTGAAGTTCAGCTGCATACAGT-3'
(SEQ ID NO: 10211)

5'-<u>UC</u>C<u>U</u>GAAGUUCAG<u>CU</u>GCAUACAGtt-3' (SEQ ID NO: 5592)

3'-<u>U</u>A<u>A</u>GGACUUCAAG<u>UC</u>GACGUAUGU<u>C</u>AA-5' (SEQ ID NO: 7902)

C5-5089 Target:
5'-ATTCCTGAAGTTCAGCTGCATACAGTT-3'
(SEQ ID NO: 10212)

5'-<u>C</u>C<u>U</u>GAAGUUCAGC<u>UG</u>C<u>A</u>UACAGUtt-3' (SEQ ID NO: 5593)

3'-<u>A</u>A<u>GG</u>ACUUCAAGUC<u>G</u>ACGUAUGUC<u>AAA</u>-5' (SEQ ID NO: 7903)

C5-5090 Target:
5'-TTCCTGAAGTTCAGCTGCATACAGTTT-3'
(SEQ ID NO: 10213)

5'-C<u>UG</u>A<u>A</u>GUUCAGCUGC<u>A</u>UACAGUUtg-3' (SEQ ID NO: 5594)

3'-<u>AGG</u>ACUUCAAGUCG<u>AC</u>GUAUGUC<u>AAA</u>C-5' (SEQ ID NO: 7904)

C5-5091 Target:
5'-TCCTGAAGTTCAGCTGCATACAGTTTG-3'
(SEQ ID NO: 10214)

5'-U<u>GAA</u>GUUCAGCUGC<u>AU</u>ACAGUUUgc-3' (SEQ ID NO: 5595)

3'-<u>GG</u>A<u>C</u>UUCAAGUCGA<u>C</u>GUAUGUC<u>AAA</u>CG-5' (SEQ ID NO: 7905)

C5-5092 Target:
5'-CCTGAAGTTCAGCTGCATACAGTTTGC-3'
(SEQ ID NO: 10215)

5'-G<u>AA</u>GUUCAGCUGC<u>AU</u>ACAGUUUGca-3' (SEQ ID NO: 5596)

3'-<u>GAC</u>UUCAAGUCGACG<u>U</u>AUGUCAA<u>A</u>CGU-5' (SEQ ID NO: 7906)

C5-5093 Target:
5'-CTGAAGTTCAGCTGCATACAGTTTGCA-3'
(SEQ ID NO: 10216)

5'-A<u>A</u>GUUCAGCUGC<u>AUA</u>CAGUUUGCac-3' (SEQ ID NO: 5597)

3'-<u>ACUUC</u>AAGUCGACGU<u>AU</u>GUCAAA<u>CGUG</u>-5' (SEQ ID NO: 7907)

TABLE 7-continued

Human Anti-C5 DsiRNAs Predicted to have >50% Knockdown Efficacy (Asymmetrics)

C5-5094 Target:
5'-TGAAGTTCAGCTGCATACAGTTTGCAC-3'
(SEQ ID NO: 10217)

5'-<u>A</u>GUUCAGCUGCAU<u>AC</u>A<u>G</u>UUUGCAct-3' (SEQ ID NO: 5598)

3'-<u>CUUC</u>AAGUCGACGU<u>AUGU</u>CAAA<u>C</u>GUGA-5' (SEQ ID NO: 7908)

C5-5095 Target:
5'-GAAGTTCAGCTGCATACAGTTTGCACT-3'
(SEQ ID NO: 10218)

5'-G<u>UU</u>CAGCUGCAU<u>AC</u>A<u>G</u>UUUGCACtt-3' (SEQ ID NO: 5599)

3'-<u>UUC</u>AAGUCGACGUAUGUCAAACGU<u>GAA</u>-5' (SEQ ID NO: 7909)

C5-5096 Target:
5'-AAGTTCAGCTGCATACAGTTTGCACTT-3'
(SEQ ID NO: 10219)

5'-<u>UU</u>C<u>A</u>GCUGCAUAC<u>A</u>GUUUGCACUta-3' (SEQ ID NO: 5600)

3'-<u>UC</u>AAGUCGACGUAUG<u>U</u>CAAACGU<u>GAAU</u>-5' (SEQ ID NO: 7910)

C5-5097 Target:
5'-AGTTCAGCTGCATACAGTTTGCACTTA-3'
(SEQ ID NO: 10220)

5'-<u>UC</u>A<u>G</u>CUGCAUACA<u>G</u>UUUGCACUUat-3' (SEQ ID NO: 5601)

3'-<u>C</u>AAGUCGACGUAUGU<u>C</u>AAACGU<u>GAAUA</u>-5' (SEQ ID NO: 7911)

C5-5098 Target:
5'-GTTCAGCTGCATACAGTTTGCACTTAT-3'
(SEQ ID NO: 10221)

5'-C<u>AG</u>CUGCAUACAG<u>UUUG</u>CACUUAtg-3' (SEQ ID NO: 5602)

3'-<u>AAG</u>UCGACGUAUGUC<u>AAA</u>CGU<u>GAAUAC</u>-5' (SEQ ID NO: 7912)

C5-5099 Target:
5'-TTCAGCTGCATACAGTTTGCACTTATG-3'
(SEQ ID NO: 10222)

5'-<u>A</u>GCUGCAUACAG<u>UUUG</u>CACUUAUgg-3' (SEQ ID NO: 5603)

3'-<u>AGUC</u>GACGUAUGUC<u>AAA</u>CGUGAAU<u>ACC</u>-5' (SEQ ID NO: 7913)

C5-5100 Target:
5'-TCAGCTGCATACAGTTTGCACTTATGG-3'
(SEQ ID NO: 10223)

5'-G<u>CU</u>GCAUACAGUUU<u>G</u>C<u>A</u>CUUAUGga-3' (SEQ ID NO: 5604)

3'-<u>GUCGA</u>CGUAUGUC<u>AAA</u>CGUGAAU<u>ACCU</u>-5' (SEQ ID NO: 7914)

C5-5101 Target:
5'-CAGCTGCATACAGTTTGCACTTATGGA-3'
(SEQ ID NO: 10224)

5'-C<u>UG</u>CAUACAGUUUGC<u>A</u>CUUAUGGac-3' (SEQ ID NO: 5605)

3'-<u>UCGAC</u>GUAUGUCAA<u>A</u>CGUGAAU<u>ACCUG</u>-5' (SEQ ID NO: 7915)

C5-5102 Target:
5'-AGCTGCATACAGTTTGCACTTATGGAC-3'
(SEQ ID NO: 10225)

5'-U<u>GC</u>AUACAGUUUGC<u>AC</u>UUAUGGAct-3' (SEQ ID NO: 5606)

3'-<u>CGAC</u>GUAUGUCAAACGUGAAU<u>ACCUGA</u>-5' (SEQ ID NO: 7916)

TABLE 7-continued

Human Anti-C5 DsiRNAs Predicted to have >50% Knockdown Efficacy (Asymmetrics)

C5-5103 Target:
5'-GCTGCATACAGTTTGCACTTATGGACT-3'
(SEQ ID NO: 10226)

5'-GCAUACAGUUUGCACUUAUGGACtc-3' (SEQ ID NO: 5607)

3'-GACGUAUGUCAAACGUGAAUACCUGAG-5' (SEQ ID NO: 7917)

C5-5104 Target:
5'-CTGCATACAGTTTGCACTTATGGACTC-3'
(SEQ ID NO: 10227)

5'-CAUACAGUUUGCACUUAUGGACUcc-3' (SEQ ID NO: 5608)

3'-ACGUAUGUCAAACGUGAAUACCUGAGG-5' (SEQ ID NO: 7918)

C5-5105 Target:
5'-TGCATACAGTTTGCACTTATGGACTCC-3'
(SEQ ID NO: 10228)

5'-AUACAGUUUGCACUUAUGGACUCct-3' (SEQ ID NO: 5609)

3'-CGUAUGUCAAACGUGAAUACCUGAGGA-5' (SEQ ID NO: 7919)

C5-5106 Target:
5'-GCATACAGTTTGCACTTATGGACTCCT-3'
(SEQ ID NO: 10229)

5'-UACAGUUUGCACUUAUGGACUCCtg-3' (SEQ ID NO: 5610)

3'-GUAUGUCAAACGUGAAUACCUGAGGAC-5' (SEQ ID NO: 7920)

C5-5107 Target:
5'-CATACAGTTTGCACTTATGGACTCCTG-3'
(SEQ ID NO: 10230)

5'-ACAGUUUGCACUUAUGGACUCCUgt-3' (SEQ ID NO: 5611)

3'-UAUGUCAAACGUGAAUACCUGAGGACA-5' (SEQ ID NO: 7921)

C5-5108 Target:
5'-ATACAGTTTGCACTTATGGACTCCTGT-3'
(SEQ ID NO: 10231)

5'-CAGUUUGCACUUAUGGACUCCUGtt-3' (SEQ ID NO: 5612)

3'-AUGUCAAACGUGAAUACCUGAGGACAA-5' (SEQ ID NO: 7922)

C5-5109 Target:
5'-TACAGTTTGCACTTATGGACTCCTGTT-3'
(SEQ ID NO: 10232)

5'-AGUUUGCACUUAUGGACUCCUGUtg-3' (SEQ ID NO: 5613)

3'-UGUCAAACGUGAAUACCUGAGGACAAC-5' (SEQ ID NO: 7923)

C5-5110 Target:
5'-ACAGTTTGCACTTATGGACTCCTGTTG-3'
(SEQ ID NO: 10233)

5'-GUUUGCACUUAUGGACUCCUGUUgt-3' (SEQ ID NO: 5614)

3'-GUCAAACGUGAAUACCUGAGGACAACA-5' (SEQ ID NO: 7924)

C5-5111 Target:
5'-CAGTTTGCACTTATGGACTCCTGTTGT-3'
(SEQ ID NO: 10234)

5'-UUUGCACUUAUGGACUCCUGUUGtt-3' (SEQ ID NO: 5615)

3'-UCAAACGUGAAUACCUGAGGACAACAA-5' (SEQ ID NO: 7925)

C5-5112 Target:
5'-AGTTTGCACTTATGGACTCCTGTTGTT-3'
(SEQ ID NO: 10235)

5'-UUGCACUUAUGGACUCCUGUUGUtg-3' (SEQ ID NO: 5616)

3'-CAAACGUGAAUACCUGAGGACAACAAC-5' (SEQ ID NO: 7926)

C5-5113 Target:
5'-GTTTGCACTTATGGACTCCTGTTGTTG-3'
(SEQ ID NO: 10236)

5'-UGCACUUAUGGACUCCUGUUGUUga-3' (SEQ ID NO: 5617)

3'-AAACGUGAAUACCUGAGGACAACAACU-5' (SEQ ID NO: 7927)

C5-5114 Target:
5'-TTTGCACTTATGGACTCCTGTTGTTGA-3'
(SEQ ID NO: 10237)

5'-GCACUUAUGGACUCCUGUUGUUGaa-3' (SEQ ID NO: 5618)

3'-AACGUGAAUACCUGAGGACAACAACUU-5' (SEQ ID NO: 7928)

C5-5115 Target:
5'-TTGCACTTATGGACTCCTGTTGTTGAA-3'
(SEQ ID NO: 10238)

5'-CACUUAUGGACUCCUGUUGUUGAag-3' (SEQ ID NO: 5619)

3'-ACGUGAAUACCUGAGGACAACAACUUC-5' (SEQ ID NO: 7929)

C5-5116 Target:
5'-TGCACTTATGGACTCCTGTTGTTGAAG-3'
(SEQ ID NO: 10239)

5'-ACUUAUGGACUCCUGUUGUUGAAgt-3' (SEQ ID NO: 5620)

3'-CGUGAAUACCUGAGGACAACAACUUCA-5' (SEQ ID NO: 7930)

C5-5117 Target:
5'-GCACTTATGGACTCCTGTTGTTGAAGT-3'
(SEQ ID NO: 10240)

5'-CUUAUGGACUCCUGUUGUUGAAGtt-3' (SEQ ID NO: 5621)

3'-GUGAAUACCUGAGGACAACAACUUCAA-5' (SEQ ID NO: 7931)

C5-5118 Target:
5'-CACTTATGGACTCCTGTTGTTGAAGTT-3'
(SEQ ID NO: 10241)

5'-UUAUGGACUCCUGUUGUUGAAGUtc-3' (SEQ ID NO: 5622)

3'-UGAAUACCUGAGGACAACAACUUCAAG-5' (SEQ ID NO: 7932)

C5-5119 Target:
5'-ACTTATGGACTCCTGTTGTTGAAGTTC-3'
(SEQ ID NO: 10242)

5'-UAUGGACUCCUGUUGUUGAAGUUcg-3' (SEQ ID NO: 5623)

3'-GAAUACCUGAGGACAACAACUUCAAGC-5' (SEQ ID NO: 7933)

C5-5120 Target:
5'-CTTATGGACTCCTGTTGTTGAAGTTCG-3'
(SEQ ID NO: 10243)

5'-UGGACUCCUGUUGUUGAAGUUCGtt-3' (SEQ ID NO: 5624)

3'-AUACCUGAGGACAACAACUUCAAGCAA-5' (SEQ ID NO: 7934)

TABLE 7-continued

Human Anti-C5 DsiRNAs Predicted to have >50%
Knockdown Efficacy (Asymmetrics)

C5-5122 Target:
5'-TATGGACTCCTGTTGTTGAAGTTCGTT-3'
(SEQ ID NO: 10244)

5'-A̲G̲CU̲GGUCUUAUUUG̲U̲AAAGCUCac-3' (SEQ ID NO: 5625)

3'-U̲AUC̲G̲ACCAGAAUAAA̲C̲AUUUCG̲A̲G̲UG̲-5' (SEQ ID NO: 7935)

C5-5178 Target:
5'-ATAGCTGGTCTTATTTGTAAAGCTCAC-3'
(SEQ ID NO: 10245)

5'-G̲CU̲G̲GUCUUAUUUG̲U̲A̲AAGCUCAct-3' (SEQ ID NO: 5626)

3'-A̲UC̲G̲ACCAGAAUAAA̲C̲AUUUCG̲A̲G̲UG̲A̲-5' (SEQ ID NO: 7936)

C5-5179 Target:
5'-TAGCTGGTCTTATTTGTAAAGCTCACT-3'
(SEQ ID NO: 10246)

5'-CU̲G̲G̲UCUUAUUUG̲U̲A̲AAGCUCACtt-3' (SEQ ID NO: 5627)

3'-U̲CG̲A̲CCAGAAUAAA̲C̲AUUUCGAG̲UG̲AA-5' (SEQ ID NO: 7937)

C5-5180 Target:
5'-AGCTGGTCTTATTTGTAAAGCTCACTT-3'
(SEQ ID NO: 10247)

5'-UG̲G̲UCUUAUUUG̲U̲A̲AAGCUCACUtt-3' (SEQ ID NO: 5628)

3'-CG̲A̲CCAGAAUAAA̲C̲A̲UUUCGAG̲UG̲AAA-5' (SEQ ID NO: 7938)

C5-5181 Target:
5'-GCTGGTCTTATTTGTAAAGCTCACTTT-3'
(SEQ ID NO: 10248)

5'-G̲G̲U̲CUUAUUUG̲U̲A̲A̲AG̲CUCACUUta-3' (SEQ ID NO: 5629)

3'-G̲A̲CC̲AGAAUAAACA̲UUUCGAG̲UG̲AAAU̲-5' (SEQ ID NO: 7939)

C5-5182 Target:
5'-CTGGTCTTATTTGTAAAGCTCACTTTA-3'
(SEQ ID NO: 10249)

5'-G̲U̲CUUAUUUGU̲AAAG̲CUCACUUUac-3' (SEQ ID NO: 5630)

3'-A̲CC̲AGAAUAAACAUUUC̲GAG̲UGAA̲UG̲-5' (SEQ ID NO: 7940)

C5-5183 Target:
5'-TGGTCTTATTTGTAAAGCTCACTTTAC-3'
(SEQ ID NO: 10250)

5'-U̲CUU̲AUUUGUAAAG̲C̲UCACUUUAct-3' (SEQ ID NO: 5631)

3'-CC̲AG̲AAUAAACAUUUCG̲AG̲UGAAAUGA̲-5' (SEQ ID NO: 7941)

C5-5184 Target:
5'-GGTCTTATTTGTAAAGCTCACTTTACT-3'
(SEQ ID NO: 10251)

5'-CU̲U̲AUUUGUAAAGCU̲C̲ACUUUACtt-3' (SEQ ID NO: 5632)

3'-CAG̲A̲A̲UAAACAUUUC̲G̲AG̲UGAAAUG̲AA̲-5' (SEQ ID NO: 7942)

C5-5185 Target:
5'-GTCTTATTTGTAAAGCTCACTTTACTT-3'
(SEQ ID NO: 10252)

5'-UU̲A̲UUUGUAAAGCU̲C̲A̲CUUUACUta-3' (SEQ ID NO: 5633)

3'-AG̲A̲A̲UAAACAUUUCG̲AGUGAAAUG̲AAU̲-5' (SEQ ID NO: 7943)

TABLE 7-continued

Human Anti-C5 DsiRNAs Predicted to have >50%
Knockdown Efficacy (Asymmetrics)

C5-5186 Target:
5'-TCTTATTTGTAAAGCTCACTTTACTTA-3'
(SEQ ID NO: 10253)

5'-U̲AUUUGUAAAGCUC̲A̲C̲UUUACUUag-3' (SEQ ID NO: 5634)

3'-G̲AAU̲AAACAUUUCGAG̲UGAAAUGA̲AUC̲-5' (SEQ ID NO: 7944)

C5-5187 Target:
5'-CTTATTTGTAAAGCTCACTTTACTTAG-3'
(SEQ ID NO: 10254)

5'-A̲UUUGUAAAGCUC̲A̲CUUUACUUAga-3' (SEQ ID NO: 5635)

3'-A̲AUA̲AACAUUUCGAG̲UGAAAUGA̲AUCU̲-5' (SEQ ID NO: 7945)

C5-5188 Target:
5'-TTATTTGTAAAGCTCACTTTACTTAGA-3'
(SEQ ID NO: 10255)

5'-U̲UUGUAAAGCUC̲A̲CUUUACUUAGaa-3' (SEQ ID NO: 5636)

3'-A̲UAA̲CAUUUCGAGUGAAAUGA̲AUCU̲U̲-5' (SEQ ID NO: 7946)

C5-5189 Target:
5'-TATTTGTAAAGCTCACTTTACTTAGAA-3'
(SEQ ID NO: 10256)

5'-UUGUAAAGCUCACUU̲U̲ACUUAGAat-3' (SEQ ID NO: 5637)

3'-U̲AAACAUUUCGAG̲UGA̲AAUGAAUCUUA̲-5' (SEQ ID NO: 7947)

C5-5190 Target:
5'-ATTTGTAAAGCTCACTTTACTTAGAAT-3'
(SEQ ID NO: 10257)

5'-UG̲U̲AAAGCUCACUU̲U̲A̲CUUAGAAtt-3' (SEQ ID NO: 5638)

3'-AAACAUUUCGAGUGA̲A̲AUGAAUCU̲UAA-5' (SEQ ID NO: 7948)

C5-5191 Target:
5'-TTTGTAAAGCTCACTTTACTTAGAATT-3'
(SEQ ID NO: 10258)

5'-G̲UA̲A̲AGCUCACUUUA̲CUUAGAAUta-3' (SEQ ID NO: 5639)

3'-A̲ACAUUUCGAGUGA̲A̲AUGAAUCUUA̲AU̲-5' (SEQ ID NO: 7949)

C5-5192 Target:
5'-TTGTAAAGCTCACTTTACTTAGAATTA-3'
(SEQ ID NO: 10259)

5'-UA̲A̲AGCUCACUUUA̲CUUAGAAUUag-3' (SEQ ID NO: 5640)

3'-A̲CAUUUCGAGUGA̲A̲UGAAUCUUA̲AUC̲-5' (SEQ ID NO: 7950)

C5-5193 Target:
5'-TGTAAAGCTCACTTTACTTAGAATTAG-3'
(SEQ ID NO: 10260)

5'-A̲AAGCUCACUUUA̲CUUAGAAUUAgt-3' (SEQ ID NO: 5641)

3'-CA̲UUUCGAGUGAAAUG̲AAUCUUA̲AUCA̲-5' (SEQ ID NO: 7951)

C5-5194 Target:
5'-GTAAAGCTCACTTTACTTAGAATTAGT-3'
(SEQ ID NO: 10261)

5'-AAG̲CUCACUUUACU̲UAGAAUUAGtg-3' (SEQ ID NO: 5642)

3'-A̲UUUCGAGUGAAAUG̲A̲A̲UCUUA̲AUCAC̲-5' (SEQ ID NO: 7952)

TABLE 7-continued

Human Anti-C5 DsiRNAs Predicted to have >50% Knockdown Efficacy (Asymmetrics)

C5-5195 Target:
5'-TAAAGCTCACTTTACTTAGAATTAGTG-3'
(SEQ ID NO: 10262)

5'-A<u>GC</u>UCACUUUACU<u>UA</u>G<u>A</u>AUUAGUgg-3' (SEQ ID NO: 5643)

3'-UU<u>U</u>C<u>G</u>AGUGAAAUG<u>AA</u>UCUUAAU<u>C</u>ACC-5' (SEQ ID NO: 7953)

C5-5196 Target:
5'-AAAGCTCACTTTACTTAGAATTAGTGG-3'
(SEQ ID NO: 10263)

5'-G<u>C</u>U<u>C</u>ACUUUACUU<u>A</u>G<u>A</u>AUUAGUGgc-3' (SEQ ID NO: 5644)

3'-UU<u>C</u>G<u>A</u>GUGAAAUG<u>A</u>AUCUUAAUC<u>ACC</u>G-5' (SEQ ID NO: 7954)

C5-5197 Target:
5'-AAGCTCACTTTACTTAGAATTAGTGGC-3'
(SEQ ID NO: 10264)

5'-C<u>UC</u>A<u>C</u>UUUACUUA<u>G</u>A<u>A</u>UUAGUGGca-3' (SEQ ID NO: 5645)

3'-U<u>C</u>G<u>A</u>GUGAAAUGA<u>A</u>UCUUAAUC<u>A</u>CC<u>G</u>U-5' (SEQ ID NO: 7955)

C5-5198 Target:
5'-AGCTCACTTTACTTAGAATTAGTGGCA-3'
(SEQ ID NO: 10265)

5'-U<u>C</u>A<u>C</u>UUUACUUAG<u>A</u>A<u>U</u>UAGUGGCac-3' (SEQ ID NO: 5646)

3'-<u>C</u>G<u>A</u>GUGAAAUGAA<u>UC</u>UUAAUCACC<u>G</u>UG-5' (SEQ ID NO: 7956)

C5-5199 Target:
5'-GCTCACTTTACTTAGAATTAGTGGCAC-3'
(SEQ ID NO: 10266)

5'-C<u>A</u>C<u>U</u>UUACUUAGA<u>AU</u>UAGUGGC<u>A</u>ct-3' (SEQ ID NO: 5647)

3'-<u>GA</u>G<u>U</u>GAAAUGAAUC<u>UU</u>AAUCACC<u>G</u>UGA-5' (SEQ ID NO: 7957)

C5-5200 Target:
5'-CTCACTTTACTTAGAATTAGTGGCACT-3'
(SEQ ID NO: 10267)

5'-A<u>C</u>UUUACUUAGA<u>AUU</u>AGUGGC<u>A</u>Ctt-3' (SEQ ID NO: 5648)

3'-<u>AGU</u>G<u>A</u>AAUGAAUCU<u>UA</u>AUCACC<u>G</u>UGAA-5' (SEQ ID NO: 7958)

C5-5201 Target:
5'-TCACTTTACTTAGAATTAGTGGCACTT-3'
(SEQ ID NO: 10268)

5'-C<u>U</u>UUACUUAGAAUU<u>A</u>GUGGCACUtg-3' (SEQ ID NO: 5649)

3'-<u>GUG</u>A<u>A</u>AUGAAUCUU<u>AA</u>UCACCGUG<u>AAC</u>-5' (SEQ ID NO: 7959)

C5-5202 Target:
5'-CACTTTACTTAGAATTAGTGGCACTTG-3'
(SEQ ID NO: 10269)

5'-U<u>U</u>U<u>A</u>CUUAGAAUUA<u>G</u>UGGCACUUgc-3' (SEQ ID NO: 5650)

3'-<u>UGA</u>A<u>A</u>UGAAUCUUA<u>AU</u>CACCGUG<u>AACG</u>-5' (SEQ ID NO: 7960)

C5-5203 Target:
5'-ACTTTACTTAGAATTAGTGGCACTTGC-3'
(SEQ ID NO: 10270)

5'-UU<u>A</u>CUUAGAAUUAG<u>U</u>GGCACUUGct-3' (SEQ ID NO: 5651)

3'-<u>GAA</u>AUGAAUCUUAA<u>UC</u>ACCGUGAA<u>C</u>GA-5' (SEQ ID NO: 7961)

C5-5204 Target:
5'-CTTTACTTAGAATTAGTGGCACTTGCT-3'
(SEQ ID NO: 10271)

5'-U<u>A</u>CUUAGAAUUAGU<u>GGC</u>ACUUGCtt-3' (SEQ ID NO: 5652)

3'-<u>AAA</u>UGAAUCUUAAU<u>C</u>ACCGUGAA<u>C</u>GAA-5' (SEQ ID NO: 7962)

C5-5205 Target:
5'-TTTACTTAGAATTAGTGGCACTTGCTT-3'
(SEQ ID NO: 10272)

5'-A<u>C</u>UUAGAAUUAGUG<u>GC</u>ACUUGCUtt-3' (SEQ ID NO: 5653)

3'-<u>AA</u>UGAAUCUUAAUC<u>A</u>CCGUGAACG<u>AAA</u>-5' (SEQ ID NO: 7963)

C5-5206 Target:
5'-TTACTTAGAATTAGTGGCACTTGCTTT-3'
(SEQ ID NO: 10273)

5'-C<u>UU</u>AGAAUUAGUGG<u>C</u>ACUUGCUUtt-3' (SEQ ID NO: 5654)

3'-<u>A</u>UG<u>A</u>AUCUUAAUC<u>A</u>CCGUGAACG<u>AAAA</u>-5' (SEQ ID NO: 7964)

C5-5207 Target:
5'-TACTTAGAATTAGTGGCACTTGCTTTT-3'
(SEQ ID NO: 10274)

5'-U<u>UA</u>GAAUUAGUGGC<u>AC</u>UUGCUUUta-3' (SEQ ID NO: 5655)

3'-<u>U</u>GA<u>A</u>UCUUAAUC<u>A</u>CCGUGAACG<u>AAAA</u>U-5' (SEQ ID NO: 7965)

C5-5208 Target:
5'-ACTTAGAATTAGTGGCACTTGCTTTTA-3'
(SEQ ID NO: 10275)

5'-U<u>A</u>G<u>A</u>AUUAGUGGC<u>A</u>CUUGCUUUUat-3' (SEQ ID NO: 5656)

3'-<u>GAA</u>UCUUAAUCACC<u>G</u>UGAACGAA<u>AAUA</u>-5' (SEQ ID NO: 7966)

C5-5209 Target:
5'-CTTAGAATTAGTGGCACTTGCTTTTAT-3'
(SEQ ID NO: 10276)

5'-A<u>GA</u>AUUAGUGGC<u>A</u>C<u>U</u>UGCUUUUAtt-3' (SEQ ID NO: 5657)

3'-<u>AA</u>UCUUAAUCACCGU<u>GAA</u>CGAAAAU<u>AA</u>-5' (SEQ ID NO: 7967)

C5-5210 Target:
5'-TTAGAATTAGTGGCACTTGCTTTTATT-3'
(SEQ ID NO: 10277)

5'-G<u>AA</u>UUAGUGGCAC<u>UU</u>GCUUUUAUta-3' (SEQ ID NO: 5658)

3'-<u>A</u>UCUUAAUCACCGUG<u>AA</u>CGAAAAU<u>AAU</u>-5' (SEQ ID NO: 7968)

C5-5211 Target:
5'-TAGAATTAGTGGCACTTGCTTTTATTA-3'
(SEQ ID NO: 10278)

5'-A<u>AU</u>UAGUGGCACUU<u>G</u>CUUUUAUUag-3' (SEQ ID NO: 5659)

3'-<u>U</u>CUUAAUCACCGUGA<u>A</u>CGAAAAU<u>AAUC</u>-5' (SEQ ID NO: 7969)

C5-5212 Target:
5'-AGAATTAGTGGCACTTGCTTTTATTAG-3'
(SEQ ID NO: 10279)

5'-A<u>UU</u>AGUGGCACUUG<u>C</u>UUUUAUUAga-3' (SEQ ID NO: 5660)

3'-<u>C</u>UUAAUCACCGUGA<u>A</u>CGAAAAU<u>AAUCU</u>-5' (SEQ ID NO: 7970)

TABLE 7-continued

Human Anti-C5 DsiRNAs Predicted to have >50% Knockdown Efficacy (Asymmetrics)

C5-5213 Target:
5'-GAATTAGTGGCACTTGCTTTTATTAGA-3'
(SEQ ID NO: 10280)

5'-UU<u>AG</u>UGGCACUUGC<u>U</u>UU<u>U</u>AUUAGAg-3' (SEQ ID NO: 5661)

3'-<u>UUA</u>A<u>U</u>CACCGUGAA<u>CG</u>AAAAUAA<u>U</u>C<u>UC</u>-5' (SEQ ID NO: 7971)

C5-5214 Target:
5'-AATTAGTGGCACTTGCTTTTATTAGAG-3'
(SEQ ID NO: 10281)

5'-<u>U</u>A<u>G</u>UGGCACUUGC<u>U</u>UU<u>U</u>AUUAGAga-3' (SEQ ID NO: 5662)

3'-<u>UAA</u>U<u>C</u>ACCGUGAAC<u>G</u>AAAAUAAUC<u>UCU</u>-5' (SEQ ID NO: 7972)

C5-5215 Target:
5'-ATTAGTGGCACTTGCTTTTATTAGAGA-3'
(SEQ ID NO: 10282)

5'-<u>A</u>G<u>U</u>GGCACUUGCU<u>U</u>U<u>U</u>AUUAGAGaa-3' (SEQ ID NO: 5663)

3'-<u>AAU</u>C<u>A</u>CCGUGAACG<u>A</u>AAAUAAUC<u>UCUU</u>-5' (SEQ ID NO: 7973)

C5-5216 Target:
5'-TTAGTGGCACTTGCTTTTATTAGAGAA-3'
(SEQ ID NO: 10283)

5'-G<u>UGG</u>CACUUGCU<u>U</u>UU<u>A</u>UUAGAGAAat-3' (SEQ ID NO: 5664)

3'-<u>AUCA</u>CCGUGAACGA<u>A</u>AA<u>U</u>AAUCUC<u>UUA</u>-5' (SEQ ID NO: 7974)

C5-5217 Target:
5'-TAGTGGCACTTGCTTTTATTAGAGAAT-3'
(SEQ ID NO: 10284)

5'-<u>U</u>GG<u>C</u>ACUUGCUUU<u>U</u>A<u>U</u>UAGAGAAtg-3' (SEQ ID NO: 5665)

3'-<u>UCACC</u>GUGAACGAA<u>AA</u>U<u>A</u>AUCUC<u>UUAC</u>-5' (SEQ ID NO: 7975)

C5-5218 Target:
5'-AGTGGCACTTGCTTTTATTAGAGAATG-3'
(SEQ ID NO: 10285)

5'-G<u>GC</u>ACUUGCUUUU<u>A</u>U<u>U</u>AGAGAAUga-3' (SEQ ID NO: 5666)

3'-<u>CACC</u>GUGAACGAAA<u>A</u>U<u>A</u>AUCUCU<u>UACU</u>-5' (SEQ ID NO: 7976)

C5-5219 Target:
5'-GTGGCACTTGCTTTTATTAGAGAATGA-3'
(SEQ ID NO: 10286)

5'-<u>GC</u>ACUUGCUUUU<u>A</u>UUAGAGAAUGat-3' (SEQ ID NO: 5667)

3'-<u>ACC</u>GUGAACGAAAAU<u>A</u>AUCUCUU<u>ACUA</u>-5' (SEQ ID NO: 7977)

C5-5220 Target:
5'-TGGCACTTGCTTTTATTAGAGAATGAT-3'
(SEQ ID NO: 10287)

5'-C<u>AC</u>UUGCUUUUAUU<u>A</u>GAGAAUGAtt-3' (SEQ ID NO: 5668)

3'-<u>CCG</u>UGAACGAAAAU<u>AA</u>UCUCUUA<u>CUAA</u>-5' (SEQ ID NO: 7978)

C5-5221 Target:
5'-GGCACTTGCTTTTATTAGAGAATGATT-3'
(SEQ ID NO: 10288)

5'-<u>A</u>C<u>U</u>UGCUUUUAUU<u>AG</u>AGAAUGA<u>U</u>tt-3' (SEQ ID NO: 5669)

3'-<u>CG</u>U<u>G</u>AACGAAAAUA<u>AU</u>CUCUUAC<u>UAAA</u>-5' (SEQ ID NO: 7979)

C5-5222 Target:
5'-GCACTTGCTTTTATTAGAGAATGATTT-3'
(SEQ ID NO: 10289)

5'-C<u>UU</u>GC<u>U</u>UUUAUUA<u>G</u>A<u>G</u>AAUGA<u>U</u>Utc-3' (SEQ ID NO: 5670)

3'-<u>GUG</u>AACGAAAAUAA<u>U</u>C<u>U</u>CUUACU<u>AAAG</u>-5' (SEQ ID NO: 7980)

C5-5223 Target:
5'-CACTTGCTTTTATTAGAGAATGATTTC-3'
(SEQ ID NO: 10290)

5'-<u>U</u>UU<u>U</u>AUUAGAGAA<u>U</u>GA<u>U</u>UUCAAtg-3' (SEQ ID NO: 5671)

3'-<u>CG</u>AAAAUAAUCUCUUA<u>C</u>UAAAGU<u>UUAC</u>-5' (SEQ ID NO: 7981)

C5-5228 Target:
5'-GCTTTTATTAGAGAATGATTTCAAATG-3'
(SEQ ID NO: 10291)

5'-<u>GC</u>U<u>G</u>UAACUUUCUG<u>AAA</u>UAACAUgg-3' (SEQ ID NO: 5672)

3'-<u>UACG</u>ACAUUGAAAGA<u>C</u>UUUAUUGU<u>ACC</u>-5' (SEQ ID NO: 7982)

C5-5252 Target:
5'-ATGCTGTAACTTTCTGAAATAACATGG-3'
(SEQ ID NO: 10292)

5'-C<u>U</u>GUAACUUUCUG<u>AAA</u>UAACAUGgc-3' (SEQ ID NO: 5673)

3'-<u>ACGA</u>CAUUGAAAGA<u>C</u>UUUAUUGU<u>ACCG</u>-5' (SEQ ID NO: 7983)

C5-5253 Target:
5'-TGCTGTAACTTTCTGAAATAACATGGC-3'
(SEQ ID NO: 10293)

5'-<u>UGU</u>AACUUUCUGA<u>AA</u>UAACAUGGcc-3' (SEQ ID NO: 5674)

3'-<u>CGA</u>CAUUGAAAGACUUUAUUGUA<u>CCGG</u>-5' (SEQ ID NO: 7984)

C5-5254 Target:
5'-GCTGTAACTTTCTGAAATAACATGGCC-3'
(SEQ ID NO: 10294)

5'-G<u>UA</u>ACUUUCUGAA<u>AU</u>AACAUGGCct-3' (SEQ ID NO: 5675)

3'-<u>GACA</u>UUGAAAGACUUUAUUGUAC<u>CGGA</u>-5' (SEQ ID NO: 7985)

C5-5255 Target:
5'-CTGTAACTTTCTGAAATAACATGGCCT-3'
(SEQ ID NO: 10295)

5'-<u>U</u>A<u>AC</u>UUUCUGAAA<u>UA</u>ACAUGGCCtt-3' (SEQ ID NO: 5676)

3'-<u>ACA</u>UUGAAAGACUU<u>U</u>A<u>U</u>UGUACCG<u>GAA</u>-5' (SEQ ID NO: 7986)

C5-5256 Target:
5'-TGTAACTTTCTGAAATAACATGGCCTT-3'
(SEQ ID NO: 10296)

5'-<u>A</u>ACUUUCUGAAAU<u>A</u>ACAUGGCCUtg-3' (SEQ ID NO: 5677)

3'-<u>CA</u>UUGAAAGACUUU<u>A</u>UUGUACCGG<u>AAC</u>-5' (SEQ ID NO: 7987)

C5-5257 Target:
5'-GTAACTTTCTGAAATAACATGGCCTTG-3'
(SEQ ID NO: 10297)

5'-<u>A</u>C<u>U</u>UUCUGAAAUA<u>A</u>C<u>A</u>UGGCCUUgg-3' (SEQ ID NO: 5678)

3'-<u>A</u>UU<u>G</u>AAAGACUUUAUUGUACCGG<u>AACC</u>-5' (SEQ ID NO: 7988)

TABLE 7-continued

Human Anti-C5 DsiRNAs Predicted to have >50% Knockdown Efficacy (Asymmetrics)

C5-5258 Target:
5'-TAACTTTCTGAAATAACATGGCCTTGG-3'
(SEQ ID NO: 10298)

5'-CUUUCUGAAAUAACAUGGCCUUGga-3' (SEQ ID NO: 5679)

3'-UUGAAAGACUUUAUUGUACCGGAACCU-5' (SEQ ID NO: 7989)

C5-5259 Target:
5'-AACTTTCTGAAATAACATGGCCTTGGA-3'
(SEQ ID NO: 10299)

5'-UUUCUGAAAUAACAUGGCCUUGGag-3' (SEQ ID NO: 5680)

3'-UGAAAGACUUUAUUGUACCGGAACCUC-5' (SEQ ID NO: 7990)

C5-5260 Target:
5'-ACTTTCTGAAATAACATGGCCTTGGAG-3'
(SEQ ID NO: 10300)

5'-UUCUGAAAUAACAUGGCCUUGGAgg-3' (SEQ ID NO: 5681)

3'-GAAAGACUUUAUUGUACCGGAACCUCC-5' (SEQ ID NO: 7991)

C5-5261 Target:
5'-CTTTCTGAAATAACATGGCCTTGGAGG-3'
(SEQ ID NO: 10301)

5'-UCUGAAAUAACAUGGCCUUGGAGgg-3' (SEQ ID NO: 5682)

3'-AAAGACUUUAUUGUACCGGAACCUCCC-5' (SEQ ID NO: 7992)

C5-5262 Target:
5'-TTTCTGAAATAACATGGCCTTGGAGGG-3'
(SEQ ID NO: 10302)

5'-CUGAAAUAACAUGGCCUUGGAGGgc-3' (SEQ ID NO: 5683)

3'-AAGACUUUAUUGUACCGGAACCUCCCG-5' (SEQ ID NO: 7993)

C5-5263 Target:
5'-TTCTGAAATAACATGGCCTTGGAGGGC-3'
(SEQ ID NO: 10303)

5'-UGAAAUAACAUGGCCUUGGAGGGca-3' (SEQ ID NO: 5684)

3'-AGACUUUAUUGUACCGGAACCUCCCGU-5' (SEQ ID NO: 7994)

C5-5264 Target:
5'-TCTGAAATAACATGGCCTTGGAGGGCA-3'
(SEQ ID NO: 10304)

5'-GAAAUAACAUGGCCUUGGAGGGCat-3' (SEQ ID NO: 5685)

3'-GACUUUAUUGUACCGGAACCUCCCGUA-5' (SEQ ID NO: 7995)

C5-5265 Target:
5'-CTGAAATAACATGGCCTTGGAGGGCAT-3'
(SEQ ID NO: 10305)

5'-AAAUAACAUGGCCUUGGAGGGCAtg-3' (SEQ ID NO: 5686)

3'-ACUUUAUUGUACCGGAACCUCCCGUAC-5' (SEQ ID NO: 7996)

C5-5266 Target:
5'-TGAAATAACATGGCCTTGGAGGGCATG-3'
(SEQ ID NO: 10306)

5'-AAUAACAUGGCCUUGGAGGGCAUga-3' (SEQ ID NO: 5687)

3'-CUUUAUUGUACCGGAACCUCCCGUACU-5' (SEQ ID NO: 7997)

C5-5267 Target:
5'-GAAATAACATGGCCTTGGAGGGCATGA-3'
(SEQ ID NO: 10307)

5'-AUAACAUGGCCUUGGAGGGCAUGaa-3' (SEQ ID NO: 5688)

3'-UUUAUUGUACCGGAACCUCCCGUACUU-5' (SEQ ID NO: 7998)

C5-5268 Target:
5'-AAATAACATGGCCTTGGAGGGCATGAA-3'
(SEQ ID NO: 10308)

5'-UAACAUGGCCUUGGAGGGCAUGAag-3' (SEQ ID NO: 5689)

3'-UUAUUGUACCGGAACCUCCCGUACUUC-5' (SEQ ID NO: 7999)

C5-5269 Target:
5'-AATAACATGGCCTTGGAGGGCATGAAG-3'
(SEQ ID NO: 10309)

5'-AACAUGGCCUUGGAGGGCAUGAAga-3' (SEQ ID NO: 5690)

3'-UAUUGUACCGGAACCUCCCGUACUUCU-5' (SEQ ID NO: 8000)

C5-5270 Target:
5'-ATAACATGGCCTTGGAGGGCATGAAGA-3'
(SEQ ID NO: 10310)

5'-ACAUGGCCUUGGAGGGCAUGAAGac-3' (SEQ ID NO: 5691)

3'-AUUGUACCGGAACCUCCCGUACUUCUG-5' (SEQ ID NO: 8001)

C5-5271 Target:
5'-TAACATGGCCTTGGAGGGCATGAAGAC-3'
(SEQ ID NO: 10311)

5'-CAUGGCCUUGGAGGGCAUGAAGAca-3' (SEQ ID NO: 5692)

3'-UUGUACCGGAACCUCCCGUACUUCUGU-5' (SEQ ID NO: 8002)

C5-5272 Target:
5'-AACATGGCCTTGGAGGGCATGAAGACA-3'
(SEQ ID NO: 10312)

5'-AUGGCCUUGGAGGGCAUGAAGACag-3' (SEQ ID NO: 5693)

3'-UGUACCGGAACCUCCCGUACUUCUGUC-5' (SEQ ID NO: 8003)

C5-5273 Target:
5'-ACATGGCCTTGGAGGGCATGAAGACAG-3'
(SEQ ID NO: 10313)

5'-UGGCCUUGGAGGGCAUGAAGACAga-3' (SEQ ID NO: 5694)

3'-GUACCGGAACCUCCCGUACUUCUGUCU-5' (SEQ ID NO: 8004)

C5-5274 Target:
5'-CATGGCCTTGGAGGGCATGAAGACAGA-3'
(SEQ ID NO: 10314)

5'-GGCCUUGGAGGGCAUGAAGACAGat-3' (SEQ ID NO: 5695)

3'-UACCGGAACCUCCCGUACUUCUGUCUA-5' (SEQ ID NO: 8005)

C5-5275 Target:
5'-ATGGCCTTGGAGGGCATGAAGACAGAT-3'
(SEQ ID NO: 10315)

5'-GCCUUGGAGGGCAUGAAGACAGAta-3' (SEQ ID NO: 5696)

3'-ACCGGAACCUCCCGUACUUCUGUCUAU-5' (SEQ ID NO: 8006)

TABLE 7-continued

Human Anti-C5 DsiRNAs Predicted to have >50% Knockdown Efficacy (Asymmetrics)

C5-5276 Target:
5'-TGGCCTTGGAGGGCATGAAGACAGATA-3'
(SEQ ID NO: 10316)

5'-C<u>C</u>UGGAGGGCAUG<u>A</u>AGACAGAUac-3' (SEQ ID NO: 5697)

3'-<u>CCGGA</u>ACCUCCCGUA<u>C</u>UU<u>C</u>UGUCU<u>A</u>UG-5' (SEQ ID NO: 8007)

C5-5277 Target:
5'-GGCCTTGGAGGGCATGAAGACAGATAC-3'
(SEQ ID NO: 10317)

5'-C<u>UU</u>GGAGGGCAUG<u>A</u>AGACAGAUAct-3' (SEQ ID NO: 5698)

3'-<u>CGGA</u>ACCUCCCGUA<u>C</u>UU<u>C</u>UGUCU<u>A</u>UGA-5' (SEQ ID NO: 8008)

C5-5278 Target:
5'-GCCTTGGAGGGCATGAAGACAGATACT-3'
(SEQ ID NO: 10318)

5'-<u>U</u>UGGAGGGCAUG<u>A</u>AGACAGAUACtc-3' (SEQ ID NO: 5699)

3'-<u>GGAA</u>CCUCCCGUA<u>C</u>UU<u>C</u>UGUCU<u>A</u>UGAG-5' (SEQ ID NO: 8009)

C5-5279 Target:
5'-CCTTGGAGGGCATGAAGACAGATACTC-3'
(SEQ ID NO: 10319)

5'-<u>U</u>GGAGGGCAUGAAGA<u>C</u>AGAUACUcc-3' (SEQ ID NO: 5700)

3'-<u>GAA</u>CCUCCCGUACUU<u>C</u>UGUCUAU<u>G</u>AGG-5' (SEQ ID NO: 8010)

C5-5280 Target:
5'-CTTGGAGGGCATGAAGACAGATACTCC-3'
(SEQ ID NO: 10320)

5'-<u>GGA</u>GGGCAUGAAGA<u>C</u>AGAUACUCct-3' (SEQ ID NO: 5701)

3'-<u>AA</u>CCUCCCGUACUU<u>C</u>UGUCUAUG<u>AGGA</u>-5' (SEQ ID NO: 8011)

C5-5281 Target:
5'-TTGGAGGGCATGAAGACAGATACTCCT-3'
(SEQ ID NO: 10321)

5'-G<u>A</u>GGGCAUGAAGA<u>C</u>AGAUACUCCtc-3' (SEQ ID NO: 5702)

3'-<u>AC</u>CUCCCGUACUU<u>C</u>UGUCUAUGA<u>GGAG</u>-5' (SEQ ID NO: 8012)

C5-5282 Target:
5'-TGGAGGGCATGAAGACAGATACTCCTC-3'
(SEQ ID NO: 10322)

5'-A<u>GGG</u>CAUGAAGAC<u>A</u>GAUACUCCUcc-3' (SEQ ID NO: 5703)

3'-<u>CC</u>UCCCGUACUUC<u>U</u>GU<u>C</u>UAUGAGG<u>AGG</u>-5' (SEQ ID NO: 8013)

C5-5283 Target:
5'-GGAGGGCATGAAGACAGATACTCCTCC-3'
(SEQ ID NO: 10323)

5'-<u>GGG</u>CAUGAAGAC<u>AGA</u>UACUCCUCca-3' (SEQ ID NO: 5704)

3'-<u>C</u>UCCCGUACUUCUGU<u>C</u>UAUGAGGA<u>GGU</u>-5' (SEQ ID NO: 8014)

C5-5284 Target:
5'-GAGGGCATGAAGACAGATACTCCTCCA-3'
(SEQ ID NO: 10324)

5'-<u>GG</u>C<u>A</u>UGAAGACAGA<u>U</u>A<u>C</u>UCCUCCaa-3' (SEQ ID NO: 5705)

3'-<u>UCCC</u>GUACUUCUGU<u>C</u>UAUGAGGAGGUU-5' (SEQ ID NO: 8015)

C5-5285 Target:
5'-AGGGCATGAAGACAGATACTCCTCCAA-3'
(SEQ ID NO: 10325)

5'-G<u>C</u>AUGAAGACAGAUA<u>C</u>UCCUCCAag-3' (SEQ ID NO: 5706)

3'-<u>CCC</u>GUACUUCUGUCU<u>A</u>UGAGGAGG<u>UUC</u>-5' (SEQ ID NO: 8016)

C5-5286 Target:
5'-GGGCATGAAGACAGATACTCCTCCAAG-3'
(SEQ ID NO: 10326)

5'-C<u>A</u>UGAAGACAGAUA<u>C</u>UCCUCCAAgg-3' (SEQ ID NO: 5707)

3'-<u>CC</u>GUACUUCUGUCU<u>A</u>UGAGGAGG<u>UUCC</u>-5' (SEQ ID NO: 8017)

C5-5287 Target:
5'-GGCATGAAGACAGATACTCCTCCAAGG-3'
(SEQ ID NO: 10327)

5'-<u>A</u>UGAAGACAGAUA<u>C</u>UCCUCCAAGgt-3' (SEQ ID NO: 5708)

3'-<u>C</u>GUACUUCUGUCUAUGAGGAGGUU<u>CCA</u>-5' (SEQ ID NO: 8018)

C5-5288 Target:
5'-GCATGAAGACAGATACTCCTCCAAGGT-3'
(SEQ ID NO: 10328)

5'-<u>U</u>G<u>A</u>AGACAGAUACU<u>CC</u>UCCAAGGtt-3' (SEQ ID NO: 5709)

3'-<u>G</u>UACUUCUGUCUAUGAGGAGGUU<u>CCAA</u>-5' (SEQ ID NO: 8019)

C5-5289 Target:
5'-CATGAAGACAGATACTCCTCCAAGGTT-3'
(SEQ ID NO: 10329)

5'-G<u>AA</u>GACAGAUACU<u>CC</u>UCCAAGGUta-3' (SEQ ID NO: 5710)

3'-<u>U</u>ACUUCUGUCUAUG<u>A</u>GGAGGUU<u>CC</u>AAU-5' (SEQ ID NO: 8020)

C5-5290 Target:
5'-ATGAAGACAGATACTCCTCCAAGGTTA-3'
(SEQ ID NO: 10330)

5'-<u>A</u>AGACAGAUACUC<u>C</u>U<u>C</u>CAAGGUUat-3' (SEQ ID NO: 5711)

3'-<u>AC</u>UUCUGUCUAUGAGGAGGUUCC<u>AAUA</u>-5' (SEQ ID NO: 8021)

C5-5291 Target:
5'-TGAAGACAGATACTCCTCCAAGGTTAT-3'
(SEQ ID NO: 10331)

5'-<u>A</u>GA<u>C</u>AGAUACUC<u>CU</u>CCAAGGUUAtt-3' (SEQ ID NO: 5712)

3'-<u>C</u>UU<u>C</u>UGUCUAUGAGGAGGUUCC<u>A</u>AU<u>AA</u>-5' (SEQ ID NO: 8022)

C5-5292 Target:
5'-GAAGACAGATACTCCTCCAAGGTTATT-3'
(SEQ ID NO: 10332)

5'-G<u>AC</u>AGAUACUCCU<u>CC</u>AAGGUUAUtg-3' (SEQ ID NO: 5713)

3'-<u>UU</u>CUGUCUAUGAGG<u>A</u>GGUUCC<u>A</u>AU<u>AAC</u>-5' (SEQ ID NO: 8023)

C5-5293 Target:
5'-AAGACAGATACTCCTCCAAGGTTATTG-3'
(SEQ ID NO: 10333)

5'-<u>AC</u>AGAUACUCCU<u>CC</u>AAGGUUAUUgg-3' (SEQ ID NO: 5714)

3'-<u>U</u>CUGUCUAUGAGGAG<u>G</u>UUCCAAU<u>AACC</u>-5' (SEQ ID NO: 8024)

TABLE 7-continued

Human Anti-C5 DsiRNAs Predicted to have >50% Knockdown Efficacy (Asymmetrics)

C5-5294 Target:
5'-AGACAGATACTCCTCCAAGGTTATTGG-3'
(SEQ ID NO: 10334)

5'-A<u>GAUA</u>CUCCUCCAA<u>GGUUA</u>UUGGac-3' (SEQ ID NO: 5715)

3'-<u>UGU</u>C<u>U</u>AUGAGGAGG<u>UU</u>CC<u>A</u>AUAA<u>CC</u>UG-5' (SEQ ID NO: 8025)

C5-5296 Target:
5'-ACAGATACTCCTCCAAGGTTATTGGAC-3'
(SEQ ID NO: 10335)

5'-G<u>AU</u>ACUCCUCCAA<u>GG</u>U<u>U</u>A<u>U</u>UGGAca-3' (SEQ ID NO: 5716)

3'-<u>GU</u>C<u>U</u>AUGAGGAGG<u>UU</u>CC<u>A</u>AUAACC<u>UGU</u>-5' (SEQ ID NO: 8026)

C5-5297 Target:
5'-CAGATACTCCTCCAAGGTTATTGGACA-3'
(SEQ ID NO: 10336)

5'-<u>AU</u>ACUCCUCCAAGG<u>U</u>U<u>A</u>UUGGAC<u>a</u>c-3' (SEQ ID NO: 5717)

3'-<u>U</u>C<u>U</u>AUGAGGAGG<u>UU</u>CC<u>AA</u>UAACCUG<u>UG</u>-5' (SEQ ID NO: 8027)

C5-5298 Target:
5'-AGATACTCCTCCAAGGTTATTGGACAC-3'
(SEQ ID NO: 10337)

5'-<u>U</u>A<u>C</u>UCCUCCAAGG<u>U</u>U<u>A</u>UUGGAC<u>A</u>cc-3' (SEQ ID NO: 5718)

3'-<u>C</u>U<u>A</u>UGAGGAGG<u>UU</u>CC<u>AA</u>UAACCUG<u>UGG</u>-5' (SEQ ID NO: 8028)

C5-5299 Target:
5'-GATACTCCTCCAAGGTTATTGGACACC-3'
(SEQ ID NO: 10338)

5'-A<u>C</u>UCCUCCAAGGU<u>UA</u>UUGGACAC<u>c</u>g-3' (SEQ ID NO: 5719)

3'-<u>UAU</u>GAGGAGGUUCC<u>AA</u>UAACCUG<u>UGGC</u>-5' (SEQ ID NO: 8029)

C5-5300 Target:
5'-ATACTCCTCCAAGGTTATTGGACACCG-3'
(SEQ ID NO: 10339)

5'-C<u>U</u>C<u>C</u>UCCAAGGUUA<u>U</u>UGGACACCgg-3' (SEQ ID NO: 5720)

3'-<u>AU</u>GA<u>G</u>GAGGUUCC<u>AA</u>UAACCUGU<u>GGCC</u>-5' (SEQ ID NO: 8030)

C5-5301 Target:
5'-TACTCCTCCAAGGTTATTGGACACCGG-3'
(SEQ ID NO: 10340)

5'-U<u>CC</u>UCCAAGGUUA<u>U</u>UGGACACCGga-3' (SEQ ID NO: 5721)

3'-<u>U</u>GA<u>GG</u>AGGUUCCAAUA<u>A</u>CCUGUG<u>GCCU</u>-5' (SEQ ID NO: 8031)

C5-5302 Target:
5'-ACTCCTCCAAGGTTATTGGACACCGGA-3'
(SEQ ID NO: 10341)

5'-<u>CC</u>U<u>C</u>CAAGGUUA<u>U</u>UGGACACCGGaa-3' (SEQ ID NO: 5722)

3'-<u>GAGG</u>AGGUUCCAAU<u>AA</u>CCUGUGG<u>CCUU</u>-5' (SEQ ID NO: 8032)

C5-5303 Target:
5'-CTCCTCCAAGGTTATTGGACACCGGAA-3'
(SEQ ID NO: 10342)

5'-C<u>U</u>CCAAGGUUAUUGGA<u>C</u>ACCGGAaa-3' (SEQ ID NO: 5723)

3'-<u>AGG</u>AGGUUCCAAUA<u>A</u>CCUGUGGCC<u>UUU</u>-5' (SEQ ID NO: 8033)

TABLE 7-continued

Human Anti-C5 DsiRNAs Predicted to have >50% Knockdown Efficacy (Asymmetrics)

C5-5304 Target:
5'-TCCTCCAAGGTTATTGGACACCGGAAA-3'
(SEQ ID NO: 10343)

5'-<u>U</u>CCAAGGUUAUUGG<u>AC</u>ACCGGAAac-3' (SEQ ID NO: 5724)

3'-<u>GG</u>AGGUUCCAAUAA<u>CC</u>UGUGGCC<u>UUUG</u>-5' (SEQ ID NO: 8034)

C5-5305 Target:
5'-CCTCCAAGGTTATTGGACACCGGAAAC-3'
(SEQ ID NO: 10344)

5'-CC<u>AA</u>GGUUAUUGG<u>AC</u>ACCGGAAAca-3' (SEQ ID NO: 5725)

3'-<u>G</u>AGGUUCCAAUA<u>A</u>CCUGUGGCC<u>UUUGU</u>-5' (SEQ ID NO: 8035)

C5-5306 Target:
5'-CTCCAAGGTTATTGGACACCGGAAACA-3'
(SEQ ID NO: 10345)

5'-C<u>AA</u>GGUUAUUGGA<u>C</u>ACCGGAAACaa-3' (SEQ ID NO: 5726)

3'-<u>AGG</u>UUCCAAUAACCUGUGGCCUUU<u>GUU</u>-5' (SEQ ID NO: 8036)

C5-5307 Target:
5'-TCCAAGGTTATTGGACACCGGAAACAA-3'
(SEQ ID NO: 10346)

5'-A<u>AG</u>GUUAUUGGAC<u>AC</u>CGGAAACAat-3' (SEQ ID NO: 5727)

3'-<u>GG</u>UUCCAAUAACCUGUGGCCUUU<u>G</u>UUA-5' (SEQ ID NO: 8037)

C5-5308 Target:
5'-CCAAGGTTATTGGACACCGGAAACAAT-3'
(SEQ ID NO: 10347)

5'-A<u>GG</u>UUAUUGGACA<u>C</u>CGGAAACAAta-3' (SEQ ID NO: 5728)

3'-<u>G</u>UUCCAAUAACCUGUGG<u>CC</u>UUU<u>GUU</u>AU-5' (SEQ ID NO: 8038)

C5-5309 Target:
5'-CAAGGTTATTGGACACCGGAAACAATA-3'
(SEQ ID NO: 10348)

5'-G<u>GU</u>U<u>A</u>UUGGACAC<u>C</u>GGAAACAAU<u>a</u>a-3' (SEQ ID NO: 5729)

3'-<u>UU</u>CC<u>A</u>AUAACCUGU<u>GG</u>CCUUUGUU<u>A</u>UU-5' (SEQ ID NO: 8039)

C5-5310 Target:
5'-AAGGTTATTGGACACCGGAAACAATAA-3'
(SEQ ID NO: 10349)

5'-GUU<u>A</u>UUGGACACC<u>GG</u>A<u>AA</u>CAAU<u>A</u>aa-3' (SEQ ID NO: 5730)

3'-<u>U</u>CC<u>A</u>AUAACCUGUGG<u>CC</u>UUUGUU<u>AUU</u>U-5' (SEQ ID NO: 8040)

C5-5311 Target:
5'-AGGTTATTGGACACCGGAAACAATAAA-3'
(SEQ ID NO: 10350)

5'-<u>U</u>U<u>A</u>UUGGACACCG<u>G</u>A<u>AA</u>CAAUAAat-3' (SEQ ID NO: 5731)

3'-<u>CC</u>AAUAACCUGUGG<u>CC</u>UUUGUU<u>AUUU</u>A-5' (SEQ ID NO: 8041)

C5-5312 Target:
5'-GGTTATTGGACACCGGAAACAATAAAT-3'
(SEQ ID NO: 10351)

5'-<u>U</u>AUUGGACACCGG<u>AAA</u>CAAUAAAtt-3' (SEQ ID NO: 5732)

3'-<u>C</u>AAU<u>A</u>ACCUGUGGCC<u>U</u>UUGUU<u>AUUUAA</u>-5' (SEQ ID NO: 8042)

TABLE 7-continued

Human Anti-C5 DsiRNAs Predicted to have >50% Knockdown Efficacy (Asymmetrics)

C5-5313 Target:
5'-GTTATTGGACACCGGAAACAATAAATT-3'
(SEQ ID NO: 10352)

5'-A<u>U</u>UGGACACCGGAAA<u>C</u>AAUAAAUtg-3' (SEQ ID NO: 5733)

3'-<u>AAUA</u>A<u>CC</u>UGUGGCC<u>U</u>UU<u>G</u>UUAUUU<u>AAC</u>-5' (SEQ ID NO: 8043)

C5-5314 Target:
5'-TTATTGGACACCGGAAACAATAAATTG-3'
(SEQ ID NO: 10353)

5'-U<u>U</u>GGACACCGGAAA<u>C</u>AAUAAAUUgg-3' (SEQ ID NO: 5734)

3'-<u>A</u>U<u>AA</u>C<u>C</u>UGUGGCC<u>U</u>UU<u>G</u>UUAUUU<u>AACC</u>-5' (SEQ ID NO: 8044)

C5-5315 Target:
5'-TATTGGACACCGGAAACAATAAATTGG-3'
(SEQ ID NO: 10354)

5'-U<u>GG</u>ACACCGGAAA<u>C</u>AAUAAAUUGga-3' (SEQ ID NO: 5735)

3'-<u>UAA</u>C<u>C</u>UGUGGCC<u>U</u>UU<u>G</u>UUAUUU<u>ACCU</u>-5' (SEQ ID NO: 8045)

C5-5316 Target:
5'-ATTGGACACCGGAAACAATAAATTGGA-3'
(SEQ ID NO: 10355)

5'-G<u>G</u>ACACCGGAAAC<u>A</u>AUAAAUUGGaa-3' (SEQ ID NO: 5736)

3'-<u>AA</u>C<u>C</u>UGUGGCC<u>U</u>UU<u>G</u>UUAUUUAA<u>CCUU</u>-5' (SEQ ID NO: 8046)

C5-5317 Target:
5'-TTGGACACCGGAAACAATAAATTGGAA-3'
(SEQ ID NO: 10356)

5'-<u>G</u>AC<u>A</u>CCGGAAACA<u>A</u>UA<u>A</u>AUUGGAac-3' (SEQ ID NO: 5737)

3'-<u>ACC</u>U<u>G</u>UGGCCUUU<u>G</u>UU<u>A</u>UUUAACC<u>UUG</u>-5' (SEQ ID NO: 8047)

C5-5318 Target:
5'-TGGACACCGGAAACAATAAATTGGAAC-3'
(SEQ ID NO: 10357)

5'-A<u>C</u>ACCGGAAACAA<u>U</u>AA<u>A</u>UUGG<u>A</u>ACa-3' (SEQ ID NO: 5738)

3'-<u>CC</u>UGUGGCCUUUG<u>U</u>U<u>A</u>UUUAACC<u>UUGU</u>-5' (SEQ ID NO: 8048)

C5-5319 Target:
5'-GGACACCGGAAACAATAAATTGGAACA-3'
(SEQ ID NO: 10358)

5'-G<u>AA</u>CACCUCCUCA<u>AA</u>C<u>C</u>UACCACtc-3' (SEQ ID NO: 5739)

3'-<u>ACC</u>UUGUGGAGGAGUUUGGAUGG<u>UGAG</u>-5' (SEQ ID NO: 8049)

C5-5339 Target:
5'-TGGAACACCTCCTCAAACCTACCACTC-3'
(SEQ ID NO: 10359)

5'-A<u>A</u>CACCUCCUCAAA<u>A</u>CCUACCACUca-3' (SEQ ID NO: 5740)

3'-<u>CC</u>UUGUGGAGGAGUUUGGAUGGU<u>GAGU</u>-5' (SEQ ID NO: 8050)

C5-5340 Target:
5'-GGAACACCTCCTCAAACCTACCACTCA-3'
(SEQ ID NO: 10360)

5'-A<u>C</u>A<u>C</u>CUCCUCAAA<u>CC</u>UACCACUCag-3' (SEQ ID NO: 5741)

3'-<u>CUU</u>GUGGAGGAGUUUGGAUGGUG<u>AGUC</u>-5' (SEQ ID NO: 8051)

TABLE 7-continued

Human Anti-C5 DsiRNAs Predicted to have >50% Knockdown Efficacy (Asymmetrics)

C5-5341 Target:
5'-GAACACCTCCTCAAACCTACCACTCAG-3'
(SEQ ID NO: 10361)

5'-C<u>A</u>C<u>C</u>UCCUCAAAC<u>CU</u>A<u>C</u>CACUCAgg-3' (SEQ ID NO: 5742)

3'-<u>UUG</u>UGGAGGAGUUUGG<u>A</u>UGGUGA<u>GUCC</u>-5' (SEQ ID NO: 8052)

C5-5342 Target:
5'-AACACCTCCTCAAACCTACCACTCAGG-3'
(SEQ ID NO: 10362)

5'-A<u>CC</u>UCCUCAAACC<u>U</u>A<u>CC</u>ACUCAGga-3' (SEQ ID NO: 5743)

3'-<u>UG</u>UGGAGGAGUUUGG<u>A</u>UGGUGAG<u>UCCU</u>-5' (SEQ ID NO: 8053)

C5-5343 Target:
5'-ACACCTCCTCAAACCTACCACTCAGGA-3'
(SEQ ID NO: 10363)

5'-<u>CC</u>UCCUCAAACCU<u>A</u>CC<u>A</u>CUCAGGaa-3' (SEQ ID NO: 5744)

3'-<u>GUGG</u>AGGAGUUUGGAUGGUGAGU<u>CCUU</u>-5' (SEQ ID NO: 8054)

C5-5344 Target:
5'-CACCTCCTCAAACCTACCACTCAGGAA-3'
(SEQ ID NO: 10364)

5'-G<u>CC</u>GAAAGAACAG<u>UCC</u>AUUGAAAgg-3' (SEQ ID NO: 5745)

3'-<u>CCC</u>GGCUUUCUUGUCAGGUAACU<u>UUCC</u>-5' (SEQ ID NO: 8055)

C5-5380 Target:
5'-GGGCCGAAAGAACAGTCCATTGAAAGG-3'
(SEQ ID NO: 10365)

5'-C<u>C</u>GAAAGAACAGU<u>CC</u>A<u>U</u>UGAAAGgg-3' (SEQ ID NO: 5746)

3'-<u>CCGG</u>CUUUCUUGUCAGGUAACUU<u>UCCC</u>-5' (SEQ ID NO: 8056)

C5-5381 Target:
5'-GGCCGAAAGAACAGTCCATTGAAAGGG-3'
(SEQ ID NO: 10366)

5'-CG<u>A</u>AAGAACAGUCC<u>A</u>UUGAAAGGga-3' (SEQ ID NO: 5747)

3'-<u>CGG</u>CUUUCUUGUCAGGUAACUUU<u>CCCU</u>-5' (SEQ ID NO: 8057)

C5-5382 Target:
5'-GCCGAAAGAACAGTCCATTGAAAGGGA-3'
(SEQ ID NO: 10367)

5'-G<u>AAA</u>GAACAGUCC<u>A</u>UUGAAAGGGag-3' (SEQ ID NO: 5748)

3'-<u>GG</u>CUUUCUUGUCAGGU<u>A</u>ACUUUC<u>CCUC</u>-5' (SEQ ID NO: 8058)

C5-5383 Target:
5'-CCGAAAGAACAGTCCATTGAAAGGGAG-3'
(SEQ ID NO: 10368)

5'-A<u>AA</u>GAACAGUCC<u>A</u>UUGAAAGGGAgt-3' (SEQ ID NO: 5749)

3'-<u>GC</u>UUUCUUGUCAGGU<u>A</u>ACUUUC<u>C</u>U<u>CA</u>-5' (SEQ ID NO: 8059)

C5-5384 Target:
5'-CGAAAGAACAGTCCATTGAAAGGGAGT-3'
(SEQ ID NO: 10369)

5'-GG<u>A</u>GUAUUACAAA<u>A</u>CAUGGCCUtt-3' (SEQ ID NO: 5750)

3'-<u>UCCC</u>UCAUAAUGUUU<u>U</u>UGUACCG<u>GAAA</u>-5' (SEQ ID NO: 8060)

TABLE 7-continued

Human Anti-C5 DsiRNAs Predicted to have >50% Knockdown Efficacy (Asymmetrics)

C5-5404 Target:
5'-AGGGAGTATTACAAAAACATGGCCTTT-3'
(SEQ ID NO: 10370)

5'-G<u>A</u>G<u>UA</u>UUACAAAAA<u>C</u>AUGGCCUUtg-3' (SEQ ID NO: 5751)

3'-<u>CCC</u>U<u>C</u>AUAAUGUUUU<u>U</u>GUACCGG<u>AAAC</u>-5' (SEQ ID NO: 8061)

C5-5405 Target:
5'-GGGAGTATTACAAAAACATGGCCTTTG-3'
(SEQ ID NO: 10371)

5'-A<u>GU</u>AUUACAAAAA<u>C</u>AUGGCCUUUgc-3' (SEQ ID NO: 5752)

3'-<u>CCUC</u>AUAAUGUUUUUGUACCGGAAACG-5' (SEQ ID NO: 8062)

C5-5406 Target:
5'-GGAGTATTACAAAAACATGGCCTTTGC-3'
(SEQ ID NO: 10372)

5'-G<u>U</u>A<u>UU</u>ACAAAAA<u>C</u>AUGGCCUUUGct-3' (SEQ ID NO: 5753)

3'-<u>CUC</u>AUAAUGUUUUUG<u>U</u>ACCGGAAA<u>CGA</u>-5' (SEQ ID NO: 8063)

C5-5407 Target:
5'-GAGTATTACAAAAACATGGCCTTTGCT-3'
(SEQ ID NO: 10373)

5'-U<u>A</u>UUACAAAAACAUG<u>G</u>CCUUUGCtt-3' (SEQ ID NO: 5754)

3'-<u>UC</u>A<u>U</u>AAUGUUUUUGU<u>A</u>CCGGAAACGAA-5' (SEQ ID NO: 8064)

C5-5408 Target:
5'-AGTATTACAAAAACATGGCCTTTGCTT-3'
(SEQ ID NO: 10374)

5'-A<u>UU</u>ACAAAAACAUG<u>GC</u>CUUUGCUtg-3' (SEQ ID NO: 5755)

3'-<u>C</u>A<u>U</u>A<u>A</u>UGUUUUUGU<u>A</u>CCGGAAACG<u>AAC</u>-5' (SEQ ID NO: 8065)

C5-5409 Target:
5'-GTATTACAAAAACATGGCCTTTGCTTG-3'
(SEQ ID NO: 10375)

5'-U<u>UA</u>CAAAAACAUGG<u>CC</u>UUUGCUUga-3' (SEQ ID NO: 5756)

3'-<u>AUA</u>A<u>U</u>GUUUUUGUA<u>CC</u>GGAAACG<u>AACU</u>-5' (SEQ ID NO: 8066)

C5-5410 Target:
5'-TATTACAAAAACATGGCCTTTGCTTGA-3'
(SEQ ID NO: 10376)

5'-U<u>AC</u>AAAAACAUGGC<u>C</u>UUUGCUUGaa-3' (SEQ ID NO: 5757)

3'-<u>UAA</u>UGUUUUUGUAC<u>C</u>GGAAACGA<u>ACUU</u>-5' (SEQ ID NO: 8067)

C5-5411 Target:
5'-ATTACAAAAACATGGCCTTTGCTTGAA-3'
(SEQ ID NO: 10377)

5'-A<u>CA</u>AAAACAUGGCC<u>UU</u>UGCUUGAaa-3' (SEQ ID NO: 5758)

3'-<u>AAU</u>GUUUUUGUACC<u>GG</u>AAACGAA<u>CUUU</u>-5' (SEQ ID NO: 8068)

C5-5412 Target:
5'-TTACAAAAACATGGCCTTTGCTTGAAA-3'
(SEQ ID NO: 10378)

5'-C<u>A</u>AAAACAUGGCCU<u>UUU</u>GCUUGAAag-3' (SEQ ID NO: 5759)

3'-<u>A</u>U<u>G</u>UUUUUGUACCGG<u>AAA</u>CGAACUUUC-5' (SEQ ID NO: 8069)

TABLE 7-continued

Human Anti-C5 DsiRNAs Predicted to have >50% Knockdown Efficacy (Asymmetrics)

C5-5413 Target:
5'-TACAAAAACATGGCCTTTGCTTGAAAG-3'
(SEQ ID NO: 10379)

5'-<u>AAAA</u>ACAUGGCCUUUGC<u>U</u>UGAAAga-3' (SEQ ID NO: 5760)

3'-<u>UGU</u>UUUUGUACCGGAAA<u>C</u>GAACUU<u>UCU</u>-5' (SEQ ID NO: 8070)

C5-5414 Target:
5'-ACAAAAACATGGCCTTTGCTTGAAAGA-3'
(SEQ ID NO: 10380)

5'-A<u>AAA</u>CAUGGCCUUUG<u>C</u>UUGAAAGaa-3' (SEQ ID NO: 5761)

3'-<u>G</u>UUUUUGUACCGGAAA<u>C</u>GAACUU<u>UCUU</u>-5' (SEQ ID NO: 8071)

C5-5415 Target:
5'-CAAAAACATGGCCTTTGCTTGAAAGAA-3'
(SEQ ID NO: 10381)

5'-A<u>AA</u>CAUGGCCUUUGC<u>U</u>UGAAAGAaa-3' (SEQ ID NO: 5762)

3'-<u>UUUU</u>UGUACCGGAAA<u>C</u>GAACUU<u>UCUUU</u>-5' (SEQ ID NO: 8072)

C5-5416 Target:
5'-AAAAACATGGCCTTTGCTTGAAAGAAA-3'
(SEQ ID NO: 10382)

5'-A<u>AC</u>AUGGCCUUUGC<u>U</u>UGAAAGAAaa-3' (SEQ ID NO: 5763)

3'-<u>UUUU</u>GUACCGGAAA<u>C</u>GAACUUU<u>CUUUU</u>-5' (SEQ ID NO: 8073)

C5-5417 Target:
5'-AAAACATGGCCTTTGCTTGAAAGAAAA-3'
(SEQ ID NO: 10383)

5'-A<u>C</u>AUGGCCUUUGC<u>UU</u>GAAAGAAAat-3' (SEQ ID NO: 5764)

3'-<u>UUU</u>GUACCGGAAACGAACUUU<u>CUUUUA</u>-5' (SEQ ID NO: 8074)

C5-5418 Target:
5'-AAACATGGCCTTTGCTTGAAAGAAAAT-3'
(SEQ ID NO: 10384)

5'-C<u>AU</u>GGCCUUUGCUU<u>G</u>AAAGAAAAta-3' (SEQ ID NO: 5765)

3'-<u>UUG</u>UACCGGA<u>A</u>ACGAACUUUCUUU<u>UAU</u>-5' (SEQ ID NO: 8075)

C5-5419 Target:
5'-AACATGGCCTTTGCTTGAAAGAAAATA-3'
(SEQ ID NO: 10385)

5'-A<u>UG</u>GCCUUUGCUUG<u>A</u>AAGAAAAUac-3' (SEQ ID NO: 5766)

3'-<u>UG</u>UACCGGAAACGA<u>A</u>CUUUCUUU<u>UAUG</u>-5' (SEQ ID NO: 8076)

C5-5420 Target:
5'-ACATGGCCTTTGCTTGAAAGAAAATAC-3'
(SEQ ID NO: 10386)

5'-<u>U</u>GGCCUUUGCUUG<u>A</u>AAGAAAAUAcc-3' (SEQ ID NO: 5767)

3'-<u>GU</u>ACCGGAAACGA<u>A</u>CUUUCUUUU<u>AUGG</u>-5' (SEQ ID NO: 8077)

C5-5421 Target:
5'-CATGGCCTTTGCTTGAAAGAAAATACC-3'
(SEQ ID NO: 10387)

5'-GG<u>CC</u>UUUGCUUGA<u>A</u>AGAAAAUA<u>C</u>ca-3' (SEQ ID NO: 5768)

3'-<u>UA</u>CCGGAAACGAACUUUCUUUU<u>AUGGU</u>-5' (SEQ ID NO: 8078)

TABLE 7-continued

Human Anti-C5 DsiRNAs Predicted to have >50% Knockdown Efficacy (Asymmetrics)

C5-5422 Target:
5'-ATGGCCTTTGCTTGAAAGAAAATACCA-3'
(SEQ ID NO: 10388)

5'-G<u>CC</u>UUUGCUUGAAA<u>G</u>AAAAUACCaa-3' (SEQ ID NO: 5769)

3'-<u>ACC</u>GGAAACGAACUUU<u>C</u>UUUUAUGGUU-5' (SEQ ID NO: 8079)

C5-5423 Target:
5'-TGGCCTTTGCTTGAAAGAAAATACCAA-3'
(SEQ ID NO: 10389)

5'-C<u>CC</u>UUUGCUUGAAAG<u>A</u>AAAUACCAag-3' (SEQ ID NO: 5770)

3'-<u>CCG</u>GAAACGAACUUU<u>C</u>UUUUAUGGUUC-5' (SEQ ID NO: 8080)

C5-5424 Target:
5'-GGCCTTTGCTTGAAAGAAAATACCAAG-3'
(SEQ ID NO: 10390)

5'-C<u>CU</u>UUGCUUGAAAG<u>A</u>AAAUACCAAgg-3' (SEQ ID NO: 5771)

3'-<u>CGG</u>AAACGAACUUU<u>C</u>UUUUAUGGUUCC-5' (SEQ ID NO: 8081)

C5-5425 Target:
5'-GCCTTTGCTTGAAAGAAAATACCAAGG-3'
(SEQ ID NO: 10391)

5'-<u>UU</u>UGCUUGAAAGA<u>A</u>AUACCAAGga-3' (SEQ ID NO: 5772)

3'-<u>GGA</u>AACGAACUUUC<u>U</u>UUUAUGGUUCCU-5' (SEQ ID NO: 8082)

C5-5426 Target:
5'-CCTTTGCTTGAAAGAAAATACCAAGGA-3'
(SEQ ID NO: 10392)

5'-<u>UU</u>GCUUGAAAGAA<u>A</u>UACCAAGGaa-3' (SEQ ID NO: 5773)

3'-<u>GAA</u>ACGAACUUUCU<u>U</u>UUAUGGUU<u>CCUU</u>-5' (SEQ ID NO: 8083)

C5-5427 Target:
5'-CTTTGCTTGAAAGAAAATACCAAGGAA-3'
(SEQ ID NO: 10393)

5'-<u>U</u>G<u>C</u>UUGAAAGAAA<u>A</u>UACCAAGGAac-3' (SEQ ID NO: 5774)

3'-<u>AAA</u>CGAACUUUCUU<u>U</u>UAUGGUUCC<u>UUG</u>-5' (SEQ ID NO: 8084)

C5-5428 Target:
5'-TTTGCTTGAAAGAAAATACCAAGGAAC-3'
(SEQ ID NO: 10394)

5'-<u>A</u>C<u>AGG</u>AAACUGAUC<u>A</u>UUAAAGCCUg-3' (SEQ ID NO: 5775)

3'-<u>CUUGU</u>CCUUUGACUAGUAAUUUC<u>GGAC</u>-5' (SEQ ID NO: 8085)

C5-5451 Target:
5'-GAACAGGAAACTGATCATTAAAGCCTG-3'
(SEQ ID NO: 10395)

5'-C<u>AGG</u>AAACUGAUC<u>A</u>UUAAAGCCUga-3' (SEQ ID NO: 5776)

3'-<u>UUGU</u>CCUUUGACUAG<u>U</u>AAUUUCGGA<u>CU</u>-5' (SEQ ID NO: 8086)

C5-5452 Target:
5'-AACAGGAAACTGATCATTAAAGCCTGA-3'
(SEQ ID NO: 10396)

5'-A<u>GG</u>AAACUGAUC<u>A</u>UUAAAGCCUGag-3' (SEQ ID NO: 5777)

3'-<u>UGUC</u>CUUUGACUAGU<u>A</u>AUUUCGGA<u>CUC</u>-5' (SEQ ID NO: 8087)

C5-5453 Target:
5'-ACAGGAAACTGATCATTAAAGCCTGAG-3'
(SEQ ID NO: 10397)

5'-GG<u>A</u>AACUGAUCAUU<u>AAA</u>GCCUGAgt-3' (SEQ ID NO: 5778)

3'-<u>GUCC</u>UUUGACUAGUA<u>A</u>UUUCGGA<u>CUCA</u>-5' (SEQ ID NO: 8088)

C5-5454 Target:
5'-CAGGAAACTGATCATTAAAGCCTGAGT-3'
(SEQ ID NO: 10398)

5'-G<u>AA</u>ACUGAUCAUU<u>AAA</u>GCCUGAGtt-3' (SEQ ID NO: 5779)

3'-<u>UCC</u>UUUGACUAGUA<u>A</u>UUUCGGACU<u>CAA</u>-5' (SEQ ID NO: 8089)

C5-5455 Target:
5'-AGGAAACTGATCATTAAAGCCTGAGTT-3'
(SEQ ID NO: 10399)

5'-<u>AAA</u>CUGAUCAUUA<u>AA</u>GCCUGAGUtt-3' (SEQ ID NO: 5780)

3'-<u>CC</u>UUUGACUAGUAA<u>U</u>UUCGGACUC<u>AAA</u>-5' (SEQ ID NO: 8090)

C5-5456 Target:
5'-GGAAACTGATCATTAAAGCCTGAGTTT-3'
(SEQ ID NO: 10400)

5'-<u>A</u>ACUGAUCAUUAA<u>A</u>G<u>C</u>CUGAGUUtg-3' (SEQ ID NO: 5781)

3'-<u>C</u>UUUGACUAGUAAU<u>U</u>UCGGACUC<u>AAAC</u>-5' (SEQ ID NO: 8091)

C5-5457 Target:
5'-GAAACTGATCATTAAAGCCTGAGTTTG-3'
(SEQ ID NO: 10401)

5'-<u>A</u>CUGAUCAUUAAAG<u>CC</u>UGAGUUUgc-3' (SEQ ID NO: 5782)

3'-<u>UUUG</u>ACUAGUAAUU<u>U</u>CGGACUC<u>AACG</u>-5' (SEQ ID NO: 8092)

C5-5458 Target:
5'-AAACTGATCATTAAAGCCTGAGTTTGC-3'
(SEQ ID NO: 10402)

5'-CUG<u>A</u>UCAUUAAAGC<u>C</u>UGAGUUUGct-3' (SEQ ID NO: 5783)

3'-<u>UUGA</u>CUAGUAAUUU<u>C</u>GGACUCA<u>ACGA</u>-5' (SEQ ID NO: 8093)

C5-5459 Target:
5'-AACTGATCATTAAAGCCTGAGTTTGCT-3'
(SEQ ID NO: 10403)

5'-UG<u>A</u>UCAUUAAAGC<u>CU</u>GAGUUUGCtt-3' (SEQ ID NO: 5784)

3'-<u>UGAC</u>UAGUAAUUUCGGACUCAAA<u>CGAA</u>-5' (SEQ ID NO: 8094)

C5-5460 Target:
5'-ACTGATCATTAAAGCCTGAGTTTGCTT-3'
(SEQ ID NO: 10404)

5'-G<u>AU</u>CAUUAAAGCC<u>UG</u>AGUUUGCUtt-3' (SEQ ID NO: 5785)

3'-<u>GACU</u>AGUAAUUUCGG<u>A</u>CUCAAACGAAA-5' (SEQ ID NO: 8095)

C5-5461 Target:
5'-CTGATCATTAAAGCCTGAGTTTGCTTT-3'
(SEQ ID NO: 10405)

5'-A<u>UC</u>AUUAAAGCCUG<u>A</u>G<u>U</u>UUGCUUtc-3' (SEQ ID NO: 5786)

3'-<u>ACUA</u>GUAAUUUCGG<u>A</u>CUCAAACGAAAG-5' (SEQ ID NO: 8096)

TABLE 7-continued

Human Anti-C5 DsiRNAs Predicted to have >50% Knockdown Efficacy (Asymmetrics)

C5-5462 Target:
5'-TGATCATTAAAGCCTGAGTTTGCTTTC-3'
(SEQ ID NO: 10406)

5'-U<u>CAU</u>UAAAGCCUGA<u>G</u>U<u>U</u>UG<u>C</u>UUUca-3' (SEQ ID NO: 5787)

3'-<u>CUAGU</u>AAUUUCGGA<u>CU</u>C<u>AAA</u>CGA<u>AAGU</u>-5' (SEQ ID NO: 8097)

C5-5463 Target:
5'-GATCATTAAAGCCTGAGTTTGCTTTCA-3'
(SEQ ID NO: 10407)

5'-U<u>UAAA</u>GCCUGAGU<u>U</u>UG<u>C</u>UUUCAAaa-3' (SEQ ID NO: 5788)

3'-<u>GU</u>A<u>A</u>UUUCGGACUC<u>AAA</u>CGAAAGU<u>UUUU</u>-5' (SEQ ID NO: 8098)

TABLE 7-continued

Human Anti-C5 DsiRNAs Predicted to have >50% Knockdown Efficacy (Asymmetrics)

C5-5466 Target:
5'-CATTAAAGCCTGAGTTTGCTTTCAAAA-3'
(SEQ ID NO: 10408)

5'-U<u>AAA</u>GCCUGAGUU<u>U</u>G<u>C</u>UUUCAAAaa-3' (SEQ ID NO: 5789)

3'-<u>UAAU</u>UUCGGACUCA<u>AA</u>CGAAAGU<u>UUUU</u>-5' (SEQ ID NO: 8099)

C5-5467 Target:
5'-ATTAAAGCCTGAGTTTGCTTTCAAAAA-3'
(SEQ ID NO: 10409)

TABLE 8

DsiRNA Target Sequences (21 mers) of Human Anti-C5 DsiRNAs Predicted to have > 50% Knockdown Efficacy

| ID | | |
|---|---|---|
| C5-40 | 21 nt Target: 5'-UCCUGCUACCUCCAACCAUGG-3' | (SEQ ID NO: 10410) |
| C5-41 | 21 nt Target: 5'-CCUGCUACCUCCAACCAUGGG-3' | (SEQ ID NO: 10411) |
| C5-42 | 21 nt Target: 5'-CUGCUACCUCCAACCAUGGGC-3' | (SEQ ID NO: 10412) |
| C5-43 | 21 nt Target: 5'-UGCUACCUCCAACCAUGGGCC-3' | (SEQ ID NO: 10413) |
| C5-46 | 21 nt Target: 5'-UACCUCCAACCAUGGGCCUUU-3' | (SEQ ID NO: 10414) |
| C5-47 | 21 nt Target: 5'-ACCUCCAACCAUGGGCCUUUU-3' | (SEQ ID NO: 10415) |
| C5-48 | 21 nt Target: 5'-CCUCCAACCAUGGGCCUUUUG-3' | (SEQ ID NO: 10416) |
| C5-49 | 21 nt Target: 5'-CUCCAACCAUGGGCCUUUUGG-3' | (SEQ ID NO: 10417) |
| C5-50 | 21 nt Target: 5'-UCCAACCAUGGGCCUUUUGGG-3' | (SEQ ID NO: 10418) |
| C5-51 | 21 nt Target: 5'-CCAACCAUGGGCCUUUUGGGA-3' | (SEQ ID NO: 10419) |
| C5-52 | 21 nt Target: 5'-CAACCAUGGGCCUUUUGGGAA-3' | (SEQ ID NO: 10420) |
| C5-53 | 21 nt Target: 5'-AACCAUGGGCCUUUUGGGAAU-3' | (SEQ ID NO: 10421) |
| C5-54 | 21 nt Target: 5'-ACCAUGGGCCUUUUGGGAAUA-3' | (SEQ ID NO: 10422) |
| C5-55 | 21 nt Target: 5'-CCAUGGGCCUUUUGGGAAUAC-3' | (SEQ ID NO: 10423) |
| C5-56 | 21 nt Target: 5'-CAUGGGCCUUUUGGGAAUACU-3' | (SEQ ID NO: 10424) |
| C5-57 | 21 nt Target: 5'-AUGGGCCUUUUGGGAAUACUU-3' | (SEQ ID NO: 10425) |
| C5-58 | 21 nt Target: 5'-UGGGCCUUUUGGGAAUACUUU-3' | (SEQ ID NO: 10426) |
| C5-59 | 21 nt Target: 5'-GGGCCUUUUGGGAAUACUUUG-3' | (SEQ ID NO: 10427) |
| C5-60 | 21 nt Target: 5'-GGCCUUUUGGGAAUACUUUGU-3' | (SEQ ID NO: 10428) |
| C5-61 | 21 nt Target: 5'-GCCUUUUGGGAAUACUUUGUU-3' | (SEQ ID NO: 10429) |
| C5-62 | 21 nt Target: 5'-CCUUUUGGGAAUACUUUGUUU-3' | (SEQ ID NO: 10430) |
| C5-63 | 21 nt Target: 5'-CUUUUGGGAAUACUUUGUUUU-3' | (SEQ ID NO: 10431) |
| C5-64 | 21 nt Target: 5'-UUUUGGGAAUACUUUGUUUUU-3' | (SEQ ID NO: 10432) |
| C5-65 | 21 nt Target: 5'-UUUGGGAAUACUUUGUUUUUU-3' | (SEQ ID NO: 10433) |
| C5-66 | 21 nt Target: 5'-UUGGGAAUACUUUGUUUUUUA-3' | (SEQ ID NO: 10434) |
| C5-67 | 21 nt Target: 5'-UGGGAAUACUUUGUUUUUUAA-3' | (SEQ ID NO: 10435) |
| C5-68 | 21 nt Target: 5'-GGGAAUACUUUGUUUUUUAAU-3' | (SEQ ID NO: 10436) |

TABLE 8-continued

| DsiRNA Target Sequences (21 mers) of Human Anti-C5 DsiRNAs Predicted to have > 50% Knockdown Efficacy | |
|---|---|
| C5-69 | 21 nt Target: 5'-GGAAUACUUUGUUUUUUAAUC-3' (SEQ ID NO: 10437) |
| C5-70 | 21 nt Target: 5'-GAAUACUUUGUUUUUUAAUCU-3' (SEQ ID NO: 10438) |
| C5-71 | 21 nt Target: 5'-AAUACUUUGUUUUUUAAUCUU-3' (SEQ ID NO: 10439) |
| C5-72 | 21 nt Target: 5'-AUACUUUGUUUUUUAAUCUUC-3' (SEQ ID NO: 10440) |
| C5-73 | 21 nt Target: 5'-UACUUUGUUUUUUAAUCUUCC-3' (SEQ ID NO: 10441) |
| C5-74 | 21 nt Target: 5'-ACUUUGUUUUUUAAUCUUCCU-3' (SEQ ID NO: 10442) |
| C5-75 | 21 nt Target: 5'-CUUUGUUUUUUAAUCUUCCUG-3' (SEQ ID NO: 10443) |
| C5-76 | 21 nt Target: 5'-UUUGUUUUUUAAUCUUCCUGG-3' (SEQ ID NO: 10444) |
| C5-77 | 21 nt Target: 5'-UUGUUUUUUAAUCUUCCUGGG-3' (SEQ ID NO: 10445) |
| C5-103 | 21 nt Target: 5'-CCUGGGGACAGGAGCAAACAU-3' (SEQ ID NO: 10446) |
| C5-104 | 21 nt Target: 5'-CUGGGGACAGGAGCAAACAUA-3' (SEQ ID NO: 10447) |
| C5-105 | 21 nt Target: 5'-UGGGGACAGGAGCAAACAUAU-3' (SEQ ID NO: 10448) |
| C5-106 | 21 nt Target: 5'-GGGGACAGGAGCAAACAUAUG-3' (SEQ ID NO: 10449) |
| C5-107 | 21 nt Target: 5'-GGGACAGGAGCAAACAUAUGU-3' (SEQ ID NO: 10450) |
| C5-108 | 21 nt Target: 5'-GGACAGGAGCAAACAUAUGUC-3' (SEQ ID NO: 10451) |
| C5-109 | 21 nt Target: 5'-GACAGGAGCAAACAUAUGUCA-3' (SEQ ID NO: 10452) |
| C5-110 | 21 nt Target: 5'-ACAGGAGCAAACAUAUGUCAU-3' (SEQ ID NO: 10453) |
| C5-111 | 21 nt Target: 5'-CAGGAGCAAACAUAUGUCAUU-3' (SEQ ID NO: 10454) |
| C5-112 | 21 nt Target: 5'-AGGAGCAAACAUAUGUCAUUU-3' (SEQ ID NO: 10455) |
| C5-113 | 21 nt Target: 5'-GGAGCAAACAUAUGUCAUUUC-3' (SEQ ID NO: 10456) |
| C5-114 | 21 nt Target: 5'-GAGCAAACAUAUGUCAUUUCA-3' (SEQ ID NO: 10457) |
| C5-115 | 21 nt Target: 5'-AGCAAACAUAUGUCAUUUCAG-3' (SEQ ID NO: 10458) |
| C5-116 | 21 nt Target: 5'-GCAAACAUAUGUCAUUUCAGC-3' (SEQ ID NO: 10459) |
| C5-117 | 21 nt Target: 5'-CAAACAUAUGUCAUUUCAGCA-3' (SEQ ID NO: 10460) |
| C5-118 | 21 nt Target: 5'-AAACAUAUGUCAUUUCAGCAC-3' (SEQ ID NO: 10461) |
| C5-119 | 21 nt Target: 5'-AACAUAUGUCAUUUCAGCACC-3' (SEQ ID NO: 10462) |
| C5-121 | 21 nt Target: 5'-CAUAUGUCAUUUCAGCACCAA-3' (SEQ ID NO: 10463) |
| C5-122 | 21 nt Target: 5'-AUAUGUCAUUUCAGCACCAAA-3' (SEQ ID NO: 10464) |
| C5-123 | 21 nt Target: 5'-UAUGUCAUUUCAGCACCAAAA-3' (SEQ ID NO: 10465) |
| C5-124 | 21 nt Target: 5'-AUGUCAUUUCAGCACCAAAAA-3' (SEQ ID NO: 10466) |
| C5-125 | 21 nt Target: 5'-UGUCAUUUCAGCACCAAAAAU-3' (SEQ ID NO: 10467) |
| C5-126 | 21 nt Target: 5'-GUCAUUUCAGCACCAAAAAUA-3' (SEQ ID NO: 10468) |
| C5-127 | 21 nt Target: 5'-UCAUUUCAGCACCAAAAAUAU-3' (SEQ ID NO: 10469) |
| C5-128 | 21 nt Target: 5'-CAUUUCAGCACCAAAAAUAUU-3' (SEQ ID NO: 10470) |
| C5-129 | 21 nt Target: 5'-AUUUCAGCACCAAAAAUAUUC-3' (SEQ ID NO: 10471) |
| C5-130 | 21 nt Target: 5'-UUUCAGCACCAAAAAUAUUCC-3' (SEQ ID NO: 10472) |
| C5-131 | 21 nt Target: 5'-UUCAGCACCAAAAAUAUUCCG-3' (SEQ ID NO: 10473) |
| C5-132 | 21 nt Target: 5'-UCAGCACCAAAAAUAUUCCGU-3' (SEQ ID NO: 10474) |

TABLE 8-continued

DsiRNA Target Sequences (21 mers) of Human Anti-C5
DsiRNAs Predicted to have > 50% Knockdown Efficacy

| | | |
|---|---|---|
| C5-133 | 21 nt Target: 5'-CAGCACCAAAAAUAUUCCGUG-3' | (SEQ ID NO: 10475) |
| C5-134 | 21 nt Target: 5'-AGCACCAAAAAUAUUCCGUGU-3' | (SEQ ID NO: 10476) |
| C5-135 | 21 nt Target: 5'-GCACCAAAAAUAUUCCGUGUU-3' | (SEQ ID NO: 10477) |
| C5-136 | 21 nt Target: 5'-CACCAAAAAUAUUCCGUGUUG-3' | (SEQ ID NO: 10478) |
| C5-137 | 21 nt Target: 5'-ACCAAAAAUAUUCCGUGUUGG-3' | (SEQ ID NO: 10479) |
| C5-138 | 21 nt Target: 5'-CCAAAAAUAUUCCGUGUUGGA-3' | (SEQ ID NO: 10480) |
| C5-139 | 21 nt Target: 5'-CAAAAAUAUUCCGUGUUGGAG-3' | (SEQ ID NO: 10481) |
| C5-140 | 21 nt Target: 5'-AAAAAUAUUCCGUGUUGGAGC-3' | (SEQ ID NO: 10482) |
| C5-141 | 21 nt Target: 5'-AAAAUAUUCCGUGUUGGAGCA-3' | (SEQ ID NO: 10483) |
| C5-142 | 21 nt Target: 5'-AAAUAUUCCGUGUUGGAGCAU-3' | (SEQ ID NO: 10484) |
| C5-143 | 21 nt Target: 5'-AAUAUUCCGUGUUGGAGCAUC-3' | (SEQ ID NO: 10485) |
| C5-144 | 21 nt Target: 5'-AUAUUCCGUGUUGGAGCAUCU-3' | (SEQ ID NO: 10486) |
| C5-145 | 21 nt Target: 5'-UAUUCCGUGUUGGAGCAUCUG-3' | (SEQ ID NO: 10487) |
| C5-146 | 21 nt Target: 5'-AUUCCGUGUUGGAGCAUCUGA-3' | (SEQ ID NO: 10488) |
| C5-147 | 21 nt Target: 5'-UUCCGUGUUGGAGCAUCUGAA-3' | (SEQ ID NO: 10489) |
| C5-148 | 21 nt Target: 5'-UCCGUGUUGGAGCAUCUGAAA-3' | (SEQ ID NO: 10490) |
| C5-149 | 21 nt Target: 5'-CCGUGUUGGAGCAUCUGAAAA-3' | (SEQ ID NO: 10491) |
| C5-181 | 21 nt Target: 5'-AAGUUUAUGGAUACACUGAAG-3' | (SEQ ID NO: 10492) |
| C5-184 | 21 nt Target: 5'-UUUAUGGAUACACUGAAGCAU-3' | (SEQ ID NO: 10493) |
| C5-186 | 21 nt Target: 5'-UAUGGAUACACUGAAGCAUUU-3' | (SEQ ID NO: 10494) |
| C5-195 | 21 nt Target: 5'-ACUGAAGCAUUUGAUGCAACA-3' | (SEQ ID NO: 10495) |
| C5-197 | 21 nt Target: 5'-UGAAGCAUUUGAUGCAACAAU-3' | (SEQ ID NO: 10496) |
| C5-199 | 21 nt Target: 5'-AAGCAUUUGAUGCAACAAUCU-3' | (SEQ ID NO: 10497) |
| C5-201 | 21 nt Target: 5'-GCAUUUGAUGCAACAAUCUCU-3' | (SEQ ID NO: 10498) |
| C5-202 | 21 nt Target: 5'-CAUUUGAUGCAACAAUCUCUA-3' | (SEQ ID NO: 10499) |
| C5-203 | 21 nt Target: 5'-AUUUGAUGCAACAAUCUCUAU-3' | (SEQ ID NO: 10500) |
| C5-208 | 21 nt Target: 5'-AUGCAACAAUCUCUAUUAAAA-3' | (SEQ ID NO: 10501) |
| C5-209 | 21 nt Target: 5'-UGCAACAAUCUCUAUUAAAAG-3' | (SEQ ID NO: 10502) |
| C5-210 | 21 nt Target: 5'-GCAACAAUCUCUAUUAAAAGU-3' | (SEQ ID NO: 10503) |
| C5-213 | 21 nt Target: 5'-ACAAUCUCUAUUAAAAGUUAU-3' | (SEQ ID NO: 10504) |
| C5-214 | 21 nt Target: 5'-CAAUCUCUAUUAAAAGUUAUC-3' | (SEQ ID NO: 10505) |
| C5-215 | 21 nt Target: 5'-AAUCUCUAUUAAAAGUUAUCC-3' | (SEQ ID NO: 10506) |
| C5-216 | 21 nt Target: 5'-AUCUCUAUUAAAAGUUAUCCU-3' | (SEQ ID NO: 10507) |
| C5-217 | 21 nt Target: 5'-UCUCUAUUAAAAGUUAUCCUG-3' | (SEQ ID NO: 10508) |
| C5-219 | 21 nt Target: 5'-UCUAUUAAAAGUUAUCCUGAU-3' | (SEQ ID NO: 10509) |
| C5-221 | 21 nt Target: 5'-UAUUAAAAGUUAUCCUGAUAA-3' | (SEQ ID NO: 10510) |
| C5-222 | 21 nt Target: 5'-AUUAAAAGUUAUCCUGAUAAA-3' | (SEQ ID NO: 10511) |
| C5-225 | 21 nt Target: 5'-AAAAGUUAUCCUGAUAAAAAA-3' | (SEQ ID NO: 10512) |
| C5-226 | 21 nt Target: 5'-AAAGUUAUCCUGAUAAAAAAU-3' | (SEQ ID NO: 10513) |

TABLE 8-continued

| DsiRNA Target Sequences (21 mers) of Human Anti-C5 DsiRNAs Predicted to have > 50% Knockdown Efficacy | | |
|---|---|---|
| C5-229 | 21 nt Target: 5'-GUUAUCCUGAUAAAAAAUUUA-3' | (SEQ ID NO: 10514) |
| C5-230 | 21 nt Target: 5'-UUAUCCUGAUAAAAAAUUUAG-3' | (SEQ ID NO: 10515) |
| C5-231 | 21 nt Target: 5'-UAUCCUGAUAAAAAAUUUAGU-3' | (SEQ ID NO: 10516) |
| C5-232 | 21 nt Target: 5'-AUCCUGAUAAAAAAUUUAGUU-3' | (SEQ ID NO: 10517) |
| C5-233 | 21 nt Target: 5'-UCCUGAUAAAAAAUUUAGUUA-3' | (SEQ ID NO: 10518) |
| C5-234 | 21 nt Target: 5'-CCUGAUAAAAAAUUUAGUUAC-3' | (SEQ ID NO: 10519) |
| C5-235 | 21 nt Target: 5'-CUGAUAAAAAAUUUAGUUACU-3' | (SEQ ID NO: 10520) |
| C5-236 | 21 nt Target: 5'-UGAUAAAAAAUUUAGUUACUC-3' | (SEQ ID NO: 10521) |
| C5-237 | 21 nt Target: 5'-GAUAAAAAAUUUAGUUACUCC-3' | (SEQ ID NO: 10522) |
| C5-238 | 21 nt Target: 5'-AUAAAAAAUUUAGUUACUCCU-3' | (SEQ ID NO: 10523) |
| C5-239 | 21 nt Target: 5'-UAAAAAAUUUAGUUACUCCUC-3' | (SEQ ID NO: 10524) |
| C5-240 | 21 nt Target: 5'-AAAAAAUUUAGUUACUCCUCA-3' | (SEQ ID NO: 10525) |
| C5-241 | 21 nt Target: 5'-AAAAAUUUAGUUACUCCUCAG-3' | (SEQ ID NO: 10526) |
| C5-242 | 21 nt Target: 5'-AAAAUUUAGUUACUCCUCAGG-3' | (SEQ ID NO: 10527) |
| C5-243 | 21 nt Target: 5'-AAAUUUAGUUACUCCUCAGGC-3' | (SEQ ID NO: 10528) |
| C5-244 | 21 nt Target: 5'-AAUUUAGUUACUCCUCAGGCC-3' | (SEQ ID NO: 10529) |
| C5-245 | 21 nt Target: 5'-AUUUAGUUACUCCUCAGGCCA-3' | (SEQ ID NO: 10530) |
| C5-246 | 21 nt Target: 5'-UUUAGUUACUCCUCAGGCCAU-3' | (SEQ ID NO: 10531) |
| C5-247 | 21 nt Target: 5'-UUAGUUACUCCUCAGGCCAUG-3' | (SEQ ID NO: 10532) |
| C5-248 | 21 nt Target: 5'-UAGUUACUCCUCAGGCCAUGU-3' | (SEQ ID NO: 10533) |
| C5-249 | 21 nt Target: 5'-AGUUACUCCUCAGGCCAUGUU-3' | (SEQ ID NO: 10534) |
| C5-250 | 21 nt Target: 5'-GUUACUCCUCAGGCCAUGUUC-3' | (SEQ ID NO: 10535) |
| C5-251 | 21 nt Target: 5'-UUACUCCUCAGGCCAUGUUCA-3' | (SEQ ID NO: 10536) |
| C5-252 | 21 nt Target: 5'-UACUCCUCAGGCCAUGUUCAU-3' | (SEQ ID NO: 10537) |
| C5-253 | 21 nt Target: 5'-ACUCCUCAGGCCAUGUUCAUU-3' | (SEQ ID NO: 10538) |
| C5-254 | 21 nt Target: 5'-CUCCUCAGGCCAUGUUCAUUU-3' | (SEQ ID NO: 10539) |
| C5-255 | 21 nt Target: 5'-UCCUCAGGCCAUGUUCAUUUA-3' | (SEQ ID NO: 10540) |
| C5-256 | 21 nt Target: 5'-CCUCAGGCCAUGUUCAUUUAU-3' | (SEQ ID NO: 10541) |
| C5-257 | 21 nt Target: 5'-CUCAGGCCAUGUUCAUUUAUC-3' | (SEQ ID NO: 10542) |
| C5-258 | 21 nt Target: 5'-UCAGGCCAUGUUCAUUUAUCC-3' | (SEQ ID NO: 10543) |
| C5-259 | 21 nt Target: 5'-CAGGCCAUGUUCAUUUAUCCU-3' | (SEQ ID NO: 10544) |
| C5-260 | 21 nt Target: 5'-AGGCCAUGUUCAUUUAUCCUC-3' | (SEQ ID NO: 10545) |
| C5-261 | 21 nt Target: 5'-GGCCAUGUUCAUUUAUCCUCA-3' | (SEQ ID NO: 10546) |
| C5-262 | 21 nt Target: 5'-GCCAUGUUCAUUUAUCCUCAG-3' | (SEQ ID NO: 10547) |
| C5-263 | 21 nt Target: 5'-CCAUGUUCAUUUAUCCUCAGA-3' | (SEQ ID NO: 10548) |
| C5-264 | 21 nt Target: 5'-CAUGUUCAUUUAUCCUCAGAG-3' | (SEQ ID NO: 10549) |
| C5-267 | 21 nt Target: 5'-GUUCAUUUAUCCUCAGAGAAU-3' | (SEQ ID NO: 10550) |
| C5-268 | 21 nt Target: 5'-UUCAUUUAUCCUCAGAGAAUA-3' | (SEQ ID NO: 10551) |

TABLE 8-continued

DsiRNA Target Sequences (21 mers) of Human Anti-C5
DsiRNAs Predicted to have > 50% Knockdown Efficacy

| ID | Target |
|---|---|
| C5-269 | 21 nt Target: 5'-UCAUUUAUCCUCAGAGAAUAA-3' (SEQ ID NO: 10552) |
| C5-270 | 21 nt Target: 5'-CAUUUAUCCUCAGAGAAUAAA-3' (SEQ ID NO: 10553) |
| C5-271 | 21 nt Target: 5'-AUUUAUCCUCAGAGAAUAAAU-3' (SEQ ID NO: 10554) |
| C5-272 | 21 nt Target: 5'-UUUAUCCUCAGAGAAUAAAUU-3' (SEQ ID NO: 10555) |
| C5-273 | 21 nt Target: 5'-UUAUCCUCAGAGAAUAAAUUC-3' (SEQ ID NO: 10556) |
| C5-274 | 21 nt Target: 5'-UAUCCUCAGAGAAUAAAUUCC-3' (SEQ ID NO: 10557) |
| C5-275 | 21 nt Target: 5'-AUCCUCAGAGAAUAAAUUCCA-3' (SEQ ID NO: 10558) |
| C5-276 | 21 nt Target: 5'-UCCUCAGAGAAUAAAUUCCAA-3' (SEQ ID NO: 10559) |
| C5-277 | 21 nt Target: 5'-CCUCAGAGAAUAAAUUCCAAA-3' (SEQ ID NO: 10560) |
| C5-278 | 21 nt Target: 5'-CUCAGAGAAUAAAUUCCAAAA-3' (SEQ ID NO: 10561) |
| C5-279 | 21 nt Target: 5'-UCAGAGAAUAAAUUCCAAAAC-3' (SEQ ID NO: 10562) |
| C5-280 | 21 nt Target: 5'-CAGAGAAUAAAUUCCAAAACU-3' (SEQ ID NO: 10563) |
| C5-281 | 21 nt Target: 5'-AGAGAAUAAAUUCCAAAACUC-3' (SEQ ID NO: 10564) |
| C5-305 | 21 nt Target: 5'-AAUCUUAACAAUACAACCAAA-3' (SEQ ID NO: 10565) |
| C5-306 | 21 nt Target: 5'-AUCUUAACAAUACAACCAAAA-3' (SEQ ID NO: 10566) |
| C5-307 | 21 nt Target: 5'-UCUUAACAAUACAACCAAAAC-3' (SEQ ID NO: 10567) |
| C5-308 | 21 nt Target: 5'-CUUAACAAUACAACCAAAACA-3' (SEQ ID NO: 10568) |
| C5-309 | 21 nt Target: 5'-UUAACAAUACAACCAAAACAA-3' (SEQ ID NO: 10569) |
| C5-310 | 21 nt Target: 5'-UAACAAUACAACCAAAACAAU-3' (SEQ ID NO: 10570) |
| C5-311 | 21 nt Target: 5'-AACAAUACAACCAAAACAAUU-3' (SEQ ID NO: 10571) |
| C5-362 | 21 nt Target: 5'-GUAUUUGGAAGUUGUAUCAAA-3' (SEQ ID NO: 10572) |
| C5-363 | 21 nt Target: 5'-UAUUUGGAAGUUGUAUCAAAG-3' (SEQ ID NO: 10573) |
| C5-374 | 21 nt Target: 5'-UGUAUCAAAGCAUUUUUCAAA-3' (SEQ ID NO: 10574) |
| C5-375 | 21 nt Target: 5'-GUAUCAAAGCAUUUUUCAAAA-3' (SEQ ID NO: 10575) |
| C5-376 | 21 nt Target: 5'-UAUCAAAGCAUUUUUCAAAAU-3' (SEQ ID NO: 10576) |
| C5-377 | 21 nt Target: 5'-AUCAAAGCAUUUUUCAAAAUC-3' (SEQ ID NO: 10577) |
| C5-378 | 21 nt Target: 5'-UCAAAGCAUUUUUCAAAAUCA-3' (SEQ ID NO: 10578) |
| C5-406 | 21 nt Target: 5'-UGCCAAUAACCUAUGACAAUG-3' (SEQ ID NO: 10579) |
| C5-407 | 21 nt Target: 5'-GCCAAUAACCUAUGACAAUGG-3' (SEQ ID NO: 10580) |
| C5-409 | 21 nt Target: 5'-CAAUAACCUAUGACAAUGGAU-3' (SEQ ID NO: 10581) |
| C5-410 | 21 nt Target: 5'-AAUAACCUAUGACAAUGGAUU-3' (SEQ ID NO: 10582) |
| C5-411 | 21 nt Target: 5'-AUAACCUAUGACAAUGGAUUU-3' (SEQ ID NO: 10583) |
| C5-412 | 21 nt Target: 5'-UAACCUAUGACAAUGGAUUUC-3' (SEQ ID NO: 10584) |
| C5-413 | 21 nt Target: 5'-AACCUAUGACAAUGGAUUUCU-3' (SEQ ID NO: 10585) |
| C5-415 | 21 nt Target: 5'-CCUAUGACAAUGGAUUUCUCU-3' (SEQ ID NO: 10586) |
| C5-416 | 21 nt Target: 5'-CUAUGACAAUGGAUUUCUCUU-3' (SEQ ID NO: 10587) |
| C5-417 | 21 nt Target: 5'-UAUGACAAUGGAUUUCUCUUC-3' (SEQ ID NO: 10588) |
| C5-421 | 21 nt Target: 5'-ACAAUGGAUUUCUCUUCAUUC-3' (SEQ ID NO: 10589) |
| C5-424 | 21 nt Target: 5'-AUGGAUUUCUCUUCAUUCAUA-3' (SEQ ID NO: 10590) |

TABLE 8-continued

DsiRNA Target Sequences (21 mers) of Human Anti-C5
DsiRNAs Predicted to have > 50% Knockdown Efficacy

| | | |
|---|---|---|
| C5-426 | 21 nt Target: 5'-GGAUUUCUCUUCAUUCAUACA-3' | (SEQ ID NO: 10591) |
| C5-427 | 21 nt Target: 5'-GAUUUCUCUUCAUUCAUACAG-3' | (SEQ ID NO: 10592) |
| C5-428 | 21 nt Target: 5'-AUUUCUCUUCAUUCAUACAGA-3' | (SEQ ID NO: 10593) |
| C5-429 | 21 nt Target: 5'-UUUCUCUUCAUUCAUACAGAC-3' | (SEQ ID NO: 10594) |
| C5-430 | 21 nt Target: 5'-UUCUCUUCAUUCAUACAGACA-3' | (SEQ ID NO: 10595) |
| C5-431 | 21 nt Target: 5'-UCUCUUCAUUCAUACAGACAA-3' | (SEQ ID NO: 10596) |
| C5-432 | 21 nt Target: 5'-CUCUUCAUUCAUACAGACAAA-3' | (SEQ ID NO: 10597) |
| C5-433 | 21 nt Target: 5'-UCUUCAUUCAUACAGACAAAC-3' | (SEQ ID NO: 10598) |
| C5-434 | 21 nt Target: 5'-CUUCAUUCAUACAGACAAACC-3' | (SEQ ID NO: 10599) |
| C5-435 | 21 nt Target: 5'-UUCAUUCAUACAGACAAACCU-3' | (SEQ ID NO: 10600) |
| C5-437 | 21 nt Target: 5'-CAUUCAUACAGACAAACCUGU-3' | (SEQ ID NO: 10601) |
| C5-441 | 21 nt Target: 5'-CAUACAGACAAACCUGUUUAU-3' | (SEQ ID NO: 10602) |
| C5-442 | 21 nt Target: 5'-AUACAGACAAACCUGUUUAUA-3' | (SEQ ID NO: 10603) |
| C5-443 | 21 nt Target: 5'-UACAGACAAACCUGUUUAUAC-3' | (SEQ ID NO: 10604) |
| C5-444 | 21 nt Target: 5'-ACAGACAAACCUGUUUAUACU-3' | (SEQ ID NO: 10605) |
| C5-445 | 21 nt Target: 5'-CAGACAAACCUGUUUAUACUC-3' | (SEQ ID NO: 10606) |
| C5-446 | 21 nt Target: 5'-AGACAAACCUGUUUAUACUCC-3' | (SEQ ID NO: 10607) |
| C5-447 | 21 nt Target: 5'-GACAAACCUGUUUAUACUCCA-3' | (SEQ ID NO: 10608) |
| C5-448 | 21 nt Target: 5'-ACAAACCUGUUUAUACUCCAG-3' | (SEQ ID NO: 10609) |
| C5-449 | 21 nt Target: 5'-CAAACCUGUUUAUACUCCAGA-3' | (SEQ ID NO: 10610) |
| C5-450 | 21 nt Target: 5'-AAACCUGUUUAUACUCCAGAC-3' | (SEQ ID NO: 10611) |
| C5-451 | 21 nt Target: 5'-AACCUGUUUAUACUCCAGACC-3' | (SEQ ID NO: 10612) |
| C5-452 | 21 nt Target: 5'-ACCUGUUUAUACUCCAGACCA-3' | (SEQ ID NO: 10613) |
| C5-482 | 21 nt Target: 5'-AGUUAGAGUUUAUUCGUUGAA-3' | (SEQ ID NO: 10614) |
| C5-483 | 21 nt Target: 5'-GUUAGAGUUUAUUCGUUGAAU-3' | (SEQ ID NO: 10615) |
| C5-484 | 21 nt Target: 5'-UUAGAGUUUAUUCGUUGAAUG-3' | (SEQ ID NO: 10616) |
| C5-485 | 21 nt Target: 5'-UAGAGUUUAUUCGUUGAAUGA-3' | (SEQ ID NO: 10617) |
| C5-505 | 21 nt Target: 5'-ACGACUUGAAGCCAGCCAAAA-3' | (SEQ ID NO: 10618) |
| C5-506 | 21 nt Target: 5'-CGACUUGAAGCCAGCCAAAAG-3' | (SEQ ID NO: 10619) |
| C5-507 | 21 nt Target: 5'-GACUUGAAGCCAGCCAAAAGA-3' | (SEQ ID NO: 10620) |
| C5-508 | 21 nt Target: 5'-ACUUGAAGCCAGCCAAAAGAG-3' | (SEQ ID NO: 10621) |
| C5-509 | 21 nt Target: 5'-CUUGAAGCCAGCCAAAAGAGA-3' | (SEQ ID NO: 10622) |
| C5-510 | 21 nt Target: 5'-UUGAAGCCAGCCAAAAGAGAA-3' | (SEQ ID NO: 10623) |
| C5-511 | 21 nt Target: 5'-UGAAGCCAGCCAAAAGAGAAA-3' | (SEQ ID NO: 10624) |
| C5-512 | 21 nt Target: 5'-GAAGCCAGCCAAAAGAGAAAC-3' | (SEQ ID NO: 10625) |
| C5-513 | 21 nt Target: 5'-AAGCCAGCCAAAAGAGAAACU-3' | (SEQ ID NO: 10626) |
| C5-514 | 21 nt Target: 5'-AGCCAGCCAAAAGAGAAACUG-3' | (SEQ ID NO: 10627) |
| C5-515 | 21 nt Target: 5'-GCCAGCCAAAAGAGAAACUGU-3' | (SEQ ID NO: 10628) |

TABLE 8-continued

DsiRNA Target Sequences (21 mers) of Human Anti-C5
DsiRNAs Predicted to have > 50% Knockdown Efficacy

| | | |
|---|---|---|
| C5-516 | 21 nt Target: 5'-CCAGCCAAAAGAGAAACUGUC-3' | (SEQ ID NO: 10629) |
| C5-517 | 21 nt Target: 5'-CAGCCAAAAGAGAAACUGUCU-3' | (SEQ ID NO: 10630) |
| C5-518 | 21 nt Target: 5'-AGCCAAAAGAGAAACUGUCUU-3' | (SEQ ID NO: 10631) |
| C5-519 | 21 nt Target: 5'-GCCAAAAGAGAAACUGUCUUA-3' | (SEQ ID NO: 10632) |
| C5-520 | 21 nt Target: 5'-CCAAAAGAGAAACUGUCUUAA-3' | (SEQ ID NO: 10633) |
| C5-521 | 21 nt Target: 5'-CAAAAGAGAAACUGUCUUAAC-3' | (SEQ ID NO: 10634) |
| C5-522 | 21 nt Target: 5'-AAAAGAGAAACUGUCUUAACU-3' | (SEQ ID NO: 10635) |
| C5-523 | 21 nt Target: 5'-AAAGAGAAACUGUCUUAACUU-3' | (SEQ ID NO: 10636) |
| C5-524 | 21 nt Target: 5'-AAGAGAAACUGUCUUAACUUU-3' | (SEQ ID NO: 10637) |
| C5-526 | 21 nt Target: 5'-GAGAAACUGUCUUAACUUUCA-3' | (SEQ ID NO: 10638) |
| C5-527 | 21 nt Target: 5'-AGAAACUGUCUUAACUUUCAU-3' | (SEQ ID NO: 10639) |
| C5-528 | 21 nt Target: 5'-GAAACUGUCUUAACUUUCAUA-3' | (SEQ ID NO: 10640) |
| C5-531 | 21 nt Target: 5'-ACUGUCUUAACUUUCAUAGAU-3' | (SEQ ID NO: 10641) |
| C5-532 | 21 nt Target: 5'-CUGUCUUAACUUUCAUAGAUC-3' | (SEQ ID NO: 10642) |
| C5-533 | 21 nt Target: 5'-UGUCUUAACUUUCAUAGAUCC-3' | (SEQ ID NO: 10643) |
| C5-534 | 21 nt Target: 5'-GUCUUAACUUUCAUAGAUCCU-3' | (SEQ ID NO: 10644) |
| C5-535 | 21 nt Target: 5'-UCUUAACUUUCAUAGAUCCUG-3' | (SEQ ID NO: 10645) |
| C5-536 | 21 nt Target: 5'-CUUAACUUUCAUAGAUCCUGA-3' | (SEQ ID NO: 10646) |
| C5-537 | 21 nt Target: 5'-UUAACUUUCAUAGAUCCUGAA-3' | (SEQ ID NO: 10647) |
| C5-538 | 21 nt Target: 5'-UAACUUUCAUAGAUCCUGAAG-3' | (SEQ ID NO: 10648) |
| C5-539 | 21 nt Target: 5'-AACUUUCAUAGAUCCUGAAGG-3' | (SEQ ID NO: 10649) |
| C5-540 | 21 nt Target: 5'-ACUUUCAUAGAUCCUGAAGGA-3' | (SEQ ID NO: 10650) |
| C5-541 | 21 nt Target: 5'-CUUUCAUAGAUCCUGAAGGAU-3' | (SEQ ID NO: 10651) |
| C5-542 | 21 nt Target: 5'-UUUCAUAGAUCCUGAAGGAUC-3' | (SEQ ID NO: 10652) |
| C5-543 | 21 nt Target: 5'-UUCAUAGAUCCUGAAGGAUCA-3' | (SEQ ID NO: 10653) |
| C5-544 | 21 nt Target: 5'-UCAUAGAUCCUGAAGGAUCAG-3' | (SEQ ID NO: 10654) |
| C5-545 | 21 nt Target: 5'-CAUAGAUCCUGAAGGAUCAGA-3' | (SEQ ID NO: 10655) |
| C5-546 | 21 nt Target: 5'-AUAGAUCCUGAAGGAUCAGAA-3' | (SEQ ID NO: 10656) |
| C5-566 | 21 nt Target: 5'-AGUUGACAUGGUAGAAGAAAU-3' | (SEQ ID NO: 10657) |
| C5-567 | 21 nt Target: 5'-GUUGACAUGGUAGAAGAAAUU-3' | (SEQ ID NO: 10658) |
| C5-570 | 21 nt Target: 5'-GACAUGGUAGAAGAAAUUGAU-3' | (SEQ ID NO: 10659) |
| C5-571 | 21 nt Target: 5'-ACAUGGUAGAAGAAAUUGAUC-3' | (SEQ ID NO: 10660) |
| C5-572 | 21 nt Target: 5'-CAUGGUAGAAGAAAUUGAUCA-3' | (SEQ ID NO: 10661) |
| C5-575 | 21 nt Target: 5'-GGUAGAAGAAAUUGAUCAUAU-3' | (SEQ ID NO: 10662) |
| C5-576 | 21 nt Target: 5'-GUAGAAGAAAUUGAUCAUAUU-3' | (SEQ ID NO: 10663) |
| C5-577 | 21 nt Target: 5'-UAGAAGAAAUUGAUCAUAUUG-3' | (SEQ ID NO: 10664) |
| C5-580 | 21 nt Target: 5'-AAGAAAUUGAUCAUAUUGGAA-3' | (SEQ ID NO: 10665) |
| C5-581 | 21 nt Target: 5'-AGAAAUUGAUCAUAUUGGAAU-3' | (SEQ ID NO: 10666) |
| C5-582 | 21 nt Target: 5'-GAAAUUGAUCAUAUUGGAAUU-3' | (SEQ ID NO: 10667) |

TABLE 8-continued

| DsiRNA Target Sequences (21 mers) of Human Anti-C5 DsiRNAs Predicted to have > 50% Knockdown Efficacy | | | | |
|---|---|---|---|---|
| C5-583 | 21 nt Target: | 5'-AAAUUGAUCAUAUUGGAAUUA-3' | (SEQ ID NO: 10668) |
| C5-584 | 21 nt Target: | 5'-AAUUGAUCAUAUUGGAAUUAU-3' | (SEQ ID NO: 10669) |
| C5-585 | 21 nt Target: | 5'-AUUGAUCAUAUUGGAAUUAUC-3' | (SEQ ID NO: 10670) |
| C5-586 | 21 nt Target: | 5'-UUGAUCAUAUUGGAAUUAUCU-3' | (SEQ ID NO: 10671) |
| C5-587 | 21 nt Target: | 5'-UGAUCAUAUUGGAAUUAUCUC-3' | (SEQ ID NO: 10672) |
| C5-588 | 21 nt Target: | 5'-GAUCAUAUUGGAAUUAUCUCU-3' | (SEQ ID NO: 10673) |
| C5-589 | 21 nt Target: | 5'-AUCAUAUUGGAAUUAUCUCUU-3' | (SEQ ID NO: 10674) |
| C5-590 | 21 nt Target: | 5'-UCAUAUUGGAAUUAUCUCUUU-3' | (SEQ ID NO: 10675) |
| C5-591 | 21 nt Target: | 5'-CAUAUUGGAAUUAUCUCUUUU-3' | (SEQ ID NO: 10676) |
| C5-592 | 21 nt Target: | 5'-AUAUUGGAAUUAUCUCUUUUC-3' | (SEQ ID NO: 10677) |
| C5-593 | 21 nt Target: | 5'-UAUUGGAAUUAUCUCUUUUCC-3' | (SEQ ID NO: 10678) |
| C5-594 | 21 nt Target: | 5'-AUUGGAAUUAUCUCUUUUCCU-3' | (SEQ ID NO: 10679) |
| C5-609 | 21 nt Target: | 5'-UUUCCUGACUUCAAGAUUCCG-3' | (SEQ ID NO: 10680) |
| C5-610 | 21 nt Target: | 5'-UUCCUGACUUCAAGAUUCCGU-3' | (SEQ ID NO: 10681) |
| C5-611 | 21 nt Target: | 5'-UCCUGACUUCAAGAUUCCGUC-3' | (SEQ ID NO: 10682) |
| C5-612 | 21 nt Target: | 5'-CCUGACUUCAAGAUUCCGUCU-3' | (SEQ ID NO: 10683) |
| C5-613 | 21 nt Target: | 5'-CUGACUUCAAGAUUCCGUCUA-3' | (SEQ ID NO: 10684) |
| C5-614 | 21 nt Target: | 5'-UGACUUCAAGAUUCCGUCUAA-3' | (SEQ ID NO: 10685) |
| C5-615 | 21 nt Target: | 5'-GACUUCAAGAUUCCGUCUAAU-3' | (SEQ ID NO: 10686) |
| C5-616 | 21 nt Target: | 5'-ACUUCAAGAUUCCGUCUAAUC-3' | (SEQ ID NO: 10687) |
| C5-617 | 21 nt Target: | 5'-CUUCAAGAUUCCGUCUAAUCC-3' | (SEQ ID NO: 10688) |
| C5-618 | 21 nt Target: | 5'-UUCAAGAUUCCGUCUAAUCCU-3' | (SEQ ID NO: 10689) |
| C5-619 | 21 nt Target: | 5'-UCAAGAUUCCGUCUAAUCCUA-3' | (SEQ ID NO: 10690) |
| C5-620 | 21 nt Target: | 5'-CAAGAUUCCGUCUAAUCCUAG-3' | (SEQ ID NO: 10691) |
| C5-621 | 21 nt Target: | 5'-AAGAUUCCGUCUAAUCCUAGA-3' | (SEQ ID NO: 10692) |
| C5-622 | 21 nt Target: | 5'-AGAUUCCGUCUAAUCCUAGAU-3' | (SEQ ID NO: 10693) |
| C5-623 | 21 nt Target: | 5'-GAUUCCGUCUAAUCCUAGAUA-3' | (SEQ ID NO: 10694) |
| C5-624 | 21 nt Target: | 5'-AUUCCGUCUAAUCCUAGAUAU-3' | (SEQ ID NO: 10695) |
| C5-625 | 21 nt Target: | 5'-UUCCGUCUAAUCCUAGAUAUG-3' | (SEQ ID NO: 10696) |
| C5-626 | 21 nt Target: | 5'-UCCGUCUAAUCCUAGAUAUGG-3' | (SEQ ID NO: 10697) |
| C5-627 | 21 nt Target: | 5'-CCGUCUAAUCCUAGAUAUGGU-3' | (SEQ ID NO: 10698) |
| C5-628 | 21 nt Target: | 5'-CGUCUAAUCCUAGAUAUGGUA-3' | (SEQ ID NO: 10699) |
| C5-629 | 21 nt Target: | 5'-GUCUAAUCCUAGAUAUGGUAU-3' | (SEQ ID NO: 10700) |
| C5-630 | 21 nt Target: | 5'-UCUAAUCCUAGAUAUGGUAUG-3' | (SEQ ID NO: 10701) |
| C5-631 | 21 nt Target: | 5'-CUAAUCCUAGAUAUGGUAUGU-3' | (SEQ ID NO: 10702) |
| C5-632 | 21 nt Target: | 5'-UAAUCCUAGAUAUGGUAUGUG-3' | (SEQ ID NO: 10703) |
| C5-633 | 21 nt Target: | 5'-AAUCCUAGAUAUGGUAUGUGG-3' | (SEQ ID NO: 10704) |
| C5-634 | 21 nt Target: | 5'-AUCCUAGAUAUGGUAUGUGGA-3' | (SEQ ID NO: 10705) |

TABLE 8-continued

| DsiRNA Target Sequences (21 mers) of Human Anti-C5 DsiRNAs Predicted to have > 50% Knockdown Efficacy | | |
|---|---|---|
| C5-659 | 21 nt Target: 5'-CAAGGCUAAAUAUAAAGAGGA-3' | (SEQ ID NO: 10706) |
| C5-660 | 21 nt Target: 5'-AAGGCUAAAUAUAAAGAGGAC-3' | (SEQ ID NO: 10707) |
| C5-661 | 21 nt Target: 5'-AGGCUAAAUAUAAAGAGGACU-3' | (SEQ ID NO: 10708) |
| C5-662 | 21 nt Target: 5'-GGCUAAAUAUAAAGAGGACUU-3' | (SEQ ID NO: 10709) |
| C5-663 | 21 nt Target: 5'-GCUAAAUAUAAAGAGGACUUU-3' | (SEQ ID NO: 10710) |
| C5-664 | 21 nt Target: 5'-CUAAAUAUAAAGAGGACUUUU-3' | (SEQ ID NO: 10711) |
| C5-665 | 21 nt Target: 5'-UAAAUAUAAAGAGGACUUUUC-3' | (SEQ ID NO: 10712) |
| C5-666 | 21 nt Target: 5'-AAAUAUAAAGAGGACUUUUCA-3' | (SEQ ID NO: 10713) |
| C5-667 | 21 nt Target: 5'-AAUAUAAAGAGGACUUUUCAA-3' | (SEQ ID NO: 10714) |
| C5-668 | 21 nt Target: 5'-AUAUAAAGAGGACUUUUCAAC-3' | (SEQ ID NO: 10715) |
| C5-669 | 21 nt Target: 5'-UAUAAAGAGGACUUUUCAACA-3' | (SEQ ID NO: 10716) |
| C5-670 | 21 nt Target: 5'-AUAAAGAGGACUUUUCAACAA-3' | (SEQ ID NO: 10717) |
| C5-671 | 21 nt Target: 5'-UAAAGAGGACUUUUCAACAAC-3' | (SEQ ID NO: 10718) |
| C5-672 | 21 nt Target: 5'-AAAGAGGACUUUUCAACAACU-3' | (SEQ ID NO: 10719) |
| C5-673 | 21 nt Target: 5'-AAGAGGACUUUUCAACAACUG-3' | (SEQ ID NO: 10720) |
| C5-674 | 21 nt Target: 5'-AGAGGACUUUUCAACAACUGG-3' | (SEQ ID NO: 10721) |
| C5-675 | 21 nt Target: 5'-GAGGACUUUUCAACAACUGGA-3' | (SEQ ID NO: 10722) |
| C5-676 | 21 nt Target: 5'-AGGACUUUUCAACAACUGGAA-3' | (SEQ ID NO: 10723) |
| C5-677 | 21 nt Target: 5'-GGACUUUUCAACAACUGGAAC-3' | (SEQ ID NO: 10724) |
| C5-702 | 21 nt Target: 5'-UAUUUUGAAGUUAAAGAAUAU-3' | (SEQ ID NO: 10725) |
| C5-703 | 21 nt Target: 5'-AUUUUGAAGUUAAAGAAUAUG-3' | (SEQ ID NO: 10726) |
| C5-704 | 21 nt Target: 5'-UUUUGAAGUUAAAGAAUAUGU-3' | (SEQ ID NO: 10727) |
| C5-705 | 21 nt Target: 5'-UUUGAAGUUAAAGAAUAUGUC-3' | (SEQ ID NO: 10728) |
| C5-706 | 21 nt Target: 5'-UUGAAGUUAAAGAAUAUGUCU-3' | (SEQ ID NO: 10729) |
| C5-707 | 21 nt Target: 5'-UGAAGUUAAAGAAUAUGUCUU-3' | (SEQ ID NO: 10730) |
| C5-708 | 21 nt Target: 5'-GAAGUUAAAGAAUAUGUCUUG-3' | (SEQ ID NO: 10731) |
| C5-709 | 21 nt Target: 5'-AAGUUAAAGAAUAUGUCUUGC-3' | (SEQ ID NO: 10732) |
| C5-713 | 21 nt Target: 5'-UAAAGAAUAUGUCUUGCCACA-3' | (SEQ ID NO: 10733) |
| C5-714 | 21 nt Target: 5'-AAAGAAUAUGUCUUGCCACAU-3' | (SEQ ID NO: 10734) |
| C5-715 | 21 nt Target: 5'-AAGAAUAUGUCUUGCCACAUU-3' | (SEQ ID NO: 10735) |
| C5-716 | 21 nt Target: 5'-AGAAUAUGUCUUGCCACAUUU-3' | (SEQ ID NO: 10736) |
| C5-717 | 21 nt Target: 5'-GAAUAUGUCUUGCCACAUUUU-3' | (SEQ ID NO: 10737) |
| C5-718 | 21 nt Target: 5'-AAUAUGUCUUGCCACAUUUUU-3' | (SEQ ID NO: 10738) |
| C5-719 | 21 nt Target: 5'-AUAUGUCUUGCCACAUUUUUC-3' | (SEQ ID NO: 10739) |
| C5-720 | 21 nt Target: 5'-UAUGUCUUGCCACAUUUUUCU-3' | (SEQ ID NO: 10740) |
| C5-721 | 21 nt Target: 5'-AUGUCUUGCCACAUUUUUCUG-3' | (SEQ ID NO: 10741) |
| C5-722 | 21 nt Target: 5'-UGUCUUGCCACAUUUUUCUGU-3' | (SEQ ID NO: 10742) |
| C5-723 | 21 nt Target: 5'-GUCUUGCCACAUUUUUCUGUC-3' | (SEQ ID NO: 10743) |
| C5-724 | 21 nt Target: 5'-UCUUGCCACAUUUUUCUGUCU-3' | (SEQ ID NO: 10744) |

TABLE 8-continued

DsiRNA Target Sequences (21 mers) of Human Anti-C5
DsiRNAs Predicted to have > 50% Knockdown Efficacy

| | | |
|---|---|---|
| C5-725 | 21 nt Target: 5'-CUUGCCACAUUUUUCUGUCUC-3' | (SEQ ID NO: 10745) |
| C5-726 | 21 nt Target: 5'-UUGCCACAUUUUUCUGUCUCA-3' | (SEQ ID NO: 10746) |
| C5-777 | 21 nt Target: 5'-AAGAACUUUAAGAAUUUUGAA-3' | (SEQ ID NO: 10747) |
| C5-778 | 21 nt Target: 5'-AGAACUUUAAGAAUUUUGAAA-3' | (SEQ ID NO: 10748) |
| C5-779 | 21 nt Target: 5'-GAACUUUAAGAAUUUUGAAAU-3' | (SEQ ID NO: 10749) |
| C5-781 | 21 nt Target: 5'-ACUUUAAGAAUUUUGAAAUUA-3' | (SEQ ID NO: 10750) |
| C5-782 | 21 nt Target: 5'-CUUUAAGAAUUUUGAAAUUAC-3' | (SEQ ID NO: 10751) |
| C5-783 | 21 nt Target: 5'-UUUAAGAAUUUUGAAAUUACU-3' | (SEQ ID NO: 10752) |
| C5-784 | 21 nt Target: 5'-UUAAGAAUUUUGAAAUUACUA-3' | (SEQ ID NO: 10753) |
| C5-785 | 21 nt Target: 5'-UAAGAAUUUUGAAAUUACUAU-3' | (SEQ ID NO: 10754) |
| C5-789 | 21 nt Target: 5'-AAUUUUGAAAUUACUAUAAAA-3' | (SEQ ID NO: 10755) |
| C5-790 | 21 nt Target: 5'-AUUUUGAAAUUACUAUAAAAG-3' | (SEQ ID NO: 10756) |
| C5-794 | 21 nt Target: 5'-UGAAAUUACUAUAAAAGCAAG-3' | (SEQ ID NO: 10757) |
| C5-795 | 21 nt Target: 5'-GAAAUUACUAUAAAAGCAAGA-3' | (SEQ ID NO: 10758) |
| C5-796 | 21 nt Target: 5'-AAAUUACUAUAAAAGCAAGAU-3' | (SEQ ID NO: 10759) |
| C5-797 | 21 nt Target: 5'-AAUUACUAUAAAAGCAAGAUA-3' | (SEQ ID NO: 10760) |
| C5-798 | 21 nt Target: 5'-AUUACUAUAAAAGCAAGAUAU-3' | (SEQ ID NO: 10761) |
| C5-799 | 21 nt Target: 5'-UUACUAUAAAAGCAAGAUAUU-3' | (SEQ ID NO: 10762) |
| C5-800 | 21 nt Target: 5'-UACUAUAAAAGCAAGAUAUUU-3' | (SEQ ID NO: 10763) |
| C5-801 | 21 nt Target: 5'-ACUAUAAAAGCAAGAUAUUUU-3' | (SEQ ID NO: 10764) |
| C5-802 | 21 nt Target: 5'-CUAUAAAAGCAAGAUAUUUUU-3' | (SEQ ID NO: 10765) |
| C5-803 | 21 nt Target: 5'-UAUAAAAGCAAGAUAUUUUUA-3' | (SEQ ID NO: 10766) |
| C5-804 | 21 nt Target: 5'-AUAAAAGCAAGAUAUUUUUAU-3' | (SEQ ID NO: 10767) |
| C5-813 | 21 nt Target: 5'-AGAUAUUUUUAUAAUAAAGUA-3' | (SEQ ID NO: 10768) |
| C5-814 | 21 nt Target: 5'-GAUAUUUUUAUAAUAAAGUAG-3' | (SEQ ID NO: 10769) |
| C5-815 | 21 nt Target: 5'-AUAUUUUUAUAAUAAAGUAGU-3' | (SEQ ID NO: 10770) |
| C5-816 | 21 nt Target: 5'-UAUUUUUAUAAUAAAGUAGUC-3' | (SEQ ID NO: 10771) |
| C5-817 | 21 nt Target: 5'-AUUUUUAUAAUAAAGUAGUCA-3' | (SEQ ID NO: 10772) |
| C5-818 | 21 nt Target: 5'-UUUUUAUAAUAAAGUAGUCAC-3' | (SEQ ID NO: 10773) |
| C5-819 | 21 nt Target: 5'-UUUUAUAAUAAAGUAGUCACU-3' | (SEQ ID NO: 10774) |
| C5-820 | 21 nt Target: 5'-UUUAUAAUAAAGUAGUCACUG-3' | (SEQ ID NO: 10775) |
| C5-821 | 21 nt Target: 5'-UUAUAAUAAAGUAGUCACUGA-3' | (SEQ ID NO: 10776) |
| C5-822 | 21 nt Target: 5'-UAUAAUAAAGUAGUCACUGAG-3' | (SEQ ID NO: 10777) |
| C5-823 | 21 nt Target: 5'-AUAAUAAAGUAGUCACUGAGG-3' | (SEQ ID NO: 10778) |
| C5-824 | 21 nt Target: 5'-UAAUAAAGUAGUCACUGAGGC-3' | (SEQ ID NO: 10779) |
| C5-825 | 21 nt Target: 5'-AAUAAAGUAGUCACUGAGGCU-3' | (SEQ ID NO: 10780) |
| C5-826 | 21 nt Target: 5'-AUAAAGUAGUCACUGAGGCUG-3' | (SEQ ID NO: 10781) |
| C5-827 | 21 nt Target: 5'-UAAAGUAGUCACUGAGGCUGA-3' | (SEQ ID NO: 10782) |

TABLE 8-continued

DsiRNA Target Sequences (21 mers) of Human Anti-C5
DsiRNAs Predicted to have > 50% Knockdown Efficacy

| | | |
|---|---|---|
| C5-847 | 21 nt Target: 5'-ACGUUUAUAUCACAUUUGGAA-3' | (SEQ ID NO: 10783) |
| C5-848 | 21 nt Target: 5'-CGUUUAUAUCACAUUUGGAAU-3' | (SEQ ID NO: 10784) |
| C5-849 | 21 nt Target: 5'-GUUUAUAUCACAUUUGGAAUA-3' | (SEQ ID NO: 10785) |
| C5-850 | 21 nt Target: 5'-UUUAUAUCACAUUUGGAAUAA-3' | (SEQ ID NO: 10786) |
| C5-851 | 21 nt Target: 5'-UUAUAUCACAUUUGGAAUAAG-3' | (SEQ ID NO: 10787) |
| C5-852 | 21 nt Target: 5'-UAUAUCACAUUUGGAAUAAGA-3' | (SEQ ID NO: 10788) |
| C5-853 | 21 nt Target: 5'-AUAUCACAUUUGGAAUAAGAG-3' | (SEQ ID NO: 10789) |
| C5-854 | 21 nt Target: 5'-UAUCACAUUUGGAAUAAGAGA-3' | (SEQ ID NO: 10790) |
| C5-855 | 21 nt Target: 5'-AUCACAUUUGGAAUAAGAGAA-3' | (SEQ ID NO: 10791) |
| C5-856 | 21 nt Target: 5'-UCACAUUUGGAAUAAGAGAAG-3' | (SEQ ID NO: 10792) |
| C5-857 | 21 nt Target: 5'-CACAUUUGGAAUAAGAGAAGA-3' | (SEQ ID NO: 10793) |
| C5-858 | 21 nt Target: 5'-ACAUUUGGAAUAAGAGAAGAC-3' | (SEQ ID NO: 10794) |
| C5-859 | 21 nt Target: 5'-CAUUUGGAAUAAGAGAAGACU-3' | (SEQ ID NO: 10795) |
| C5-860 | 21 nt Target: 5'-AUUUGGAAUAAGAGAAGACUU-3' | (SEQ ID NO: 10796) |
| C5-861 | 21 nt Target: 5'-UUUGGAAUAAGAGAAGACUUA-3' | (SEQ ID NO: 10797) |
| C5-862 | 21 nt Target: 5'-UUGGAAUAAGAGAAGACUUAA-3' | (SEQ ID NO: 10798) |
| C5-863 | 21 nt Target: 5'-UGGAAUAAGAGAAGACUUAAA-3' | (SEQ ID NO: 10799) |
| C5-864 | 21 nt Target: 5'-GGAAUAAGAGAAGACUUAAAA-3' | (SEQ ID NO: 10800) |
| C5-865 | 21 nt Target: 5'-GAAUAAGAGAAGACUUAAAAG-3' | (SEQ ID NO: 10801) |
| C5-866 | 21 nt Target: 5'-AAUAAGAGAAGACUUAAAAGA-3' | (SEQ ID NO: 10802) |
| C5-867 | 21 nt Target: 5'-AUAAGAGAAGACUUAAAAGAU-3' | (SEQ ID NO: 10803) |
| C5-868 | 21 nt Target: 5'-UAAGAGAAGACUUAAAAGAUG-3' | (SEQ ID NO: 10804) |
| C5-869 | 21 nt Target: 5'-AAGAGAAGACUUAAAAGAUGA-3' | (SEQ ID NO: 10805) |
| C5-870 | 21 nt Target: 5'-AGAGAAGACUUAAAAGAUGAU-3' | (SEQ ID NO: 10806) |
| C5-871 | 21 nt Target: 5'-GAGAAGACUUAAAAGAUGAUC-3' | (SEQ ID NO: 10807) |
| C5-872 | 21 nt Target: 5'-AGAAGACUUAAAAGAUGAUCA-3' | (SEQ ID NO: 10808) |
| C5-873 | 21 nt Target: 5'-GAAGACUUAAAAGAUGAUCAA-3' | (SEQ ID NO: 10809) |
| C5-874 | 21 nt Target: 5'-AAGACUUAAAAGAUGAUCAAA-3' | (SEQ ID NO: 10810) |
| C5-875 | 21 nt Target: 5'-AGACUUAAAAGAUGAUCAAAA-3' | (SEQ ID NO: 10811) |
| C5-876 | 21 nt Target: 5'-GACUUAAAAGAUGAUCAAAAA-3' | (SEQ ID NO: 10812) |
| C5-877 | 21 nt Target: 5'-ACUUAAAAGAUGAUCAAAAAG-3' | (SEQ ID NO: 10813) |
| C5-878 | 21 nt Target: 5'-CUUAAAAGAUGAUCAAAAAGA-3' | (SEQ ID NO: 10814) |
| C5-879 | 21 nt Target: 5'-UUAAAAGAUGAUCAAAAAGAA-3' | (SEQ ID NO: 10815) |
| C5-880 | 21 nt Target: 5'-UAAAAGAUGAUCAAAAAGAAA-3' | (SEQ ID NO: 10816) |
| C5-881 | 21 nt Target: 5'-AAAAGAUGAUCAAAAAGAAAU-3' | (SEQ ID NO: 10817) |
| C5-882 | 21 nt Target: 5'-AAAGAUGAUCAAAAAGAAAUG-3' | (SEQ ID NO: 10818) |
| C5-883 | 21 nt Target: 5'-AAGAUGAUCAAAAAGAAAUGA-3' | (SEQ ID NO: 10819) |
| C5-884 | 21 nt Target: 5'-AGAUGAUCAAAAAGAAAUGAU-3' | (SEQ ID NO: 10820) |
| C5-885 | 21 nt Target: 5'-GAUGAUCAAAAAGAAAUGAUG-3' | (SEQ ID NO: 10821) |

TABLE 8-continued

DsiRNA Target Sequences (21 mers) of Human Anti-C5
DsiRNAs Predicted to have > 50% Knockdown Efficac TABLE 8-continued DsiRNA Target Sequences (21 mers) of Human Anti-C5
DsiRNAs Predicted to have > 50% Knockdown Efficacy

| | | |
|---|---|---|
| C5-961 | 21 nt Target: 5'-AUUCUGAAACAGCAGUCAAAG-3' | (SEQ ID NO: 10860) |
| C5-962 | 21 nt Target: 5'-UUCUGAAACAGCAGUCAAAGA-3' | (SEQ ID NO: 10861) |
| C5-963 | 21 nt Target: 5'-UCUGAAACAGCAGUCAAAGAA-3' | (SEQ ID NO: 10862) |
| C5-964 | 21 nt Target: 5'-CUGAAACAGCAGUCAAAGAAC-3' | (SEQ ID NO: 10863) |
| C5-965 | 21 nt Target: 5'-UGAAACAGCAGUCAAAGAACU-3' | (SEQ ID NO: 10864) |
| C5-966 | 21 nt Target: 5'-GAAACAGCAGUCAAAGAACUG-3' | (SEQ ID NO: 10865) |
| C5-967 | 21 nt Target: 5'-AAACAGCAGUCAAAGAACUGU-3' | (SEQ ID NO: 10866) |
| C5-969 | 21 nt Target: 5'-ACAGCAGUCAAAGAACUGUCA-3' | (SEQ ID NO: 10867) |
| C5-971 | 21 nt Target: 5'-AGCAGUCAAAGAACUGUCAUA-3' | (SEQ ID NO: 10868) |
| C5-972 | 21 nt Target: 5'-GCAGUCAAAGAACUGUCAUAC-3' | (SEQ ID NO: 10869) |
| C5-974 | 21 nt Target: 5'-AGUCAAAGAACUGUCAUACUA-3' | (SEQ ID NO: 10870) |
| C5-975 | 21 nt Target: 5'-GUCAAAGAACUGUCAUACUAC-3' | (SEQ ID NO: 10871) |
| C5-976 | 21 nt Target: 5'-UCAAAGAACUGUCAUACUACA-3' | (SEQ ID NO: 10872) |
| C5-979 | 21 nt Target: 5'-AAGAACUGUCAUACUACAGUU-3' | (SEQ ID NO: 10873) |
| C5-981 | 21 nt Target: 5'-GAACUGUCAUACUACAGUUUA-3' | (SEQ ID NO: 10874) |
| C5-982 | 21 nt Target: 5'-AACUGUCAUACUACAGUUUAG-3' | (SEQ ID NO: 10875) |
| C5-983 | 21 nt Target: 5'-ACUGUCAUACUACAGUUUAGA-3' | (SEQ ID NO: 10876) |
| C5-984 | 21 nt Target: 5'-CUGUCAUACUACAGUUUAGAA-3' | (SEQ ID NO: 10877) |
| C5-985 | 21 nt Target: 5'-UGUCAUACUACAGUUUAGAAG-3' | (SEQ ID NO: 10878) |
| C5-986 | 21 nt Target: 5'-GUCAUACUACAGUUUAGAAGA-3' | (SEQ ID NO: 10879) |
| C5-987 | 21 nt Target: 5'-UCAUACUACAGUUUAGAAGAU-3' | (SEQ ID NO: 10880) |
| C5-988 | 21 nt Target: 5'-CAUACUACAGUUUAGAAGAUU-3' | (SEQ ID NO: 10881) |
| C5-989 | 21 nt Target: 5'-AUACUACAGUUUAGAAGAUUU-3' | (SEQ ID NO: 10882) |
| C5-990 | 21 nt Target: 5'-UACUACAGUUUAGAAGAUUUA-3' | (SEQ ID NO: 10883) |
| C5-991 | 21 nt Target: 5'-ACUACAGUUUAGAAGAUUUAA-3' | (SEQ ID NO: 10884) |
| C5-992 | 21 nt Target: 5'-CUACAGUUUAGAAGAUUUAAA-3' | (SEQ ID NO: 10885) |
| C5-993 | 21 nt Target: 5'-UACAGUUUAGAAGAUUUAAAC-3' | (SEQ ID NO: 10886) |
| C5-994 | 21 nt Target: 5'-ACAGUUUAGAAGAUUUAAACA-3' | (SEQ ID NO: 10887) |
| C5-995 | 21 nt Target: 5'-CAGUUUAGAAGAUUUAAACAA-3' | (SEQ ID NO: 10888) |
| C5-996 | 21 nt Target: 5'-AGUUUAGAAGAUUUAAACAAC-3' | (SEQ ID NO: 10889) |
| C5-997 | 21 nt Target: 5'-GUUUAGAAGAUUUAAACAACA-3' | (SEQ ID NO: 10890) |
| C5-998 | 21 nt Target: 5'-UUUAGAAGAUUUAAACAACAA-3' | (SEQ ID NO: 10891) |
| C5-999 | 21 nt Target: 5'-UUAGAAGAUUUAAACAACAAG-3' | (SEQ ID NO: 10892) |
| C5-1000 | 21 nt Target: 5'-UAGAAGAUUUAAACAACAAGU-3' | (SEQ ID NO: 10893) |
| C5-1001 | 21 nt Target: 5'-AGAAGAUUUAAACAACAAGUA-3' | (SEQ ID NO: 10894) |
| C5-1002 | 21 nt Target: 5'-GAAGAUUUAAACAACAAGUAC-3' | (SEQ ID NO: 10895) |
| C5-1003 | 21 nt Target: 5'-AAGAUUUAAACAACAAGUACC-3' | (SEQ ID NO: 10896) |
| C5-1004 | 21 nt Target: 5'-AGAUUUAAACAACAAGUACCU-3' | (SEQ ID NO: 10897) |
| C5-1005 | 21 nt Target: 5'-GAUUUAAACAACAAGUACCUU-3' | (SEQ ID NO: 10898) |

TABLE 8-continued

| DsiRNA Target Sequences (21 mers) of Human Anti-C5 DsiRNAs Predicted to have > 50% Knockdown Efficacy | | |
|---|---|---|
| C5-1018 | 21 nt Target: 5'-AGUACCUUUAUAUUGCUGUAA-3' | (SEQ ID NO: 10899) |
| C5-1020 | 21 nt Target: 5'-UACCUUUAUAUUGCUGUAACA-3' | (SEQ ID NO: 10900) |
| C5-1021 | 21 nt Target: 5'-ACCUUUAUAUUGCUGUAACAG-3' | (SEQ ID NO: 10901) |
| C5-1022 | 21 nt Target: 5'-CCUUUAUAUUGCUGUAACAGU-3' | (SEQ ID NO: 10902) |
| C5-1023 | 21 nt Target: 5'-CUUUAUAUUGCUGUAACAGUC-3' | (SEQ ID NO: 10903) |
| C5-1024 | 21 nt Target: 5'-UUUAUAUUGCUGUAACAGUCA-3' | (SEQ ID NO: 10904) |
| C5-1025 | 21 nt Target: 5'-UUAUAUUGCUGUAACAGUCAU-3' | (SEQ ID NO: 10905) |
| C5-1026 | 21 nt Target: 5'-UAUAUUGCUGUAACAGUCAUA-3' | (SEQ ID NO: 10906) |
| C5-1027 | 21 nt Target: 5'-AUAUUGCUGUAACAGUCAUAG-3' | (SEQ ID NO: 10907) |
| C5-1028 | 21 nt Target: 5'-UAUUGCUGUAACAGUCAUAGA-3' | (SEQ ID NO: 10908) |
| C5-1029 | 21 nt Target: 5'-AUUGCUGUAACAGUCAUAGAG-3' | (SEQ ID NO: 10909) |
| C5-1030 | 21 nt Target: 5'-UUGCUGUAACAGUCAUAGAGU-3' | (SEQ ID NO: 10910) |
| C5-1031 | 21 nt Target: 5'-UGCUGUAACAGUCAUAGAGUC-3' | (SEQ ID NO: 10911) |
| C5-1032 | 21 nt Target: 5'-GCUGUAACAGUCAUAGAGUCU-3' | (SEQ ID NO: 10912) |
| C5-1033 | 21 nt Target: 5'-CUGUAACAGUCAUAGAGUCUA-3' | (SEQ ID NO: 10913) |
| C5-1034 | 21 nt Target: 5'-UGUAACAGUCAUAGAGUCUAC-3' | (SEQ ID NO: 10914) |
| C5-1035 | 21 nt Target: 5'-GUAACAGUCAUAGAGUCUACA-3' | (SEQ ID NO: 10915) |
| C5-1036 | 21 nt Target: 5'-UAACAGUCAUAGAGUCUACAG-3' | (SEQ ID NO: 10916) |
| C5-1037 | 21 nt Target: 5'-AACAGUCAUAGAGUCUACAGG-3' | (SEQ ID NO: 10917) |
| C5-1038 | 21 nt Target: 5'-ACAGUCAUAGAGUCUACAGGU-3' | (SEQ ID NO: 10918) |
| C5-1039 | 21 nt Target: 5'-CAGUCAUAGAGUCUACAGGUG-3' | (SEQ ID NO: 10919) |
| C5-1040 | 21 nt Target: 5'-AGUCAUAGAGUCUACAGGUGG-3' | (SEQ ID NO: 10920) |
| C5-1041 | 21 nt Target: 5'-GUCAUAGAGUCUACAGGUGGA-3' | (SEQ ID NO: 10921) |
| C5-1042 | 21 nt Target: 5'-UCAUAGAGUCUACAGGUGGAU-3' | (SEQ ID NO: 10922) |
| C5-1043 | 21 nt Target: 5'-CAUAGAGUCUACAGGUGGAUU-3' | (SEQ ID NO: 10923) |
| C5-1044 | 21 nt Target: 5'-AUAGAGUCUACAGGUGGAUUU-3' | (SEQ ID NO: 10924) |
| C5-1045 | 21 nt Target: 5'-UAGAGUCUACAGGUGGAUUUU-3' | (SEQ ID NO: 10925) |
| C5-1046 | 21 nt Target: 5'-AGAGUCUACAGGUGGAUUUUC-3' | (SEQ ID NO: 10926) |
| C5-1047 | 21 nt Target: 5'-GAGUCUACAGGUGGAUUUUCU-3' | (SEQ ID NO: 10927) |
| C5-1048 | 21 nt Target: 5'-AGUCUACAGGUGGAUUUUCUG-3' | (SEQ ID NO: 10928) |
| C5-1049 | 21 nt Target: 5'-GUCUACAGGUGGAUUUUCUGA-3' | (SEQ ID NO: 10929) |
| C5-1050 | 21 nt Target: 5'-UCUACAGGUGGAUUUUCUGAA-3' | (SEQ ID NO: 10930) |
| C5-1051 | 21 nt Target: 5'-CUACAGGUGGAUUUUCUGAAG-3' | (SEQ ID NO: 10931) |
| C5-1052 | 21 nt Target: 5'-UACAGGUGGAUUUUCUGAAGA-3' | (SEQ ID NO: 10932) |
| C5-1053 | 21 nt Target: 5'-ACAGGUGGAUUUUCUGAAGAG-3' | (SEQ ID NO: 10933) |
| C5-1054 | 21 nt Target: 5'-CAGGUGGAUUUUCUGAAGAGG-3' | (SEQ ID NO: 10934) |
| C5-1055 | 21 nt Target: 5'-AGGUGGAUUUUCUGAAGAGGC-3' | (SEQ ID NO: 10935) |
| C5-1056 | 21 nt Target: 5'-GGUGGAUUUUCUGAAGAGGCA-3' | (SEQ ID NO: 10936) |

TABLE 8-continued

DsiRNA Target Sequences (21 mers) of Human Anti-C5
DsiRNAs Predicted to have > 50% Knockdown Efficacy

| ID | Target |
|---|---|
| C5-1057 | 21 nt Target: 5'-GUGGAUUUCUGAAGAGGCAG-3' (SEQ ID NO: 10937) |
| C5-1058 | 21 nt Target: 5'-UGGAUUUUCUGAAGAGGCAGA-3' (SEQ ID NO: 10938) |
| C5-1059 | 21 nt Target: 5'-GGAUUUUCUGAAGAGGCAGAA-3' (SEQ ID NO: 10939) |
| C5-1060 | 21 nt Target: 5'-GAUUUUCUGAAGAGGCAGAAA-3' (SEQ ID NO: 10940) |
| C5-1061 | 21 nt Target: 5'-AUUUUCUGAAGAGGCAGAAAU-3' (SEQ ID NO: 10941) |
| C5-1062 | 21 nt Target: 5'-UUUUCUGAAGAGGCAGAAAUA-3' (SEQ ID NO: 10942) |
| C5-1063 | 21 nt Target: 5'-UUUCUGAAGAGGCAGAAAUAC-3' (SEQ ID NO: 10943) |
| C5-1064 | 21 nt Target: 5'-UUCUGAAGAGGCAGAAAUACC-3' (SEQ ID NO: 10944) |
| C5-1065 | 21 nt Target: 5'-UCUGAAGAGGCAGAAAUACCU-3' (SEQ ID NO: 10945) |
| C5-1066 | 21 nt Target: 5'-CUGAAGAGGCAGAAAUACCUG-3' (SEQ ID NO: 10946) |
| C5-1067 | 21 nt Target: 5'-UGAAGAGGCAGAAAUACCUGG-3' (SEQ ID NO: 10947) |
| C5-1068 | 21 nt Target: 5'-GAAGAGGCAGAAAUACCUGGC-3' (SEQ ID NO: 10948) |
| C5-1069 | 21 nt Target: 5'-AAGAGGCAGAAAUACCUGGCA-3' (SEQ ID NO: 10949) |
| C5-1070 | 21 nt Target: 5'-AGAGGCAGAAAUACCUGGCAU-3' (SEQ ID NO: 10950) |
| C5-1071 | 21 nt Target: 5'-GAGGCAGAAAUACCUGGCAUC-3' (SEQ ID NO: 10951) |
| C5-1072 | 21 nt Target: 5'-AGGCAGAAAUACCUGGCAUCA-3' (SEQ ID NO: 10952) |
| C5-1073 | 21 nt Target: 5'-GGCAGAAAUACCUGGCAUCAA-3' (SEQ ID NO: 10953) |
| C5-1074 | 21 nt Target: 5'-GCAGAAAUACCUGGCAUCAAA-3' (SEQ ID NO: 10954) |
| C5-1075 | 21 nt Target: 5'-CAGAAAUACCUGGCAUCAAAU-3' (SEQ ID NO: 10955) |
| C5-1076 | 21 nt Target: 5'-AGAAAUACCUGGCAUCAAAUA-3' (SEQ ID NO: 10956) |
| C5-1077 | 21 nt Target: 5'-GAAAUACCUGGCAUCAAAUAU-3' (SEQ ID NO: 10957) |
| C5-1078 | 21 nt Target: 5'-AAAUACCUGGCAUCAAAUAUG-3' (SEQ ID NO: 10958) |
| C5-1079 | 21 nt Target: 5'-AAUACCUGGCAUCAAAUAUGU-3' (SEQ ID NO: 10959) |
| C5-1080 | 21 nt Target: 5'-AUACCUGGCAUCAAAUAUGUC-3' (SEQ ID NO: 10960) |
| C5-1081 | 21 nt Target: 5'-UACCUGGCAUCAAAUAUGUCC-3' (SEQ ID NO: 10961) |
| C5-1082 | 21 nt Target: 5'-ACCUGGCAUCAAAUAUGUCCU-3' (SEQ ID NO: 10962) |
| C5-1083 | 21 nt Target: 5'-CCUGGCAUCAAAUAUGUCCUC-3' (SEQ ID NO: 10963) |
| C5-1084 | 21 nt Target: 5'-CUGGCAUCAAAUAUGUCCUCU-3' (SEQ ID NO: 10964) |
| C5-1085 | 21 nt Target: 5'-UGGCAUCAAAUAUGUCCUCUC-3' (SEQ ID NO: 10965) |
| C5-1086 | 21 nt Target: 5'-GGCAUCAAAUAUGUCCUCUCU-3' (SEQ ID NO: 10966) |
| C5-1087 | 21 nt Target: 5'-GCAUCAAAUAUGUCCUCUCUC-3' (SEQ ID NO: 10967) |
| C5-1089 | 21 nt Target: 5'-AUCAAAUAUGUCCUCUCUCCC-3' (SEQ ID NO: 10968) |
| C5-1090 | 21 nt Target: 5'-UCAAAUAUGUCCUCUCUCCCU-3' (SEQ ID NO: 10969) |
| C5-1091 | 21 nt Target: 5'-CAAAUAUGUCCUCUCUCCCUA-3' (SEQ ID NO: 10970) |
| C5-1092 | 21 nt Target: 5'-AAAUAUGUCCUCUCUCCCUAC-3' (SEQ ID NO: 10971) |
| C5-1093 | 21 nt Target: 5'-AAUAUGUCCUCUCUCCCUACA-3' (SEQ ID NO: 10972) |
| C5-1094 | 21 nt Target: 5'-AUAUGUCCUCUCUCCCUACAA-3' (SEQ ID NO: 10973) |
| C5-1095 | 21 nt Target: 5'-UAUGUCCUCUCUCCCUACAAA-3' (SEQ ID NO: 10974) |
| C5-1096 | 21 nt Target: 5'-AUGUCCUCUCUCCCUACAAAC-3' (SEQ ID NO: 10975) |

TABLE 8-continued

DsiRNA Target Sequences (21 mers) of Human Anti-C5
DsiRNAs Predicted to have > 50% Knockdown Efficacy C5-1097   21 nt Target: 5'-UGUCCUCUCUCCCUACAAACU-3'  (SEQ ID NO: 10976)

C5-1098   21 nt Target: 5'-GUCCUCUCUCCCUACAAACUG-3'  (SEQ ID NO: 10977)

C5-1099   21 nt Target: 5'-UCCUCUCUCCCUACAAACUGA-3'  (SEQ ID NO: 10978)

C5-1100   21 nt Target: 5'-CCUCUCUCCCUACAAACUGAA-3'  (SEQ ID NO: 10979)

C5-1101   21 nt Target: 5'-CUCUCUCCCUACAAACUGAAU-3'  (SEQ ID NO: 10980)

C5-1102   21 nt Target: 5'-UCUCUCCCUACAAACUGAAUU-3'  (SEQ ID NO: 10981)

C5-1103   21 nt Target: 5'-CUCUCCCUACAAACUGAAUUU-3'  (SEQ ID NO: 10982)

C5-1104   21 nt Target: 5'-UCUCCCUACAAACUGAAUUUG-3'  (SEQ ID NO: 10983)

C5-1106   21 nt Target: 5'-UCCCUACAAACUGAAUUUGGU-3'  (SEQ ID NO: 10984)

C5-1107   21 nt Target: 5'-CCCUACAAACUGAAUUUGGUU-3'  (SEQ ID NO: 10985)

C5-1108   21 nt Target: 5'-CCUACAAACUGAAUUUGGUUG-3'  (SEQ ID NO: 10986)

C5-1111   21 nt Target: 5'-ACAAACUGAAUUUGGUUGCUA-3'  (SEQ ID NO: 10987)

C5-1112   21 nt Target: 5'-CAAACUGAAUUUGGUUGCUAC-3'  (SEQ ID NO: 10988)

C5-1113   21 nt Target: 5'-AAACUGAAUUUGGUUGCUACU-3'  (SEQ ID NO: 10989)

C5-1114   21 nt Target: 5'-AACUGAAUUUGGUUGCUACUC-3'  (SEQ ID NO: 10990)

C5-1115   21 nt Target: 5'-ACUGAAUUUGGUUGCUACUCC-3'  (SEQ ID NO: 10991)

C5-1116   21 nt Target: 5'-CUGAAUUUGGUUGCUACUCCU-3'  (SEQ ID NO: 10992)

C5-1117   21 nt Target: 5'-UGAAUUUGGUUGCUACUCCUC-3'  (SEQ ID NO: 10993)

C5-1118   21 nt Target: 5'-GAAUUUGGUUGCUACUCCUCU-3'  (SEQ ID NO: 10994)

C5-1119   21 nt Target: 5'-AAUUUGGUUGCUACUCCUCUU-3'  (SEQ ID NO: 10995)

C5-1120   21 nt Target: 5'-AUUUGGUUGCUACUCCUCUUU-3'  (SEQ ID NO: 10996)

C5-1121   21 nt Target: 5'-UUUGGUUGCUACUCCUCUUUU-3'  (SEQ ID NO: 10997)

C5-1122   21 nt Target: 5'-UUGGUUGCUACUCCUCUUUUC-3'  (SEQ ID NO: 10998)

C5-1123   21 nt Target: 5'-UGGUUGCUACUCCUCUUUUCC-3'  (SEQ ID NO: 10999)

C5-1124   21 nt Target: 5'-GGUUGCUACUCCUCUUUUCCU-3'  (SEQ ID NO: 11000)

C5-1125   21 nt Target: 5'-GUUGCUACUCCUCUUUUCCUG-3'  (SEQ ID NO: 11001)

C5-1126   21 nt Target: 5'-UUGCUACUCCUCUUUUCCUGA-3'  (SEQ ID NO: 11002)

C5-1127   21 nt Target: 5'-UGCUACUCCUCUUUUCCUGAA-3'  (SEQ ID NO: 11003)

C5-1128   21 nt Target: 5'-GCUACUCCUCUUUUCCUGAAG-3'  (SEQ ID NO: 11004)

C5-1129   21 nt Target: 5'-CUACUCCUCUUUUCCUGAAGC-3'  (SEQ ID NO: 11005)

C5-1130   21 nt Target: 5'-UACUCCUCUUUUCCUGAAGCC-3'  (SEQ ID NO: 11006)

C5-1131   21 nt Target: 5'-ACUCCUCUUUUCCUGAAGCCU-3'  (SEQ ID NO: 11007)

C5-1132   21 nt Target: 5'-CUCCUCUUUUCCUGAAGCCUG-3'  (SEQ ID NO: 11008)

C5-1133   21 nt Target: 5'-UCCUCUUUUCCUGAAGCCUGG-3'  (SEQ ID NO: 11009)

C5-1134   21 nt Target: 5'-CCUCUUUUCCUGAAGCCUGGG-3'  (SEQ ID NO: 11010)

C5-1135   21 nt Target: 5'-CUCUUUUCCUGAAGCCUGGGA-3'  (SEQ ID NO: 11011)

C5-1136   21 nt Target: 5'-UCUUUUCCUGAAGCCUGGGAU-3'  (SEQ ID NO: 11012)

C5-1137   21 nt Target: 5'-CUUUUCCUGAAGCCUGGGAUU-3'  (SEQ ID NO: 11013)

TABLE 8-continued

DsiRNA Target Sequences (21 mers) of Human Anti-C5
DsiRNAs Predicted to have > 50% Knockdown Efficacy

| | | |
|---|---|---|
| C5-1138 | 21 nt Target: 5'-UUUUCCUGAAGCCUGGGAUUC-3' | (SEQ ID NO: 11014) |
| C5-1139 | 21 nt Target: 5'-UUUCCUGAAGCCUGGGAUUCC-3' | (SEQ ID NO: 11015) |
| C5-1140 | 21 nt Target: 5'-UUCCUGAAGCCUGGGAUUCCA-3' | (SEQ ID NO: 11016) |
| C5-1141 | 21 nt Target: 5'-UCCUGAAGCCUGGGAUUCCAU-3' | (SEQ ID NO: 11017) |
| C5-1142 | 21 nt Target: 5'-CCUGAAGCCUGGGAUUCCAUA-3' | (SEQ ID NO: 11018) |
| C5-1143 | 21 nt Target: 5'-CUGAAGCCUGGGAUUCCAUAU-3' | (SEQ ID NO: 11019) |
| C5-1163 | 21 nt Target: 5'-UCCCAUCAAGGUGCAGGUUAA-3' | (SEQ ID NO: 11020) |
| C5-1164 | 21 nt Target: 5'-CCCAUCAAGGUGCAGGUUAAA-3' | (SEQ ID NO: 11021) |
| C5-1165 | 21 nt Target: 5'-CCAUCAAGGUGCAGGUUAAAG-3' | (SEQ ID NO: 11022) |
| C5-1166 | 21 nt Target: 5'-CAUCAAGGUGCAGGUUAAAGA-3' | (SEQ ID NO: 11023) |
| C5-1167 | 21 nt Target: 5'-AUCAAGGUGCAGGUUAAAGAU-3' | (SEQ ID NO: 11024) |
| C5-1187 | 21 nt Target: 5'-UUCGCUUGACCAGUUGGUAGG-3' | (SEQ ID NO: 11025) |
| C5-1188 | 21 nt Target: 5'-UCGCUUGACCAGUUGGUAGGA-3' | (SEQ ID NO: 11026) |
| C5-1189 | 21 nt Target: 5'-CGCUUGACCAGUUGGUAGGAG-3' | (SEQ ID NO: 11027) |
| C5-1190 | 21 nt Target: 5'-GCUUGACCAGUUGGUAGGAGG-3' | (SEQ ID NO: 11028) |
| C5-1210 | 21 nt Target: 5'-GAGUCCCAGUAACACUGAAUG-3' | (SEQ ID NO: 11029) |
| C5-1211 | 21 nt Target: 5'-AGUCCCAGUAACACUGAAUGC-3' | (SEQ ID NO: 11030) |
| C5-1212 | 21 nt Target: 5'-GUCCCAGUAACACUGAAUGCA-3' | (SEQ ID NO: 11031) |
| C5-1213 | 21 nt Target: 5'-UCCCAGUAACACUGAAUGCAC-3' | (SEQ ID NO: 11032) |
| C5-1214 | 21 nt Target: 5'-CCCAGUAACACUGAAUGCACA-3' | (SEQ ID NO: 11033) |
| C5-1215 | 21 nt Target: 5'-CCAGUAACACUGAAUGCACAA-3' | (SEQ ID NO: 11034) |
| C5-1216 | 21 nt Target: 5'-CAGUAACACUGAAUGCACAAA-3' | (SEQ ID NO: 11035) |
| C5-1217 | 21 nt Target: 5'-AGUAACACUGAAUGCACAAAC-3' | (SEQ ID NO: 11036) |
| C5-1218 | 21 nt Target: 5'-GUAACACUGAAUGCACAAACA-3' | (SEQ ID NO: 11037) |
| C5-1219 | 21 nt Target: 5'-UAACACUGAAUGCACAAACAA-3' | (SEQ ID NO: 11038) |
| C5-1220 | 21 nt Target: 5'-AACACUGAAUGCACAAACAAU-3' | (SEQ ID NO: 11039) |
| C5-1221 | 21 nt Target: 5'-ACACUGAAUGCACAAACAAUU-3' | (SEQ ID NO: 11040) |
| C5-1224 | 21 nt Target: 5'-CUGAAUGCACAAACAAUUGAU-3' | (SEQ ID NO: 11041) |
| C5-1225 | 21 nt Target: 5'-UGAAUGCACAAACAAUUGAUG-3' | (SEQ ID NO: 11042) |
| C5-1226 | 21 nt Target: 5'-GAAUGCACAAACAAUUGAUGU-3' | (SEQ ID NO: 11043) |
| C5-1246 | 21 nt Target: 5'-UAAACCAAGAGACAUCUGACU-3' | (SEQ ID NO: 11044) |
| C5-1247 | 21 nt Target: 5'-AAACCAAGAGACAUCUGACUU-3' | (SEQ ID NO: 11045) |
| C5-1248 | 21 nt Target: 5'-AACCAAGAGACAUCUGACUUG-3' | (SEQ ID NO: 11046) |
| C5-1276 | 21 nt Target: 5'-GCAAAAGUGUAACACGUGUUUG-3' | (SEQ ID NO: 11047) |
| C5-1277 | 21 nt Target: 5'-CAAAAGUGUAACACGUGUUGA-3' | (SEQ ID NO: 11048) |
| C5-1278 | 21 nt Target: 5'-AAAAGUGUAACACGUGUUGAU-3' | (SEQ ID NO: 11049) |
| C5-1279 | 21 nt Target: 5'-AAAGUGUAACACGUGUUGAUG-3' | (SEQ ID NO: 11050) |
| C5-1280 | 21 nt Target: 5'-AAGUGUAACACGUGUUGAUGA-3' | (SEQ ID NO: 11051) |
| C5-1281 | 21 nt Target: 5'-AGUGUAACACGUGUUGAUGAU-3' | (SEQ ID NO: 11052) |

TABLE 8-continued

DsiRNA Target Sequences (21 mers) of Human Anti-C5
DsiRNAs Predicted to have > 50% Knockdown Efficacy

| | | |
|---|---|---|
| C5-1282 | 21 nt Target: 5'-GUGUAACACGUGUUGAUGAUG-3' | (SEQ ID NO: 11053) |
| C5-1283 | 21 nt Target: 5'-UGUAACACGUGUUGAUGAUGG-3' | (SEQ ID NO: 11054) |
| C5-1284 | 21 nt Target: 5'-GUAACACGUGUUGAUGAUGGA-3' | (SEQ ID NO: 11055) |
| C5-1285 | 21 nt Target: 5'-UAACACGUGUUGAUGAUGGAG-3' | (SEQ ID NO: 11056) |
| C5-1286 | 21 nt Target: 5'-AACACGUGUUGAUGAUGGAGU-3' | (SEQ ID NO: 11057) |
| C5-1287 | 21 nt Target: 5'-ACACGUGUUGAUGAUGGAGUA-3' | (SEQ ID NO: 11058) |
| C5-1288 | 21 nt Target: 5'-CACGUGUUGAUGAUGGAGUAG-3' | (SEQ ID NO: 11059) |
| C5-1289 | 21 nt Target: 5'-ACGUGUUGAUGAUGGAGUAGC-3' | (SEQ ID NO: 11060) |
| C5-1290 | 21 nt Target: 5'-CGUGUUGAUGAUGGAGUAGCU-3' | (SEQ ID NO: 11061) |
| C5-1291 | 21 nt Target: 5'-GUGUUGAUGAUGGAGUAGCUU-3' | (SEQ ID NO: 11062) |
| C5-1292 | 21 nt Target: 5'-UGUUGAUGAUGGAGUAGCUUC-3' | (SEQ ID NO: 11063) |
| C5-1319 | 21 nt Target: 5'-GCUUAAUCUCCCAUCUGGAGU-3' | (SEQ ID NO: 11064) |
| C5-1320 | 21 nt Target: 5'-CUUAAUCUCCCAUCUGGAGUG-3' | (SEQ ID NO: 11065) |
| C5-1321 | 21 nt Target: 5'-UUAAUCUCCCAUCUGGAGUGA-3' | (SEQ ID NO: 11066) |
| C5-1322 | 21 nt Target: 5'-UAAUCUCCCAUCUGGAGUGAC-3' | (SEQ ID NO: 11067) |
| C5-1323 | 21 nt Target: 5'-AAUCUCCCAUCUGGAGUGACG-3' | (SEQ ID NO: 11068) |
| C5-1325 | 21 nt Target: 5'-UCUCCCAUCUGGAGUGACGGU-3' | (SEQ ID NO: 11069) |
| C5-1327 | 21 nt Target: 5'-UCCCAUCUGGAGUGACGGUGC-3' | (SEQ ID NO: 11070) |
| C5-1328 | 21 nt Target: 5'-CCCAUCUGGAGUGACGGUGCU-3' | (SEQ ID NO: 11071) |
| C5-1329 | 21 nt Target: 5'-CCAUCUGGAGUGACGGUGCUG-3' | (SEQ ID NO: 11072) |
| C5-1330 | 21 nt Target: 5'-CAUCUGGAGUGACGGUGCUGG-3' | (SEQ ID NO: 11073) |
| C5-1331 | 21 nt Target: 5'-AUCUGGAGUGACGGUGCUGGA-3' | (SEQ ID NO: 11074) |
| C5-1332 | 21 nt Target: 5'-UCUGGAGUGACGGUGCUGGAG-3' | (SEQ ID NO: 11075) |
| C5-1333 | 21 nt Target: 5'-CUGGAGUGACGGUGCUGGAGU-3' | (SEQ ID NO: 11076) |
| C5-1334 | 21 nt Target: 5'-UGGAGUGACGGUGCUGGAGUU-3' | (SEQ ID NO: 11077) |
| C5-1335 | 21 nt Target: 5'-GGAGUGACGGUGCUGGAGUUU-3' | (SEQ ID NO: 11078) |
| C5-1336 | 21 nt Target: 5'-GAGUGACGGUGCUGGAGUUUA-3' | (SEQ ID NO: 11079) |
| C5-1337 | 21 nt Target: 5'-AGUGACGGUGCUGGAGUUUAA-3' | (SEQ ID NO: 11080) |
| C5-1338 | 21 nt Target: 5'-GUGACGGUGCUGGAGUUUAAU-3' | (SEQ ID NO: 11081) |
| C5-1339 | 21 nt Target: 5'-UGACGGUGCUGGAGUUUAAUG-3' | (SEQ ID NO: 11082) |
| C5-1340 | 21 nt Target: 5'-GACGGUGCUGGAGUUUAAUGU-3' | (SEQ ID NO: 11083) |
| C5-1341 | 21 nt Target: 5'-ACGGUGCUGGAGUUUAAUGUC-3' | (SEQ ID NO: 11084) |
| C5-1342 | 21 nt Target: 5'-CGGUGCUGGAGUUUAAUGUCA-3' | (SEQ ID NO: 11085) |
| C5-1343 | 21 nt Target: 5'-GGUGCUGGAGUUUAAUGUCAA-3' | (SEQ ID NO: 11086) |
| C5-1344 | 21 nt Target: 5'-GUGCUGGAGUUUAAUGUCAAA-3' | (SEQ ID NO: 11087) |
| C5-1345 | 21 nt Target: 5'-UGCUGGAGUUUAAUGUCAAAA-3' | (SEQ ID NO: 11088) |
| C5-1346 | 21 nt Target: 5'-GCUGGAGUUUAAUGUCAAAAC-3' | (SEQ ID NO: 11089) |
| C5-1347 | 21 nt Target: 5'-CUGGAGUUUAAUGUCAAAACU-3' | (SEQ ID NO: 11090) |

TABLE 8-continued

DsiRNA Target Sequences (21 mers) of Human Anti-C5
DsiRNAs Predicted to have > 50% Knockdown Efficacy

| | | |
|---|---|---|
| C5-1348 | 21 nt Target: 5'-UGGAGUUUAAUGUCAAAACUG-3' | (SEQ ID NO: 11091) |
| C5-1349 | 21 nt Target: 5'-GGAGUUUAAUGUCAAAACUGA-3' | (SEQ ID NO: 11092) |
| C5-1350 | 21 nt Target: 5'-GAGUUUAAUGUCAAAACUGAU-3' | (SEQ ID NO: 11093) |
| C5-1351 | 21 nt Target: 5'-AGUUUAAUGUCAAAACUGAUG-3' | (SEQ ID NO: 11094) |
| C5-1352 | 21 nt Target: 5'-GUUUAAUGUCAAAACUGAUGC-3' | (SEQ ID NO: 11095) |
| C5-1353 | 21 nt Target: 5'-UUUAAUGUCAAAACUGAUGCU-3' | (SEQ ID NO: 11096) |
| C5-1354 | 21 nt Target: 5'-UUAAUGUCAAAACUGAUGCUC-3' | (SEQ ID NO: 11097) |
| C5-1355 | 21 nt Target: 5'-UAAUGUCAAAACUGAUGCUCC-3' | (SEQ ID NO: 11098) |
| C5-1356 | 21 nt Target: 5'-AAUGUCAAAACUGAUGCUCCA-3' | (SEQ ID NO: 11099) |
| C5-1357 | 21 nt Target: 5'-AUGUCAAAACUGAUGCUCCAG-3' | (SEQ ID NO: 11100) |
| C5-1358 | 21 nt Target: 5'-UGUCAAAACUGAUGCUCCAGA-3' | (SEQ ID NO: 11101) |
| C5-1359 | 21 nt Target: 5'-GUCAAAACUGAUGCUCCAGAU-3' | (SEQ ID NO: 11102) |
| C5-1360 | 21 nt Target: 5'-UCAAAACUGAUGCUCCAGAUC-3' | (SEQ ID NO: 11103) |
| C5-1361 | 21 nt Target: 5'-CAAAACUGAUGCUCCAGAUCU-3' | (SEQ ID NO: 11104) |
| C5-1362 | 21 nt Target: 5'-AAAACUGAUGCUCCAGAUCUU-3' | (SEQ ID NO: 11105) |
| C5-1363 | 21 nt Target: 5'-AAACUGAUGCUCCAGAUCUUC-3' | (SEQ ID NO: 11106) |
| C5-1364 | 21 nt Target: 5'-AACUGAUGCUCCAGAUCUUCC-3' | (SEQ ID NO: 11107) |
| C5-1365 | 21 nt Target: 5'-ACUGAUGCUCCAGAUCUUCCA-3' | (SEQ ID NO: 11108) |
| C5-1366 | 21 nt Target: 5'-CUGAUGCUCCAGAUCUUCCAG-3' | (SEQ ID NO: 11109) |
| C5-1367 | 21 nt Target: 5'-UGAUGCUCCAGAUCUUCCAGA-3' | (SEQ ID NO: 11110) |
| C5-1387 | 21 nt Target: 5'-AAGAAAAUCAGGCCAGGGAAG-3' | (SEQ ID NO: 11111) |
| C5-1388 | 21 nt Target: 5'-AGAAAAUCAGGCCAGGGAAGG-3' | (SEQ ID NO: 11112) |
| C5-1389 | 21 nt Target: 5'-GAAAAUCAGGCCAGGGAAGGU-3' | (SEQ ID NO: 11113) |
| C5-1390 | 21 nt Target: 5'-AAAAUCAGGCCAGGGAAGGUU-3' | (SEQ ID NO: 11114) |
| C5-1391 | 21 nt Target: 5'-AAAUCAGGCCAGGGAAGGUUA-3' | (SEQ ID NO: 11115) |
| C5-1392 | 21 nt Target: 5'-AAUCAGGCCAGGGAAGGUUAC-3' | (SEQ ID NO: 11116) |
| C5-1393 | 21 nt Target: 5'-AUCAGGCCAGGGAAGGUUACC-3' | (SEQ ID NO: 11117) |
| C5-1394 | 21 nt Target: 5'-UCAGGCCAGGGAAGGUUACCG-3' | (SEQ ID NO: 11118) |
| C5-1395 | 21 nt Target: 5'-CAGGCCAGGGAAGGUUACCGA-3' | (SEQ ID NO: 11119) |
| C5-1396 | 21 nt Target: 5'-AGGCCAGGGAAGGUUACCGAG-3' | (SEQ ID NO: 11120) |
| C5-1397 | 21 nt Target: 5'-GGCCAGGGAAGGUUACCGAGC-3' | (SEQ ID NO: 11121) |
| C5-1398 | 21 nt Target: 5'-GCCAGGGAAGGUUACCGAGCA-3' | (SEQ ID NO: 11122) |
| C5-1399 | 21 nt Target: 5'-CCAGGGAAGGUUACCGAGCAA-3' | (SEQ ID NO: 11123) |
| C5-1400 | 21 nt Target: 5'-CAGGGAAGGUUACCGAGCAAU-3' | (SEQ ID NO: 11124) |
| C5-1401 | 21 nt Target: 5'-AGGGAAGGUUACCGAGCAAUA-3' | (SEQ ID NO: 11125) |
| C5-1402 | 21 nt Target: 5'-GGGAAGGUUACCGAGCAAUAG-3' | (SEQ ID NO: 11126) |
| C5-1403 | 21 nt Target: 5'-GGAAGGUUACCGAGCAAUAGC-3' | (SEQ ID NO: 11127) |
| C5-1404 | 21 nt Target: 5'-GAAGGUUACCGAGCAAUAGCA-3' | (SEQ ID NO: 11128) |
| C5-1406 | 21 nt Target: 5'-AGGUUACCGAGCAAUAGCAUA-3' | (SEQ ID NO: 11129) |

TABLE 8-continued

DsiRNA Target Sequences (21 mers) of Human Anti-C5
DsiRNAs Predicted to have > 50% Knockdown Efficacy C5-1407   21 nt Target:  5'-GGUUACCGAGCAAUAGCAUAC-3'  (SEQ ID NO: 11130)

C5-1408   21 nt Target:  5'-GUUACCGAGCAAUAGCAUACU-3'  (SEQ ID NO: 11131)

C5-1409   21 nt Target:  5'-UUACCGAGCAAUAGCAUACUC-3'  (SEQ ID NO: 11132)

C5-1410   21 nt Target:  5'-UACCGAGCAAUAGCAUACUCA-3'  (SEQ ID NO: 11133)

C5-1411   21 nt Target:  5'-ACCGAGCAAUAGCAUACUCAU-3'  (SEQ ID NO: 11134)

C5-1412   21 nt Target:  5'-CCGAGCAAUAGCAUACUCAUC-3'  (SEQ ID NO: 11135)

C5-1413   21 nt Target:  5'-CGAGCAAUAGCAUACUCAUCU-3'  (SEQ ID NO: 11136)

C5-1414   21 nt Target:  5'-GAGCAAUAGCAUACUCAUCUC-3'  (SEQ ID NO: 11137)

C5-1415   21 nt Target:  5'-AGCAAUAGCAUACUCAUCUCU-3'  (SEQ ID NO: 11138)

C5-1416   21 nt Target:  5'-GCAAUAGCAUACUCAUCUCUC-3'  (SEQ ID NO: 11139)

C5-1417   21 nt Target:  5'-CAAUAGCAUACUCAUCUCUCA-3'  (SEQ ID NO: 11140)

C5-1418   21 nt Target:  5'-AAUAGCAUACUCAUCUCUCAG-3'  (SEQ ID NO: 11141)

C5-1419   21 nt Target:  5'-AUAGCAUACUCAUCUCUCAGC-3'  (SEQ ID NO: 11142)

C5-1420   21 nt Target:  5'-UAGCAUACUCAUCUCUCAGCC-3'  (SEQ ID NO: 11143)

C5-1421   21 nt Target:  5'-AGCAUACUCAUCUCUCAGCCA-3'  (SEQ ID NO: 11144)

C5-1422   21 nt Target:  5'-GCAUACUCAUCUCUCAGCCAA-3'  (SEQ ID NO: 11145)

C5-1423   21 nt Target:  5'-CAUACUCAUCUCUCAGCCAAA-3'  (SEQ ID NO: 11146)

C5-1424   21 nt Target:  5'-AUACUCAUCUCUCAGCCAAAG-3'  (SEQ ID NO: 11147)

C5-1425   21 nt Target:  5'-UACUCAUCUCUCAGCCAAAGU-3'  (SEQ ID NO: 11148)

C5-1426   21 nt Target:  5'-ACUCAUCUCUCAGCCAAAGUU-3'  (SEQ ID NO: 11149)

C5-1427   21 nt Target:  5'-CUCAUCUCUCAGCCAAAGUUA-3'  (SEQ ID NO: 11150)

C5-1428   21 nt Target:  5'-UCAUCUCUCAGCCAAAGUUAC-3'  (SEQ ID NO: 11151)

C5-1429   21 nt Target:  5'-CAUCUCUCAGCCAAAGUUACC-3'  (SEQ ID NO: 11152)

C5-1430   21 nt Target:  5'-AUCUCUCAGCCAAAGUUACCU-3'  (SEQ ID NO: 11153)

C5-1431   21 nt Target:  5'-UCUCUCAGCCAAAGUUACCUU-3'  (SEQ ID NO: 11154)

C5-1432   21 nt Target:  5'-CUCUCAGCCAAAGUUACCUUU-3'  (SEQ ID NO: 11155)

C5-1474   21 nt Target:  5'-AUAAGGCUUUGCUAGUGGGAG-3'  (SEQ ID NO: 11156)

C5-1475   21 nt Target:  5'-UAAGGCUUUGCUAGUGGGAGA-3'  (SEQ ID NO: 11157)

C5-1476   21 nt Target:  5'-AAGGCUUUGCUAGUGGGAGAA-3'  (SEQ ID NO: 11158)

C5-1517   21 nt Target:  5'-CCCCAAAAGCCCAUAUAUUGA-3'  (SEQ ID NO: 11159)

C5-1518   21 nt Target:  5'-CCCAAAAGCCCAUAUAUUGAC-3'  (SEQ ID NO: 11160)

C5-1520   21 nt Target:  5'-CAAAAGCCCAUAUAUUGACAA-3'  (SEQ ID NO: 11161)

C5-1521   21 nt Target:  5'-AAAAGCCCAUAUAUUGACAAA-3'  (SEQ ID NO: 11162)

C5-1522   21 nt Target:  5'-AAAGCCCAUAUAUUGACAAAA-3'  (SEQ ID NO: 11163)

C5-1525   21 nt Target:  5'-GCCCAUAUAUUGACAAAAUAA-3'  (SEQ ID NO: 11164)

C5-1529   21 nt Target:  5'-AUAUAUUGACAAAAUAACUCA-3'  (SEQ ID NO: 11165)

C5-1530   21 nt Target:  5'-UAUAUUGACAAAAUAACUCAC-3'  (SEQ ID NO: 11166)

C5-1532   21 nt Target:  5'-UAUUGACAAAAUAACUCACUA-3'  (SEQ ID NO: 11167)

TABLE 8-continued

DsiRNA Target Sequences (21 mers) of Human Anti-C5
DsiRNAs Predicted to have > 50% Knockdown Efficacy

| | | |
|---|---|---|
| C5-1555 | 21 nt Target: 5'-AUUACUUGAUUUUAUCCAAGG-3' | (SEQ ID NO: 11168) |
| C5-1556 | 21 nt Target: 5'-UUACUUGAUUUUAUCCAAGGG-3' | (SEQ ID NO: 11169) |
| C5-1557 | 21 nt Target: 5'-UACUUGAUUUUAUCCAAGGGC-3' | (SEQ ID NO: 11170) |
| C5-1558 | 21 nt Target: 5'-ACUUGAUUUUAUCCAAGGGCA-3' | (SEQ ID NO: 11171) |
| C5-1559 | 21 nt Target: 5'-CUUGAUUUUAUCCAAGGGCAA-3' | (SEQ ID NO: 11172) |
| C5-1560 | 21 nt Target: 5'-UUGAUUUUAUCCAAGGGCAAA-3' | (SEQ ID NO: 11173) |
| C5-1561 | 21 nt Target: 5'-UGAUUUUAUCCAAGGGCAAAA-3' | (SEQ ID NO: 11174) |
| C5-1562 | 21 nt Target: 5'-GAUUUUAUCCAAGGGCAAAAU-3' | (SEQ ID NO: 11175) |
| C5-1563 | 21 nt Target: 5'-AUUUUAUCCAAGGGCAAAAUU-3' | (SEQ ID NO: 11176) |
| C5-1564 | 21 nt Target: 5'-UUUUAUCCAAGGGCAAAAUUA-3' | (SEQ ID NO: 11177) |
| C5-1565 | 21 nt Target: 5'-UUUAUCCAAGGGCAAAAUUAU-3' | (SEQ ID NO: 11178) |
| C5-1566 | 21 nt Target: 5'-UUAUCCAAGGGCAAAAUUAUC-3' | (SEQ ID NO: 11179) |
| C5-1567 | 21 nt Target: 5'-UAUCCAAGGGCAAAAUUAUCC-3' | (SEQ ID NO: 11180) |
| C5-1568 | 21 nt Target: 5'-AUCCAAGGGCAAAAUUAUCCA-3' | (SEQ ID NO: 11181) |
| C5-1569 | 21 nt Target: 5'-UCCAAGGGCAAAAUUAUCCAC-3' | (SEQ ID NO: 11182) |
| C5-1570 | 21 nt Target: 5'-CCAAGGGCAAAAUUAUCCACU-3' | (SEQ ID NO: 11183) |
| C5-1571 | 21 nt Target: 5'-CAAGGGCAAAAUUAUCCACUU-3' | (SEQ ID NO: 11184) |
| C5-1572 | 21 nt Target: 5'-AAGGGCAAAAUUAUCCACUUU-3' | (SEQ ID NO: 11185) |
| C5-1573 | 21 nt Target: 5'-AGGGCAAAAUUAUCCACUUUG-3' | (SEQ ID NO: 11186) |
| C5-1574 | 21 nt Target: 5'-GGGCAAAAUUAUCCACUUUGG-3' | (SEQ ID NO: 11187) |
| C5-1575 | 21 nt Target: 5'-GGCAAAAUUAUCCACUUUGGC-3' | (SEQ ID NO: 11188) |
| C5-1576 | 21 nt Target: 5'-GCAAAAUUAUCCACUUUGGCA-3' | (SEQ ID NO: 11189) |
| C5-1577 | 21 nt Target: 5'-CAAAAUUAUCCACUUUGGCAC-3' | (SEQ ID NO: 11190) |
| C5-1607 | 21 nt Target: 5'-AUUUUCAGAUGCAUCUUAUCA-3' | (SEQ ID NO: 11191) |
| C5-1608 | 21 nt Target: 5'-UUUUCAGAUGCAUCUUAUCAA-3' | (SEQ ID NO: 11192) |
| C5-1609 | 21 nt Target: 5'-UUUCAGAUGCAUCUUAUCAAA-3' | (SEQ ID NO: 11193) |
| C5-1610 | 21 nt Target: 5'-UUCAGAUGCAUCUUAUCAAAG-3' | (SEQ ID NO: 11194) |
| C5-1611 | 21 nt Target: 5'-UCAGAUGCAUCUUAUCAAAGU-3' | (SEQ ID NO: 11195) |
| C5-1612 | 21 nt Target: 5'-CAGAUGCAUCUUAUCAAAGUA-3' | (SEQ ID NO: 11196) |
| C5-1613 | 21 nt Target: 5'-AGAUGCAUCUUAUCAAAGUAU-3' | (SEQ ID NO: 11197) |
| C5-1614 | 21 nt Target: 5'-GAUGCAUCUUAUCAAAGUAUA-3' | (SEQ ID NO: 11198) |
| C5-1615 | 21 nt Target: 5'-AUGCAUCUUAUCAAAGUAUAA-3' | (SEQ ID NO: 11199) |
| C5-1616 | 21 nt Target: 5'-UGCAUCUUAUCAAAGUAUAAA-3' | (SEQ ID NO: 11200) |
| C5-1617 | 21 nt Target: 5'-GCAUCUUAUCAAAGUAUAAAC-3' | (SEQ ID NO: 11201) |
| C5-1618 | 21 nt Target: 5'-CAUCUUAUCAAAGUAUAAACA-3' | (SEQ ID NO: 11202) |
| C5-1619 | 21 nt Target: 5'-AUCUUAUCAAAGUAUAAACAU-3' | (SEQ ID NO: 11203) |
| C5-1620 | 21 nt Target: 5'-UCUUAUCAAAGUAUAAACAUU-3' | (SEQ ID NO: 11204) |
| C5-1621 | 21 nt Target: 5'-CUUAUCAAAGUAUAAACAUUC-3' | (SEQ ID NO: 11205) |
| C5-1622 | 21 nt Target: 5'-UUAUCAAAGUAUAAACAUUCC-3' | (SEQ ID NO: 11206) |

TABLE 8-continued

DsiRNA Target Sequences (21 mers) of Human Anti-C5
DsiRNAs Predicted to have > 50% Knockdown Efficac TABLE 8-continued DsiRNA Target Sequences (21 mers) of Human Anti-C5
DsiRNAs Predicted to have > 50% Knockdown Efficacy

| | | |
|---|---|---|
| C5-1735 | 21 nt Target: 5'-GGUUAAAUAUUGAAGAAAAAU-3' | (SEQ ID NO: 11245) |
| C5-1736 | 21 nt Target: 5'-GUUAAAUAUUGAAGAAAAAUG-3' | (SEQ ID NO: 11246) |
| C5-1737 | 21 nt Target: 5'-UUAAAUAUUGAAGAAAAAUGU-3' | (SEQ ID NO: 11247) |
| C5-1738 | 21 nt Target: 5'-UAAAUAUUGAAGAAAAAUGUG-3' | (SEQ ID NO: 11248) |
| C5-1739 | 21 nt Target: 5'-AAAUAUUGAAGAAAAAUGUGG-3' | (SEQ ID NO: 11249) |
| C5-1740 | 21 nt Target: 5'-AAUAUUGAAGAAAAAUGUGGC-3' | (SEQ ID NO: 11250) |
| C5-1741 | 21 nt Target: 5'-AUAUUGAAGAAAAAUGUGGCA-3' | (SEQ ID NO: 11251) |
| C5-1742 | 21 nt Target: 5'-UAUUGAAGAAAAAUGUGGCAA-3' | (SEQ ID NO: 11252) |
| C5-1743 | 21 nt Target: 5'-AUUGAAGAAAAAUGUGGCAAC-3' | (SEQ ID NO: 11253) |
| C5-1744 | 21 nt Target: 5'-UUGAAGAAAAAUGUGGCAACC-3' | (SEQ ID NO: 11254) |
| C5-1745 | 21 nt Target: 5'-UGAAGAAAAAUGUGGCAACCA-3' | (SEQ ID NO: 11255) |
| C5-1746 | 21 nt Target: 5'-GAAGAAAAAUGUGGCAACCAG-3' | (SEQ ID NO: 11256) |
| C5-1747 | 21 nt Target: 5'-AAGAAAAAUGUGGCAACCAGC-3' | (SEQ ID NO: 11257) |
| C5-1748 | 21 nt Target: 5'-AGAAAAAUGUGGCAACCAGCU-3' | (SEQ ID NO: 11258) |
| C5-1749 | 21 nt Target: 5'-GAAAAAUGUGGCAACCAGCUC-3' | (SEQ ID NO: 11259) |
| C5-1750 | 21 nt Target: 5'-AAAAAUGUGGCAACCAGCUCC-3' | (SEQ ID NO: 11260) |
| C5-1751 | 21 nt Target: 5'-AAAAUGUGGCAACCAGCUCCA-3' | (SEQ ID NO: 11261) |
| C5-1752 | 21 nt Target: 5'-AAAUGUGGCAACCAGCUCCAG-3' | (SEQ ID NO: 11262) |
| C5-1755 | 21 nt Target: 5'-UGUGGCAACCAGCUCCAGGUU-3' | (SEQ ID NO: 11263) |
| C5-1756 | 21 nt Target: 5'-GUGGCAACCAGCUCCAGGUUC-3' | (SEQ ID NO: 11264) |
| C5-1757 | 21 nt Target: 5'-UGGCAACCAGCUCCAGGUUCA-3' | (SEQ ID NO: 11265) |
| C5-1758 | 21 nt Target: 5'-GGCAACCAGCUCCAGGUUCAU-3' | (SEQ ID NO: 11266) |
| C5-1759 | 21 nt Target: 5'-GCAACCAGCUCCAGGUUCAUC-3' | (SEQ ID NO: 11267) |
| C5-1760 | 21 nt Target: 5'-CAACCAGCUCCAGGUUCAUCU-3' | (SEQ ID NO: 11268) |
| C5-1761 | 21 nt Target: 5'-AACCAGCUCCAGGUUCAUCUG-3' | (SEQ ID NO: 11269) |
| C5-1762 | 21 nt Target: 5'-ACCAGCUCCAGGUUCAUCUGU-3' | (SEQ ID NO: 11270) |
| C5-1763 | 21 nt Target: 5'-CCAGCUCCAGGUUCAUCUGUC-3' | (SEQ ID NO: 11271) |
| C5-1764 | 21 nt Target: 5'-CAGCUCCAGGUUCAUCUGUCU-3' | (SEQ ID NO: 11272) |
| C5-1765 | 21 nt Target: 5'-AGCUCCAGGUUCAUCUGUCUC-3' | (SEQ ID NO: 11273) |
| C5-1766 | 21 nt Target: 5'-GCUCCAGGUUCAUCUGUCUCC-3' | (SEQ ID NO: 11274) |
| C5-1767 | 21 nt Target: 5'-CUCCAGGUUCAUCUGUCUCCU-3' | (SEQ ID NO: 11275) |
| C5-1768 | 21 nt Target: 5'-UCCAGGUUCAUCUGUCUCCUG-3' | (SEQ ID NO: 11276) |
| C5-1769 | 21 nt Target: 5'-CCAGGUUCAUCUGUCUCCUGA-3' | (SEQ ID NO: 11277) |
| C5-1770 | 21 nt Target: 5'-CAGGUUCAUCUGUCUCCUGAU-3' | (SEQ ID NO: 11278) |
| C5-1771 | 21 nt Target: 5'-AGGUUCAUCUGUCUCCUGAUG-3' | (SEQ ID NO: 11279) |
| C5-1772 | 21 nt Target: 5'-GGUUCAUCUGUCUCCUGAUGC-3' | (SEQ ID NO: 11280) |
| C5-1773 | 21 nt Target: 5'-GUUCAUCUGUCUCCUGAUGCA-3' | (SEQ ID NO: 11281) |
| C5-1774 | 21 nt Target: 5'-UUCAUCUGUCUCCUGAUGCAG-3' | (SEQ ID NO: 11282) |
| C5-1775 | 21 nt Target: 5'-UCAUCUGUCUCCUGAUGCAGA-3' | (SEQ ID NO: 11283) |

TABLE 8-continued

DsiRNA Target Sequences (21 mers) of Human Anti-C5
DsiRNAs Predicted to have > 50% Knockdown Efficacy

```
C5-1776    21 nt Target:  5'-CAUCUGUCUCCUGAUGCAGAU-3'  (SEQ ID NO: 11284)

C5-1840    21 nt Target:  5'-GAAUGGAUUCCUGGGUGGCAU-3'  (SEQ ID NO: 11285)

C5-1841    21 nt Target:  5'-AAUGGAUUCCUGGGUGGCAUU-3'  (SEQ ID NO: 11286)

C5-1842    21 nt Target:  5'-AUGGAUUCCUGGGUGGCAUUA-3'  (SEQ ID NO: 11287)

C5-1898    21 nt Target:  5'-AGGAGCCAAAAAGCCCUUGGA-3'  (SEQ ID NO: 11288)

C5-1899    21 nt Target:  5'-GGAGCCAAAAAGCCCUUGGAA-3'  (SEQ ID NO: 11289)

C5-1900    21 nt Target:  5'-GAGCCAAAAAGCCCUUGGAAA-3'  (SEQ ID NO: 11290)

C5-1901    21 nt Target:  5'-AGCCAAAAAGCCCUUGGAAAG-3'  (SEQ ID NO: 11291)

C5-1902    21 nt Target:  5'-GCCAAAAAGCCCUUGGAAAGA-3'  (SEQ ID NO: 11292)

C5-1903    21 nt Target:  5'-CCAAAAAGCCCUUGGAAAGAG-3'  (SEQ ID NO: 11293)

C5-1904    21 nt Target:  5'-CAAAAAGCCCUUGGAAAGAGU-3'  (SEQ ID NO: 11294)

C5-1905    21 nt Target:  5'-AAAAAGCCCUUGGAAAGAGUA-3'  (SEQ ID NO: 11295)

C5-1906    21 nt Target:  5'-AAAAGCCCUUGGAAAGAGUAU-3'  (SEQ ID NO: 11296)

C5-1907    21 nt Target:  5'-AAAGCCCUUGGAAAGAGUAUU-3'  (SEQ ID NO: 11297)

C5-1908    21 nt Target:  5'-AAGCCCUUGGAAAGAGUAUUU-3'  (SEQ ID NO: 11298)

C5-1909    21 nt Target:  5'-AGCCCUUGGAAAGAGUAUUUC-3'  (SEQ ID NO: 11299)

C5-1910    21 nt Target:  5'-GCCCUUGGAAAGAGUAUUUCA-3'  (SEQ ID NO: 11300)

C5-1911    21 nt Target:  5'-CCCUUGGAAAGAGUAUUUCAA-3'  (SEQ ID NO: 11301)

C5-1912    21 nt Target:  5'-CCUUGGAAAGAGUAUUUCAAU-3'  (SEQ ID NO: 11302)

C5-1913    21 nt Target:  5'-CUUGGAAAGAGUAUUUCAAUU-3'  (SEQ ID NO: 11303)

C5-1914    21 nt Target:  5'-UUGGAAAGAGUAUUUCAAUUC-3'  (SEQ ID NO: 11304)

C5-1915    21 nt Target:  5'-UGGAAAGAGUAUUUCAAUUCU-3'  (SEQ ID NO: 11305)

C5-1916    21 nt Target:  5'-GGAAAGAGUAUUUCAAUUCUU-3'  (SEQ ID NO: 11306)

C5-1917    21 nt Target:  5'-GAAAGAGUAUUUCAAUUCUUA-3'  (SEQ ID NO: 11307)

C5-1918    21 nt Target:  5'-AAAGAGUAUUUCAAUUCUUAG-3'  (SEQ ID NO: 11308)

C5-1919    21 nt Target:  5'-AAGAGUAUUUCAAUUCUUAGA-3'  (SEQ ID NO: 11309)

C5-1920    21 nt Target:  5'-AGAGUAUUUCAAUUCUUAGAG-3'  (SEQ ID NO: 11310)

C5-1921    21 nt Target:  5'-GAGUAUUUCAAUUCUUAGAGA-3'  (SEQ ID NO: 11311)

C5-1922    21 nt Target:  5'-AGUAUUUCAAUUCUUAGAGAA-3'  (SEQ ID NO: 11312)

C5-1923    21 nt Target:  5'-GUAUUUCAAUUCUUAGAGAAG-3'  (SEQ ID NO: 11313)

C5-1924    21 nt Target:  5'-UAUUUCAAUUCUUAGAGAAGA-3'  (SEQ ID NO: 11314)

C5-1925    21 nt Target:  5'-AUUUCAAUUCUUAGAGAAGAG-3'  (SEQ ID NO: 11315)

C5-1926    21 nt Target:  5'-UUUCAAUUCUUAGAGAAGAGU-3'  (SEQ ID NO: 11316)

C5-1927    21 nt Target:  5'-UUCAAUUCUUAGAGAAGAGUG-3'  (SEQ ID NO: 11317)

C5-1928    21 nt Target:  5'-UCAAUUCUUAGAGAAGAGUGA-3'  (SEQ ID NO: 11318)

C5-1929    21 nt Target:  5'-CAAUUCUUAGAGAAGAGUGAU-3'  (SEQ ID NO: 11319)

C5-1930    21 nt Target:  5'-AAUUCUUAGAGAAGAGUGAUC-3'  (SEQ ID NO: 11320)

C5-1932    21 nt Target:  5'-UUCUUAGAGAAGAGUGAUCUG-3'  (SEQ ID NO: 11321)
```

TABLE 8-continued

DsiRNA Target Sequences (21 mers) of Human Anti-C5
DsiRNAs Predicted to have > 50% Knockdown Efficacy

| | | |
|---|---|---|
| C5-1933 | 21 nt Target: 5'-UCUUAGAGAAGAGUGAUCUGG-3' | (SEQ ID NO: 11322) |
| C5-1935 | 21 nt Target: 5'-UUAGAGAAGAGUGAUCUGGGC-3' | (SEQ ID NO: 11323) |
| C5-1956 | 21 nt Target: 5'-UGUGGGGCAGGUGGUGGCCUC-3' | (SEQ ID NO: 11324) |
| C5-1960 | 21 nt Target: 5'-GGGCAGGUGGUGGCCUCAACA-3' | (SEQ ID NO: 11325) |
| C5-1961 | 21 nt Target: 5'-GGCAGGUGGUGGCCUCAACAA-3' | (SEQ ID NO: 11326) |
| C5-1962 | 21 nt Target: 5'-GCAGGUGGUGGCCUCAACAAU-3' | (SEQ ID NO: 11327) |
| C5-1963 | 21 nt Target: 5'-CAGGUGGUGGCCUCAACAAUG-3' | (SEQ ID NO: 11328) |
| C5-1964 | 21 nt Target: 5'-AGGUGGUGGCCUCAACAAUGC-3' | (SEQ ID NO: 11329) |
| C5-1965 | 21 nt Target: 5'-GGUGGUGGCCUCAACAAUGCC-3' | (SEQ ID NO: 11330) |
| C5-1989 | 21 nt Target: 5'-GUGUUCCACCUAGCUGGACUU-3' | (SEQ ID NO: 11331) |
| C5-1990 | 21 nt Target: 5'-UGUUCCACCUAGCUGGACUUA-3' | (SEQ ID NO: 11332) |
| C5-1991 | 21 nt Target: 5'-GUUCCACCUAGCUGGACUUAC-3' | (SEQ ID NO: 11333) |
| C5-1992 | 21 nt Target: 5'-UUCCACCUAGCUGGACUUACC-3' | (SEQ ID NO: 11334) |
| C5-1993 | 21 nt Target: 5'-UCCACCUAGCUGGACUUACCU-3' | (SEQ ID NO: 11335) |
| C5-1994 | 21 nt Target: 5'-CCACCUAGCUGGACUUACCUU-3' | (SEQ ID NO: 11336) |
| C5-1995 | 21 nt Target: 5'-CACCUAGCUGGACUUACCUUC-3' | (SEQ ID NO: 11337) |
| C5-1996 | 21 nt Target: 5'-ACCUAGCUGGACUUACCUUCC-3' | (SEQ ID NO: 11338) |
| C5-1997 | 21 nt Target: 5'-CCUAGCUGGACUUACCUUCCU-3' | (SEQ ID NO: 11339) |
| C5-1998 | 21 nt Target: 5'-CUAGCUGGACUUACCUUCCUC-3' | (SEQ ID NO: 11340) |
| C5-1999 | 21 nt Target: 5'-UAGCUGGACUUACCUUCCUCA-3' | (SEQ ID NO: 11341) |
| C5-2000 | 21 nt Target: 5'-AGCUGGACUUACCUUCCUCAC-3' | (SEQ ID NO: 11342) |
| C5-2001 | 21 nt Target: 5'-GCUGGACUUACCUUCCUCACU-3' | (SEQ ID NO: 11343) |
| C5-2002 | 21 nt Target: 5'-CUGGACUUACCUUCCUCACUA-3' | (SEQ ID NO: 11344) |
| C5-2003 | 21 nt Target: 5'-UGGACUUACCUUCCUCACUAA-3' | (SEQ ID NO: 11345) |
| C5-2004 | 21 nt Target: 5'-GGACUUACCUUCCUCACUAAU-3' | (SEQ ID NO: 11346) |
| C5-2005 | 21 nt Target: 5'-GACUUACCUUCCUCACUAAUG-3' | (SEQ ID NO: 11347) |
| C5-2006 | 21 nt Target: 5'-ACUUACCUUCCUCACUAAUGC-3' | (SEQ ID NO: 11348) |
| C5-2007 | 21 nt Target: 5'-CUUACCUUCCUCACUAAUGCA-3' | (SEQ ID NO: 11349) |
| C5-2008 | 21 nt Target: 5'-UUACCUUCCUCACUAAUGCAA-3' | (SEQ ID NO: 11350) |
| C5-2009 | 21 nt Target: 5'-UACCUUCCUCACUAAUGCAAA-3' | (SEQ ID NO: 11351) |
| C5-2010 | 21 nt Target: 5'-ACCUUCCUCACUAAUGCAAAU-3' | (SEQ ID NO: 11352) |
| C5-2011 | 21 nt Target: 5'-CCUUCCUCACUAAUGCAAAUG-3' | (SEQ ID NO: 11353) |
| C5-2012 | 21 nt Target: 5'-CUUCCUCACUAAUGCAAAUGC-3' | (SEQ ID NO: 11354) |
| C5-2013 | 21 nt Target: 5'-UUCCUCACUAAUGCAAAUGCA-3' | (SEQ ID NO: 11355) |
| C5-2014 | 21 nt Target: 5'-UCCUCACUAAUGCAAAUGCAG-3' | (SEQ ID NO: 11356) |
| C5-2015 | 21 nt Target: 5'-CCUCACUAAUGCAAAUGCAGA-3' | (SEQ ID NO: 11357) |
| C5-2016 | 21 nt Target: 5'-CUCACUAAUGCAAAUGCAGAU-3' | (SEQ ID NO: 11358) |
| C5-2017 | 21 nt Target: 5'-UCACUAAUGCAAAUGCAGAUG-3' | (SEQ ID NO: 11359) |
| C5-2018 | 21 nt Target: 5'-CACUAAUGCAAAUGCAGAUGA-3' | (SEQ ID NO: 11360) |

TABLE 8-continued

DsiRNA Target Sequences (21 mers) of Human Anti-C5
DsiRNAs Predicted to have > 50% Knockdown Efficacy C5-2019    21 nt Target:  5'-ACUAAUGCAAAUGCAGAUGAC-3'    (SEQ ID NO: 11361)

C5-2020    21 nt Target:  5'-CUAAUGCAAAUGCAGAUGACU-3'    (SEQ ID NO: 11362)

C5-2021    21 nt Target:  5'-UAAUGCAAAUGCAGAUGACUC-3'    (SEQ ID NO: 11363)

C5-2022    21 nt Target:  5'-AAUGCAAAUGCAGAUGACUCC-3'    (SEQ ID NO: 11364)

C5-2023    21 nt Target:  5'-AUGCAAAUGCAGAUGACUCCC-3'    (SEQ ID NO: 11365)

C5-2024    21 nt Target:  5'-UGCAAAUGCAGAUGACUCCCA-3'    (SEQ ID NO: 11366)

C5-2025    21 nt Target:  5'-GCAAAUGCAGAUGACUCCCAA-3'    (SEQ ID NO: 11367)

C5-2026    21 nt Target:  5'-CAAAUGCAGAUGACUCCCAAG-3'    (SEQ ID NO: 11368)

C5-2027    21 nt Target:  5'-AAAUGCAGAUGACUCCCAAGA-3'    (SEQ ID NO: 11369)

C5-2028    21 nt Target:  5'-AAUGCAGAUGACUCCCAAGAA-3'    (SEQ ID NO: 11370)

C5-2029    21 nt Target:  5'-AUGCAGAUGACUCCCAAGAAA-3'    (SEQ ID NO: 11371)

C5-2030    21 nt Target:  5'-UGCAGAUGACUCCCAAGAAAA-3'    (SEQ ID NO: 11372)

C5-2031    21 nt Target:  5'-GCAGAUGACUCCCAAGAAAAU-3'    (SEQ ID NO: 11373)

C5-2032    21 nt Target:  5'-CAGAUGACUCCCAAGAAAAUG-3'    (SEQ ID NO: 11374)

C5-2033    21 nt Target:  5'-AGAUGACUCCCAAGAAAAUGA-3'    (SEQ ID NO: 11375)

C5-2034    21 nt Target:  5'-GAUGACUCCCAAGAAAAUGAU-3'    (SEQ ID NO: 11376)

C5-2035    21 nt Target:  5'-AUGACUCCCAAGAAAAUGAUG-3'    (SEQ ID NO: 11377)

C5-2036    21 nt Target:  5'-UGACUCCCAAGAAAAUGAUGA-3'    (SEQ ID NO: 11378)

C5-2037    21 nt Target:  5'-GACUCCCAAGAAAAUGAUGAA-3'    (SEQ ID NO: 11379)

C5-2038    21 nt Target:  5'-ACUCCCAAGAAAAUGAUGAAC-3'    (SEQ ID NO: 11380)

C5-2039    21 nt Target:  5'-CUCCCAAGAAAAUGAUGAACC-3'    (SEQ ID NO: 11381)

C5-2040    21 nt Target:  5'-UCCCAAGAAAAUGAUGAACCU-3'    (SEQ ID NO: 11382)

C5-2041    21 nt Target:  5'-CCCAAGAAAAUGAUGAACCUU-3'    (SEQ ID NO: 11383)

C5-2042    21 nt Target:  5'-CCAAGAAAAUGAUGAACCUUG-3'    (SEQ ID NO: 11384)

C5-2044    21 nt Target:  5'-AAGAAAAUGAUGAACCUUGUA-3'    (SEQ ID NO: 11385)

C5-2045    21 nt Target:  5'-AGAAAAUGAUGAACCUUGUAA-3'    (SEQ ID NO: 11386)

C5-2046    21 nt Target:  5'-GAAAAUGAUGAACCUUGUAAA-3'    (SEQ ID NO: 11387)

C5-2047    21 nt Target:  5'-AAAAUGAUGAACCUUGUAAAG-3'    (SEQ ID NO: 11388)

C5-2049    21 nt Target:  5'-AAUGAUGAACCUUGUAAAGAA-3'    (SEQ ID NO: 11389)

C5-2052    21 nt Target:  5'-GAUGAACCUUGUAAAGAAAUU-3'    (SEQ ID NO: 11390)

C5-2096    21 nt Target:  5'-AAAGAAGAUAGAAGAAAUAGC-3'    (SEQ ID NO: 11391)

C5-2097    21 nt Target:  5'-AAGAAGAUAGAAGAAAUAGCU-3'    (SEQ ID NO: 11392)

C5-2098    21 nt Target:  5'-AGAAGAUAGAAGAAAUAGCUG-3'    (SEQ ID NO: 11393)

C5-2099    21 nt Target:  5'-GAAGAUAGAAGAAAUAGCUGC-3'    (SEQ ID NO: 11394)

C5-2100    21 nt Target:  5'-AAGAUAGAAGAAAUAGCUGCU-3'    (SEQ ID NO: 11395)

C5-2101    21 nt Target:  5'-AGAUAGAAGAAAUAGCUGCUA-3'    (SEQ ID NO: 11396)

C5-2102    21 nt Target:  5'-GAUAGAAGAAAUAGCUGCUAA-3'    (SEQ ID NO: 11397)

C5-2103    21 nt Target:  5'-AUAGAAGAAAUAGCUGCUAAA-3'    (SEQ ID NO: 11398)

TABLE 8-continued

DsiRNA Target Sequences (21 mers) of Human Anti-C5
DsiRNAs Predicted to have > 50% Knockdown Efficacy

| | | |
|---|---|---|
| C5-2104 | 21 nt Target: 5'-UAGAAGAAAUAGCUGCUAAAU-3' | (SEQ ID NO: 11399) |
| C5-2105 | 21 nt Target: 5'-AGAAGAAAUAGCUGCUAAAUA-3' | (SEQ ID NO: 11400) |
| C5-2106 | 21 nt Target: 5'-GAAGAAAUAGCUGCUAAAUAU-3' | (SEQ ID NO: 11401) |
| C5-2107 | 21 nt Target: 5'-AAGAAAUAGCUGCUAAAUAUA-3' | (SEQ ID NO: 11402) |
| C5-2108 | 21 nt Target: 5'-AGAAAUAGCUGCUAAAUAUAA-3' | (SEQ ID NO: 11403) |
| C5-2109 | 21 nt Target: 5'-GAAAUAGCUGCUAAAUAUAAA-3' | (SEQ ID NO: 11404) |
| C5-2110 | 21 nt Target: 5'-AAAUAGCUGCUAAAUAUAAAC-3' | (SEQ ID NO: 11405) |
| C5-2111 | 21 nt Target: 5'-AAUAGCUGCUAAAUAUAAACA-3' | (SEQ ID NO: 11406) |
| C5-2112 | 21 nt Target: 5'-AUAGCUGCUAAAUAUAAACAU-3' | (SEQ ID NO: 11407) |
| C5-2113 | 21 nt Target: 5'-UAGCUGCUAAAUAUAAACAUU-3' | (SEQ ID NO: 11408) |
| C5-2135 | 21 nt Target: 5'-AGUAGUGAAGAAAUGUUGUUA-3' | (SEQ ID NO: 11409) |
| C5-2136 | 21 nt Target: 5'-GUAGUGAAGAAAUGUUGUUAC-3' | (SEQ ID NO: 11410) |
| C5-2137 | 21 nt Target: 5'-UAGUGAAGAAAUGUUGUUACG-3' | (SEQ ID NO: 11411) |
| C5-2138 | 21 nt Target: 5'-AGUGAAGAAAUGUUGUUACGA-3' | (SEQ ID NO: 11412) |
| C5-2139 | 21 nt Target: 5'-GUGAAGAAAUGUUGUUACGAU-3' | (SEQ ID NO: 11413) |
| C5-2140 | 21 nt Target: 5'-UGAAGAAAUGUUGUUACGAUG-3' | (SEQ ID NO: 11414) |
| C5-2141 | 21 nt Target: 5'-GAAGAAAUGUUGUUACGAUGG-3' | (SEQ ID NO: 11415) |
| C5-2142 | 21 nt Target: 5'-AAGAAAUGUUGUUACGAUGGA-3' | (SEQ ID NO: 11416) |
| C5-2143 | 21 nt Target: 5'-AGAAAUGUUGUUACGAUGGAG-3' | (SEQ ID NO: 11417) |
| C5-2174 | 21 nt Target: 5'-UAAUGAUGAAACCUGUGAGCA-3' | (SEQ ID NO: 11418) |
| C5-2175 | 21 nt Target: 5'-AAUGAUGAAACCUGUGAGCAG-3' | (SEQ ID NO: 11419) |
| C5-2176 | 21 nt Target: 5'-AUGAUGAAACCUGUGAGCAGC-3' | (SEQ ID NO: 11420) |
| C5-2177 | 21 nt Target: 5'-UGAUGAAACCUGUGAGCAGCG-3' | (SEQ ID NO: 11421) |
| C5-2178 | 21 nt Target: 5'-GAUGAAACCUGUGAGCAGCGA-3' | (SEQ ID NO: 11422) |
| C5-2179 | 21 nt Target: 5'-AUGAAACCUGUGAGCAGCGAG-3' | (SEQ ID NO: 11423) |
| C5-2180 | 21 nt Target: 5'-UGAAACCUGUGAGCAGCGAGC-3' | (SEQ ID NO: 11424) |
| C5-2183 | 21 nt Target: 5'-AACCUGUGAGCAGCGAGCUGC-3' | (SEQ ID NO: 11425) |
| C5-2184 | 21 nt Target: 5'-ACCUGUGAGCAGCGAGCUGCA-3' | (SEQ ID NO: 11426) |
| C5-2185 | 21 nt Target: 5'-CCUGUGAGCAGCGAGCUGCAC-3' | (SEQ ID NO: 11427) |
| C5-2186 | 21 nt Target: 5'-CUGUGAGCAGCGAGCUGCACG-3' | (SEQ ID NO: 11428) |
| C5-2187 | 21 nt Target: 5'-UGUGAGCAGCGAGCUGCACGG-3' | (SEQ ID NO: 11429) |
| C5-2188 | 21 nt Target: 5'-GUGAGCAGCGAGCUGCACGGA-3' | (SEQ ID NO: 11430) |
| C5-2189 | 21 nt Target: 5'-UGAGCAGCGAGCUGCACGGAU-3' | (SEQ ID NO: 11431) |
| C5-2190 | 21 nt Target: 5'-GAGCAGCGAGCUGCACGGAUU-3' | (SEQ ID NO: 11432) |
| C5-2191 | 21 nt Target: 5'-AGCAGCGAGCUGCACGGAUUA-3' | (SEQ ID NO: 11433) |
| C5-2192 | 21 nt Target: 5'-GCAGCGAGCUGCACGGAUUAG-3' | (SEQ ID NO: 11434) |
| C5-2193 | 21 nt Target: 5'-CAGCGAGCUGCACGGAUUAGU-3' | (SEQ ID NO: 11435) |
| C5-2251 | 21 nt Target: 5'-GUGUCGUCGCAAGCCAGCUCC-3' | (SEQ ID NO: 11436) |
| C5-2252 | 21 nt Target: 5'-UGUCGUCGCAAGCCAGCUCCG-3' | (SEQ ID NO: 11437) |

TABLE 8-continued

| DsiRNA Target Sequences (21 mers) of Human Anti-C5 DsiRNAs Predicted to have > 50% Knockdown Efficacy | | |
|---|---|---|
| C5-2253 | 21 nt Target: 5'-GUCGUCGCAAGCCAGCUCCGU-3' | (SEQ ID NO: 11438) |
| C5-2254 | 21 nt Target: 5'-UCGUCGCAAGCCAGCUCCGUG-3' | (SEQ ID NO: 11439) |
| C5-2255 | 21 nt Target: 5'-CGUCGCAAGCCAGCUCCGUGC-3' | (SEQ ID NO: 11440) |
| C5-2256 | 21 nt Target: 5'-GUCGCAAGCCAGCUCCGUGCU-3' | (SEQ ID NO: 11441) |
| C5-2257 | 21 nt Target: 5'-UCGCAAGCCAGCUCCGUGCUA-3' | (SEQ ID NO: 11442) |
| C5-2258 | 21 nt Target: 5'-CGCAAGCCAGCUCCGUGCUAA-3' | (SEQ ID NO: 11443) |
| C5-2259 | 21 nt Target: 5'-GCAAGCCAGCUCCGUGCUAAU-3' | (SEQ ID NO: 11444) |
| C5-2260 | 21 nt Target: 5'-CAAGCCAGCUCCGUGCUAAUA-3' | (SEQ ID NO: 11445) |
| C5-2313 | 21 nt Target: 5'-CACAUGAAGACCCUGUUACCA-3' | (SEQ ID NO: 11446) |
| C5-2314 | 21 nt Target: 5'-ACAUGAAGACCCUGUUACCAG-3' | (SEQ ID NO: 11447) |
| C5-2315 | 21 nt Target: 5'-CAUGAAGACCCUGUUACCAGU-3' | (SEQ ID NO: 11448) |
| C5-2317 | 21 nt Target: 5'-UGAAGACCCUGUUACCAGUAA-3' | (SEQ ID NO: 11449) |
| C5-2318 | 21 nt Target: 5'-GAAGACCCUGUUACCAGUAAG-3' | (SEQ ID NO: 11450) |
| C5-2319 | 21 nt Target: 5'-AAGACCCUGUUACCAGUAAGC-3' | (SEQ ID NO: 11451) |
| C5-2320 | 21 nt Target: 5'-AGACCCUGUUACCAGUAAGCA-3' | (SEQ ID NO: 11452) |
| C5-2321 | 21 nt Target: 5'-GACCCUGUUACCAGUAAGCAA-3' | (SEQ ID NO: 11453) |
| C5-2322 | 21 nt Target: 5'-ACCCUGUUACCAGUAAGCAAG-3' | (SEQ ID NO: 11454) |
| C5-2323 | 21 nt Target: 5'-CCCUGUUACCAGUAAGCAAGC-3' | (SEQ ID NO: 11455) |
| C5-2324 | 21 nt Target: 5'-CCUGUUACCAGUAAGCAAGCC-3' | (SEQ ID NO: 11456) |
| C5-2325 | 21 nt Target: 5'-CUGUUACCAGUAAGCAAGCCA-3' | (SEQ ID NO: 11457) |
| C5-2326 | 21 nt Target: 5'-UGUUACCAGUAAGCAAGCCAG-3' | (SEQ ID NO: 11458) |
| C5-2327 | 21 nt Target: 5'-GUUACCAGUAAGCAAGCCAGA-3' | (SEQ ID NO: 11459) |
| C5-2328 | 21 nt Target: 5'-UUACCAGUAAGCAAGCCAGAA-3' | (SEQ ID NO: 11460) |
| C5-2329 | 21 nt Target: 5'-UACCAGUAAGCAAGCCAGAAA-3' | (SEQ ID NO: 11461) |
| C5-2330 | 21 nt Target: 5'-ACCAGUAAGCAAGCCAGAAAU-3' | (SEQ ID NO: 11462) |
| C5-2331 | 21 nt Target: 5'-CCAGUAAGCAAGCCAGAAAUU-3' | (SEQ ID NO: 11463) |
| C5-2332 | 21 nt Target: 5'-CAGUAAGCAAGCCAGAAAUUC-3' | (SEQ ID NO: 11464) |
| C5-2333 | 21 nt Target: 5'-AGUAAGCAAGCCAGAAAUUCG-3' | (SEQ ID NO: 11465) |
| C5-2334 | 21 nt Target: 5'-GUAAGCAAGCCAGAAAUUCGG-3' | (SEQ ID NO: 11466) |
| C5-2335 | 21 nt Target: 5'-UAAGCAAGCCAGAAAUUCGGA-3' | (SEQ ID NO: 11467) |
| C5-2336 | 21 nt Target: 5'-AAGCAAGCCAGAAAUUCGGAG-3' | (SEQ ID NO: 11468) |
| C5-2338 | 21 nt Target: 5'-GCAAGCCAGAAAUUCGGAGUU-3' | (SEQ ID NO: 11469) |
| C5-2339 | 21 nt Target: 5'-CAAGCCAGAAAUUCGGAGUUA-3' | (SEQ ID NO: 11470) |
| C5-2340 | 21 nt Target: 5'-AAGCCAGAAAUUCGGAGUUAU-3' | (SEQ ID NO: 11471) |
| C5-2341 | 21 nt Target: 5'-AGCCAGAAAUUCGGAGUUAUU-3' | (SEQ ID NO: 11472) |
| C5-2342 | 21 nt Target: 5'-GCCAGAAAUUCGGAGUUAUUU-3' | (SEQ ID NO: 11473) |
| C5-2343 | 21 nt Target: 5'-CCAGAAAUUCGGAGUUAUUUU-3' | (SEQ ID NO: 11474) |
| C5-2344 | 21 nt Target: 5'-CAGAAAUUCGGAGUUAUUUUC-3' | (SEQ ID NO: 11475) |

TABLE 8-continued

DsiRNA Target Sequences (21 mers) of Human Anti-C5
DsiRNAs Predicted to have > 50% Knockdown Efficacy

| | | |
|---|---|---|
| C5-2345 | 21 nt Target: 5'-AGAAAUUCGGAGUUAUUUUCC-3' | (SEQ ID NO: 11476) |
| C5-2346 | 21 nt Target: 5'-GAAAUUCGGAGUUAUUUUCCA-3' | (SEQ ID NO: 11477) |
| C5-2347 | 21 nt Target: 5'-AAAUUCGGAGUUAUUUUCCAG-3' | (SEQ ID NO: 11478) |
| C5-2348 | 21 nt Target: 5'-AAUUCGGAGUUAUUUUCCAGA-3' | (SEQ ID NO: 11479) |
| C5-2349 | 21 nt Target: 5'-AUUCGGAGUUAUUUUCCAGAA-3' | (SEQ ID NO: 11480) |
| C5-2350 | 21 nt Target: 5'-UUCGGAGUUAUUUUCCAGAAA-3' | (SEQ ID NO: 11481) |
| C5-2351 | 21 nt Target: 5'-UCGGAGUUAUUUUCCAGAAAG-3' | (SEQ ID NO: 11482) |
| C5-2352 | 21 nt Target: 5'-CGGAGUUAUUUUCCAGAAAGC-3' | (SEQ ID NO: 11483) |
| C5-2353 | 21 nt Target: 5'-GGAGUUAUUUUCCAGAAAGCU-3' | (SEQ ID NO: 11484) |
| C5-2354 | 21 nt Target: 5'-GAGUUAUUUUCCAGAAAGCUG-3' | (SEQ ID NO: 11485) |
| C5-2355 | 21 nt Target: 5'-AGUUAUUUUCCAGAAAGCUGG-3' | (SEQ ID NO: 11486) |
| C5-2356 | 21 nt Target: 5'-GUUAUUUUCCAGAAAGCUGGU-3' | (SEQ ID NO: 11487) |
| C5-2357 | 21 nt Target: 5'-UUAUUUUCCAGAAAGCUGGUU-3' | (SEQ ID NO: 11488) |
| C5-2377 | 21 nt Target: 5'-UGUGGGAAGUUCAUCUUGUUC-3' | (SEQ ID NO: 11489) |
| C5-2378 | 21 nt Target: 5'-GUGGGAAGUUCAUCUUGUUCC-3' | (SEQ ID NO: 11490) |
| C5-2379 | 21 nt Target: 5'-UGGGAAGUUCAUCUUGUUCCC-3' | (SEQ ID NO: 11491) |
| C5-2380 | 21 nt Target: 5'-GGGAAGUUCAUCUUGUUCCCA-3' | (SEQ ID NO: 11492) |
| C5-2381 | 21 nt Target: 5'-GGAAGUUCAUCUUGUUCCCAG-3' | (SEQ ID NO: 11493) |
| C5-2382 | 21 nt Target: 5'-GAAGUUCAUCUUGUUCCCAGA-3' | (SEQ ID NO: 11494) |
| C5-2383 | 21 nt Target: 5'-AAGUUCAUCUUGUUCCCAGAA-3' | (SEQ ID NO: 11495) |
| C5-2384 | 21 nt Target: 5'-AGUUCAUCUUGUUCCCAGAAG-3' | (SEQ ID NO: 11496) |
| C5-2385 | 21 nt Target: 5'-GUUCAUCUUGUUCCCAGAAGA-3' | (SEQ ID NO: 11497) |
| C5-2386 | 21 nt Target: 5'-UUCAUCUUGUUCCCAGAAGAA-3' | (SEQ ID NO: 11498) |
| C5-2387 | 21 nt Target: 5'-UCAUCUUGUUCCCAGAAGAAA-3' | (SEQ ID NO: 11499) |
| C5-2388 | 21 nt Target: 5'-CAUCUUGUUCCCAGAAGAAAA-3' | (SEQ ID NO: 11500) |
| C5-2389 | 21 nt Target: 5'-AUCUUGUUCCCAGAAGAAAAC-3' | (SEQ ID NO: 11501) |
| C5-2390 | 21 nt Target: 5'-UCUUGUUCCCAGAAGAAAACA-3' | (SEQ ID NO: 11502) |
| C5-2391 | 21 nt Target: 5'-CUUGUUCCCAGAAGAAAACAG-3' | (SEQ ID NO: 11503) |
| C5-2392 | 21 nt Target: 5'-UUGUUCCCAGAAGAAAACAGU-3' | (SEQ ID NO: 11504) |
| C5-2393 | 21 nt Target: 5'-UGUUCCCAGAAGAAAACAGUU-3' | (SEQ ID NO: 11505) |
| C5-2394 | 21 nt Target: 5'-GUUCCCAGAAGAAAACAGUUG-3' | (SEQ ID NO: 11506) |
| C5-2395 | 21 nt Target: 5'-UUCCCAGAAGAAAACAGUUGC-3' | (SEQ ID NO: 11507) |
| C5-2396 | 21 nt Target: 5'-UCCCAGAAGAAAACAGUUGCA-3' | (SEQ ID NO: 11508) |
| C5-2397 | 21 nt Target: 5'-CCCAGAAGAAAACAGUUGCAG-3' | (SEQ ID NO: 11509) |
| C5-2398 | 21 nt Target: 5'-CCAGAAGAAAACAGUUGCAGU-3' | (SEQ ID NO: 11510) |
| C5-2399 | 21 nt Target: 5'-CAGAAGAAAACAGUUGCAGUU-3' | (SEQ ID NO: 11511) |
| C5-2400 | 21 nt Target: 5'-AGAAGAAAACAGUUGCAGUUU-3' | (SEQ ID NO: 11512) |
| C5-2401 | 21 nt Target: 5'-GAAGAAAACAGUUGCAGUUUG-3' | (SEQ ID NO: 11513) |
| C5-2402 | 21 nt Target: 5'-AAGAAAACAGUUGCAGUUUGC-3' | (SEQ ID NO: 11514) |

TABLE 8-continued

DsiRNA Target Sequences (21 mers) of Human Anti-C5
DsiRNAs Predicted to have > 50% Knockdown Efficac TABLE 8-continued DsiRNA Target Sequences (21 mers) of Human Anti-C5
DsiRNAs Predicted to have > 50% Knockdown Efficacy

| | | |
|---|---|---|
| C5-2539 | 21 nt Target: 5'-AUAUACCAUAUUCUGUUGUAC-3' | (SEQ ID NO: 11553) |
| C5-2540 | 21 nt Target: 5'-UAUACCAUAUUCUGUUGUACG-3' | (SEQ ID NO: 11554) |
| C5-2541 | 21 nt Target: 5'-AUACCAUAUUCUGUUGUACGA-3' | (SEQ ID NO: 11555) |
| C5-2542 | 21 nt Target: 5'-UACCAUAUUCUGUUGUACGAG-3' | (SEQ ID NO: 11556) |
| C5-2543 | 21 nt Target: 5'-ACCAUAUUCUGUUGUACGAGG-3' | (SEQ ID NO: 11557) |
| C5-2544 | 21 nt Target: 5'-CCAUAUUCUGUUGUACGAGGA-3' | (SEQ ID NO: 11558) |
| C5-2545 | 21 nt Target: 5'-CAUAUUCUGUUGUACGAGGAG-3' | (SEQ ID NO: 11559) |
| C5-2546 | 21 nt Target: 5'-AUAUUCUGUUGUACGAGGAGA-3' | (SEQ ID NO: 11560) |
| C5-2547 | 21 nt Target: 5'-UAUUCUGUUGUACGAGGAGAA-3' | (SEQ ID NO: 11561) |
| C5-2548 | 21 nt Target: 5'-AUUCUGUUGUACGAGGAGAAC-3' | (SEQ ID NO: 11562) |
| C5-2549 | 21 nt Target: 5'-UUCUGUUGUACGAGGAGAACA-3' | (SEQ ID NO: 11563) |
| C5-2550 | 21 nt Target: 5'-UCUGUUGUACGAGGAGAACAG-3' | (SEQ ID NO: 11564) |
| C5-2582 | 21 nt Target: 5'-AGGAACUGUUUACAACUAUAG-3' | (SEQ ID NO: 11565) |
| C5-2583 | 21 nt Target: 5'-GGAACUGUUUACAACUAUAGG-3' | (SEQ ID NO: 11566) |
| C5-2584 | 21 nt Target: 5'-GAACUGUUUACAACUAUAGGA-3' | (SEQ ID NO: 11567) |
| C5-2585 | 21 nt Target: 5'-AACUGUUUACAACUAUAGGAC-3' | (SEQ ID NO: 11568) |
| C5-2586 | 21 nt Target: 5'-ACUGUUUACAACUAUAGGACU-3' | (SEQ ID NO: 11569) |
| C5-2587 | 21 nt Target: 5'-CUGUUUACAACUAUAGGACUU-3' | (SEQ ID NO: 11570) |
| C5-2588 | 21 nt Target: 5'-UGUUUACAACUAUAGGACUUC-3' | (SEQ ID NO: 11571) |
| C5-2589 | 21 nt Target: 5'-GUUUACAACUAUAGGACUUCU-3' | (SEQ ID NO: 11572) |
| C5-2590 | 21 nt Target: 5'-UUUACAACUAUAGGACUUCUG-3' | (SEQ ID NO: 11573) |
| C5-2591 | 21 nt Target: 5'-UUACAACUAUAGGACUUCUGG-3' | (SEQ ID NO: 11574) |
| C5-2592 | 21 nt Target: 5'-UACAACUAUAGGACUUCUGGG-3' | (SEQ ID NO: 11575) |
| C5-2593 | 21 nt Target: 5'-ACAACUAUAGGACUUCUGGGA-3' | (SEQ ID NO: 11576) |
| C5-2594 | 21 nt Target: 5'-CAACUAUAGGACUUCUGGGAU-3' | (SEQ ID NO: 11577) |
| C5-2595 | 21 nt Target: 5'-AACUAUAGGACUUCUGGGAUG-3' | (SEQ ID NO: 11578) |
| C5-2596 | 21 nt Target: 5'-ACUAUAGGACUUCUGGGAUGC-3' | (SEQ ID NO: 11579) |
| C5-2597 | 21 nt Target: 5'-CUAUAGGACUUCUGGGAUGCA-3' | (SEQ ID NO: 11580) |
| C5-2598 | 21 nt Target: 5'-UAUAGGACUUCUGGGAUGCAG-3' | (SEQ ID NO: 11581) |
| C5-2599 | 21 nt Target: 5'-AUAGGACUUCUGGGAUGCAGU-3' | (SEQ ID NO: 11582) |
| C5-2628 | 21 nt Target: 5'-AAAAUGUCUGCUGUGGAGGGA-3' | (SEQ ID NO: 11583) |
| C5-2629 | 21 nt Target: 5'-AAAUGUCUGCUGUGGAGGGAA-3' | (SEQ ID NO: 11584) |
| C5-2630 | 21 nt Target: 5'-AAUGUCUGCUGUGGAGGGAAU-3' | (SEQ ID NO: 11585) |
| C5-2631 | 21 nt Target: 5'-AUGUCUGCUGUGGAGGGAAUC-3' | (SEQ ID NO: 11586) |
| C5-2632 | 21 nt Target: 5'-UGUCUGCUGUGGAGGGAAUCU-3' | (SEQ ID NO: 11587) |
| C5-2633 | 21 nt Target: 5'-GUCUGCUGUGGAGGGAAUCUG-3' | (SEQ ID NO: 11588) |
| C5-2634 | 21 nt Target: 5'-UCUGCUGUGGAGGGAAUCUGC-3' | (SEQ ID NO: 11589) |
| C5-2635 | 21 nt Target: 5'-CUGCUGUGGAGGGAAUCUGCA-3' | (SEQ ID NO: 11590) |
| C5-2636 | 21 nt Target: 5'-UGCUGUGGAGGGAAUCUGCAC-3' | (SEQ ID NO: 11591) |

TABLE 8-continued

DsiRNA Target Sequences (21 mers) of Human Anti-C5
DsiRNAs Predicted to have > 50% Knockdown Efficacy

```
C5-2637    21 nt Target:  5'-GCUGUGGAGGGAAUCUGCACU-3'   (SEQ ID NO: 11592)

C5-2638    21 nt Target:  5'-CUGUGGAGGGAAUCUGCACUU-3'   (SEQ ID NO: 11593)

C5-2639    21 nt Target:  5'-UGUGGAGGGAAUCUGCACUUC-3'   (SEQ ID NO: 11594)

C5-2659    21 nt Target:  5'-CGGAAAGCCCAGUCAUUGAUC-3'   (SEQ ID NO: 11595)

C5-2660    21 nt Target:  5'-GGAAAGCCCAGUCAUUGAUCA-3'   (SEQ ID NO: 11596)

C5-2661    21 nt Target:  5'-GAAAGCCCAGUCAUUGAUCAU-3'   (SEQ ID NO: 11597)

C5-2662    21 nt Target:  5'-AAAGCCCAGUCAUUGAUCAUC-3'   (SEQ ID NO: 11598)

C5-2663    21 nt Target:  5'-AAGCCCAGUCAUUGAUCAUCA-3'   (SEQ ID NO: 11599)

C5-2664    21 nt Target:  5'-AGCCCAGUCAUUGAUCAUCAG-3'   (SEQ ID NO: 11600)

C5-2665    21 nt Target:  5'-GCCCAGUCAUUGAUCAUCAGG-3'   (SEQ ID NO: 11601)

C5-2666    21 nt Target:  5'-CCCAGUCAUUGAUCAUCAGGG-3'   (SEQ ID NO: 11602)

C5-2667    21 nt Target:  5'-CCAGUCAUUGAUCAUCAGGGC-3'   (SEQ ID NO: 11603)

C5-2668    21 nt Target:  5'-CAGUCAUUGAUCAUCAGGGCA-3'   (SEQ ID NO: 11604)

C5-2669    21 nt Target:  5'-AGUCAUUGAUCAUCAGGGCAC-3'   (SEQ ID NO: 11605)

C5-2670    21 nt Target:  5'-GUCAUUGAUCAUCAGGGCACA-3'   (SEQ ID NO: 11606)

C5-2671    21 nt Target:  5'-UCAUUGAUCAUCAGGGCACAA-3'   (SEQ ID NO: 11607)

C5-2672    21 nt Target:  5'-CAUUGAUCAUCAGGGCACAAA-3'   (SEQ ID NO: 11608)

C5-2673    21 nt Target:  5'-AUUGAUCAUCAGGGCACAAAG-3'   (SEQ ID NO: 11609)

C5-2674    21 nt Target:  5'-UUGAUCAUCAGGGCACAAAGU-3'   (SEQ ID NO: 11610)

C5-2675    21 nt Target:  5'-UGAUCAUCAGGGCACAAAGUC-3'   (SEQ ID NO: 11611)

C5-2676    21 nt Target:  5'-GAUCAUCAGGGCACAAAGUCC-3'   (SEQ ID NO: 11612)

C5-2677    21 nt Target:  5'-AUCAUCAGGGCACAAAGUCCU-3'   (SEQ ID NO: 11613)

C5-2678    21 nt Target:  5'-UCAUCAGGGCACAAAGUCCUC-3'   (SEQ ID NO: 11614)

C5-2679    21 nt Target:  5'-CAUCAGGGCACAAAGUCCUCC-3'   (SEQ ID NO: 11615)

C5-2680    21 nt Target:  5'-AUCAGGGCACAAAGUCCUCCA-3'   (SEQ ID NO: 11616)

C5-2711    21 nt Target:  5'-CCAGAAAGUAGAGGGCUCCUC-3'   (SEQ ID NO: 11617)

C5-2749    21 nt Target:  5'-UCACUGUGCUUCCUCUGGAAA-3'   (SEQ ID NO: 11618)

C5-2750    21 nt Target:  5'-CACUGUGCUUCCUCUGGAAAU-3'   (SEQ ID NO: 11619)

C5-2751    21 nt Target:  5'-ACUGUGCUUCCUCUGGAAAUU-3'   (SEQ ID NO: 11620)

C5-2752    21 nt Target:  5'-CUGUGCUUCCUCUGGAAAUUG-3'   (SEQ ID NO: 11621)

C5-2805    21 nt Target:  5'-UGGUUUGGAAAAGAAAUCUUA-3'   (SEQ ID NO: 11622)

C5-2806    21 nt Target:  5'-GGUUUGGAAAAGAAAUCUUAG-3'   (SEQ ID NO: 11623)

C5-2807    21 nt Target:  5'-GUUUGGAAAAGAAAUCUUAGU-3'   (SEQ ID NO: 11624)

C5-2808    21 nt Target:  5'-UUUGGAAAAGAAAUCUUAGUA-3'   (SEQ ID NO: 11625)

C5-2809    21 nt Target:  5'-UUGGAAAAGAAAUCUUAGUAA-3'   (SEQ ID NO: 11626)

C5-2810    21 nt Target:  5'-UGGAAAAGAAAUCUUAGUAAA-3'   (SEQ ID NO: 11627)

C5-2811    21 nt Target:  5'-GGAAAAGAAAUCUUAGUAAAA-3'   (SEQ ID NO: 11628)

C5-2833    21 nt Target:  5'-CAUUACGAGUGGUGCCAGAAG-3'   (SEQ ID NO: 11629)
```

TABLE 8-continued

DsiRNA Target Sequences (21 mers) of Human Anti-C5
DsiRNAs Predicted to have > 50% Knockdown Efficacy

| | | |
|---|---|---|
| C5-2834 | 21 nt Target: 5'-AUUACGAGUGGUGCCAGAAGG-3' | (SEQ ID NO: 11630) |
| C5-2835 | 21 nt Target: 5'-UUACGAGUGGUGCCAGAAGGU-3' | (SEQ ID NO: 11631) |
| C5-2836 | 21 nt Target: 5'-UACGAGUGGUGCCAGAAGGUG-3' | (SEQ ID NO: 11632) |
| C5-2837 | 21 nt Target: 5'-ACGAGUGGUGCCAGAAGGUGU-3' | (SEQ ID NO: 11633) |
| C5-2838 | 21 nt Target: 5'-CGAGUGGUGCCAGAAGGUGUC-3' | (SEQ ID NO: 11634) |
| C5-2839 | 21 nt Target: 5'-GAGUGGUGCCAGAAGGUGUCA-3' | (SEQ ID NO: 11635) |
| C5-2840 | 21 nt Target: 5'-AGUGGUGCCAGAAGGUGUCAA-3' | (SEQ ID NO: 11636) |
| C5-2841 | 21 nt Target: 5'-GUGGUGCCAGAAGGUGUCAAA-3' | (SEQ ID NO: 11637) |
| C5-2842 | 21 nt Target: 5'-UGGUGCCAGAAGGUGUCAAAA-3' | (SEQ ID NO: 11638) |
| C5-2843 | 21 nt Target: 5'-GGUGCCAGAAGGUGUCAAAAG-3' | (SEQ ID NO: 11639) |
| C5-2844 | 21 nt Target: 5'-GUGCCAGAAGGUGUCAAAAGG-3' | (SEQ ID NO: 11640) |
| C5-2845 | 21 nt Target: 5'-UGCCAGAAGGUGUCAAAAGGG-3' | (SEQ ID NO: 11641) |
| C5-2846 | 21 nt Target: 5'-GCCAGAAGGUGUCAAAAGGGA-3' | (SEQ ID NO: 11642) |
| C5-2847 | 21 nt Target: 5'-CCAGAAGGUGUCAAAAGGGAA-3' | (SEQ ID NO: 11643) |
| C5-2848 | 21 nt Target: 5'-CAGAAGGUGUCAAAAGGGAAA-3' | (SEQ ID NO: 11644) |
| C5-2849 | 21 nt Target: 5'-AGAAGGUGUCAAAAGGGAAAG-3' | (SEQ ID NO: 11645) |
| C5-2850 | 21 nt Target: 5'-GAAGGUGUCAAAAGGGAAAGC-3' | (SEQ ID NO: 11646) |
| C5-2851 | 21 nt Target: 5'-AAGGUGUCAAAAGGGAAAGCU-3' | (SEQ ID NO: 11647) |
| C5-2852 | 21 nt Target: 5'-AGGUGUCAAAAGGGAAAGCUA-3' | (SEQ ID NO: 11648) |
| C5-2853 | 21 nt Target: 5'-GGUGUCAAAAGGGAAAGCUAU-3' | (SEQ ID NO: 11649) |
| C5-2854 | 21 nt Target: 5'-GUGUCAAAAGGGAAAGCUAUU-3' | (SEQ ID NO: 11650) |
| C5-2855 | 21 nt Target: 5'-UGUCAAAAGGGAAAGCUAUUC-3' | (SEQ ID NO: 11651) |
| C5-2856 | 21 nt Target: 5'-GUCAAAAGGGAAAGCUAUUCU-3' | (SEQ ID NO: 11652) |
| C5-2857 | 21 nt Target: 5'-UCAAAAGGGAAAGCUAUUCUG-3' | (SEQ ID NO: 11653) |
| C5-2858 | 21 nt Target: 5'-CAAAAGGGAAAGCUAUUCUGG-3' | (SEQ ID NO: 11654) |
| C5-2859 | 21 nt Target: 5'-AAAAGGGAAAGCUAUUCUGGU-3' | (SEQ ID NO: 11655) |
| C5-2879 | 21 nt Target: 5'-UGUUACUUUGGAUCCUAGGGG-3' | (SEQ ID NO: 11656) |
| C5-2880 | 21 nt Target: 5'-GUUACUUUGGAUCCUAGGGGU-3' | (SEQ ID NO: 11657) |
| C5-2881 | 21 nt Target: 5'-UUACUUUGGAUCCUAGGGGUA-3' | (SEQ ID NO: 11658) |
| C5-2882 | 21 nt Target: 5'-UACUUUGGAUCCUAGGGGUAU-3' | (SEQ ID NO: 11659) |
| C5-2883 | 21 nt Target: 5'-ACUUUGGAUCCUAGGGGUAUU-3' | (SEQ ID NO: 11660) |
| C5-2884 | 21 nt Target: 5'-CUUUGGAUCCUAGGGGUAUUU-3' | (SEQ ID NO: 11661) |
| C5-2885 | 21 nt Target: 5'-UUUGGAUCCUAGGGGUAUUUA-3' | (SEQ ID NO: 11662) |
| C5-2886 | 21 nt Target: 5'-UUGGAUCCUAGGGGUAUUUAU-3' | (SEQ ID NO: 11663) |
| C5-2887 | 21 nt Target: 5'-UGGAUCCUAGGGGUAUUUAUG-3' | (SEQ ID NO: 11664) |
| C5-2920 | 21 nt Target: 5'-GACGAAAGGAGUUCCCAUACA-3' | (SEQ ID NO: 11665) |
| C5-2921 | 21 nt Target: 5'-ACGAAAGGAGUUCCCAUACAG-3' | (SEQ ID NO: 11666) |
| C5-2922 | 21 nt Target: 5'-CGAAAGGAGUUCCCAUACAGG-3' | (SEQ ID NO: 11667) |
| C5-2923 | 21 nt Target: 5'-GAAAGGAGUUCCCAUACAGGA-3' | (SEQ ID NO: 11668) |

TABLE 8-continued

DsiRNA Target Sequences (21 mers) of Human Anti-C5
DsiRNAs Predicted to have > 50% Kn TABLE 8-continued

| DsiRNA Target Sequences (21 mers) of Human Anti-C5 DsiRNAs Predicted to have > 50% Knockdown Efficacy |
|---|
| C5-2984 21 nt Target: 5'-UUUGAGUGUAAAAGGACUGCU-3' (SEQ ID NO: 11707) |
| C5-2985 21 nt Target: 5'-UUGAGUGUAAAAGGACUGCUU-3' (SEQ ID NO: 11708) |
| C5-2986 21 nt Target: 5'-UGAGUGUAAAAGGACUGCUUG-3' (SEQ ID NO: 11709) |
| C5-2987 21 nt Target: 5'-GAGUGUAAAAGGACUGCUUGU-3' (SEQ ID NO: 11710) |
| C5-2988 21 nt Target: 5'-AGUGUAAAAGGACUGCUUGUA-3' (SEQ ID NO: 11711) |
| C5-2989 21 nt Target: 5'-GUGUAAAAGGACUGCUUGUAG-3' (SEQ ID NO: 11712) |
| C5-2990 21 nt Target: 5'-UGUAAAAGGACUGCUUGUAGG-3' (SEQ ID NO: 11713) |
| C5-2991 21 nt Target: 5'-GUAAAAGGACUGCUUGUAGGU-3' (SEQ ID NO: 11714) |
| C5-2992 21 nt Target: 5'-UAAAAGGACUGCUUGUAGGUG-3' (SEQ ID NO: 11715) |
| C5-2993 21 nt Target: 5'-AAAAGGACUGCUUGUAGGUGA-3' (SEQ ID NO: 11716) |
| C5-2994 21 nt Target: 5'-AAAGGACUGCUUGUAGGUGAG-3' (SEQ ID NO: 11717) |
| C5-2995 21 nt Target: 5'-AAGGACUGCUUGUAGGUGAGA-3' (SEQ ID NO: 11718) |
| C5-2996 21 nt Target: 5'-AGGACUGCUUGUAGGUGAGAU-3' (SEQ ID NO: 11719) |
| C5-2997 21 nt Target: 5'-GGACUGCUUGUAGGUGAGAUC-3' (SEQ ID NO: 11720) |
| C5-2998 21 nt Target: 5'-GACUGCUUGUAGGUGAGAUCU-3' (SEQ ID NO: 11721) |
| C5-2999 21 nt Target: 5'-ACUGCUUGUAGGUGAGAUCUU-3' (SEQ ID NO: 11722) |
| C5-3000 21 nt Target: 5'-CUGCUUGUAGGUGAGAUCUUG-3' (SEQ ID NO: 11723) |
| C5-3001 21 nt Target: 5'-UGCUUGUAGGUGAGAUCUUGU-3' (SEQ ID NO: 11724) |
| C5-3002 21 nt Target: 5'-GCUUGUAGGUGAGAUCUUGUC-3' (SEQ ID NO: 11725) |
| C5-3003 21 nt Target: 5'-CUUGUAGGUGAGAUCUUGUCU-3' (SEQ ID NO: 11726) |
| C5-3004 21 nt Target: 5'-UUGUAGGUGAGAUCUUGUCUG-3' (SEQ ID NO: 11727) |
| C5-3005 21 nt Target: 5'-UGUAGGUGAGAUCUUGUCUGC-3' (SEQ ID NO: 11728) |
| C5-3006 21 nt Target: 5'-GUAGGUGAGAUCUUGUCUGCA-3' (SEQ ID NO: 11729) |
| C5-3007 21 nt Target: 5'-UAGGUGAGAUCUUGUCUGCAG-3' (SEQ ID NO: 11730) |
| C5-3008 21 nt Target: 5'-AGGUGAGAUCUUGUCUGCAGU-3' (SEQ ID NO: 11731) |
| C5-3009 21 nt Target: 5'-GGUGAGAUCUUGUCUGCAGUU-3' (SEQ ID NO: 11732) |
| C5-3010 21 nt Target: 5'-GUGAGAUCUUGUCUGCAGUUC-3' (SEQ ID NO: 11733) |
| C5-3011 21 nt Target: 5'-UGAGAUCUUGUCUGCAGUUCU-3' (SEQ ID NO: 11734) |
| C5-3012 21 nt Target: 5'-GAGAUCUUGUCUGCAGUUCUA-3' (SEQ ID NO: 11735) |
| C5-3013 21 nt Target: 5'-AGAUCUUGUCUGCAGUUCUAA-3' (SEQ ID NO: 11736) |
| C5-3014 21 nt Target: 5'-GAUCUUGUCUGCAGUUCUAAG-3' (SEQ ID NO: 11737) |
| C5-3015 21 nt Target: 5'-AUCUUGUCUGCAGUUCUAAGU-3' (SEQ ID NO: 11738) |
| C5-3016 21 nt Target: 5'-UCUUGUCUGCAGUUCUAAGUC-3' (SEQ ID NO: 11739) |
| C5-3036 21 nt Target: 5'-CAGGAAGGCAUCAAUAUCCUA-3' (SEQ ID NO: 11740) |
| C5-3037 21 nt Target: 5'-AGGAAGGCAUCAAUAUCCUAA-3' (SEQ ID NO: 11741) |
| C5-3038 21 nt Target: 5'-GGAAGGCAUCAAUAUCCUAAC-3' (SEQ ID NO: 11742) |
| C5-3039 21 nt Target: 5'-GAAGGCAUCAAUAUCCUAACC-3' (SEQ ID NO: 11743) |
| C5-3040 21 nt Target: 5'-AAGGCAUCAAUAUCCUAACCC-3' (SEQ ID NO: 11744) |
| C5-3041 21 nt Target: 5'-AGGCAUCAAUAUCCUAACCCA-3' (SEQ ID NO: 11745) |

TABLE 8-continued

| DsiRNA Target Sequences (21 mers) of Human Anti-C5 DsiRNAs Predicted to have > 50% Knockdown Efficacy |
|---|
| C5-3042 21 nt Target: 5'-GGCAUCAAUAUCCUAACCCAC-3' (SEQ ID NO: 11746) |
| C5-3043 21 nt Target: 5'-GCAUCAAUAUCCUAACCCACC-3' (SEQ ID NO: 11747) |
| C5-3044 21 nt Target: 5'-CAUCAAUAUCCUAACCCACCU-3' (SEQ ID NO: 11748) |
| C5-3045 21 nt Target: 5'-AUCAAUAUCCUAACCCACCUC-3' (SEQ ID NO: 11749) |
| C5-3046 21 nt Target: 5'-UCAAUAUCCUAACCCACCUCC-3' (SEQ ID NO: 11750) |
| C5-3047 21 nt Target: 5'-CAAUAUCCUAACCCACCUCCC-3' (SEQ ID NO: 11751) |
| C5-3048 21 nt Target: 5'-AAUAUCCUAACCCACCUCCCC-3' (SEQ ID NO: 11752) |
| C5-3054 21 nt Target: 5'-CUAACCCACCUCCCCAAAGGG-3' (SEQ ID NO: 11753) |
| C5-3055 21 nt Target: 5'-UAACCCACCUCCCCAAAGGGA-3' (SEQ ID NO: 11754) |
| C5-3056 21 nt Target: 5'-AACCCACCUCCCCAAAGGGAG-3' (SEQ ID NO: 11755) |
| C5-3079 21 nt Target: 5'-CAGAGGCGGAGCUGAUGAGCG-3' (SEQ ID NO: 11756) |
| C5-3082 21 nt Target: 5'-AGGCGGAGCUGAUGAGCGUUG-3' (SEQ ID NO: 11757) |
| C5-3083 21 nt Target: 5'-GGCGGAGCUGAUGAGCGUUGU-3' (SEQ ID NO: 11758) |
| C5-3084 21 nt Target: 5'-GCGGAGCUGAUGAGCGUUGUC-3' (SEQ ID NO: 11759) |
| C5-3085 21 nt Target: 5'-CGGAGCUGAUGAGCGUUGUCC-3' (SEQ ID NO: 11760) |
| C5-3086 21 nt Target: 5'-GGAGCUGAUGAGCGUUGUCCC-3' (SEQ ID NO: 11761) |
| C5-3087 21 nt Target: 5'-GAGCUGAUGAGCGUUGUCCCA-3' (SEQ ID NO: 11762) |
| C5-3088 21 nt Target: 5'-AGCUGAUGAGCGUUGUCCCAG-3' (SEQ ID NO: 11763) |
| C5-3089 21 nt Target: 5'-GCUGAUGAGCGUUGUCCCAGU-3' (SEQ ID NO: 11764) |
| C5-3090 21 nt Target: 5'-CUGAUGAGCGUUGUCCCAGUA-3' (SEQ ID NO: 11765) |
| C5-3091 21 nt Target: 5'-UGAUGAGCGUUGUCCCAGUAU-3' (SEQ ID NO: 11766) |
| C5-3092 21 nt Target: 5'-GAUGAGCGUUGUCCCAGUAUU-3' (SEQ ID NO: 11767) |
| C5-3093 21 nt Target: 5'-AUGAGCGUUGUCCCAGUAUUC-3' (SEQ ID NO: 11768) |
| C5-3094 21 nt Target: 5'-UGAGCGUUGUCCCAGUAUUCU-3' (SEQ ID NO: 11769) |
| C5-3095 21 nt Target: 5'-GAGCGUUGUCCCAGUAUUCUA-3' (SEQ ID NO: 11770) |
| C5-3096 21 nt Target: 5'-AGCGUUGUCCCAGUAUUCUAU-3' (SEQ ID NO: 11771) |
| C5-3097 21 nt Target: 5'-GCGUUGUCCCAGUAUUCUAUG-3' (SEQ ID NO: 11772) |
| C5-3098 21 nt Target: 5'-CGUUGUCCCAGUAUUCUAUGU-3' (SEQ ID NO: 11773) |
| C5-3099 21 nt Target: 5'-GUUGUCCCAGUAUUCUAUGUU-3' (SEQ ID NO: 11774) |
| C5-3100 21 nt Target: 5'-UUGUCCCAGUAUUCUAUGUUU-3' (SEQ ID NO: 11775) |
| C5-3101 21 nt Target: 5'-UGUCCCAGUAUUCUAUGUUUU-3' (SEQ ID NO: 11776) |
| C5-3102 21 nt Target: 5'-GUCCCAGUAUUCUAUGUUUUU-3' (SEQ ID NO: 11777) |
| C5-3104 21 nt Target: 5'-CCCAGUAUUCUAUGUUUUUCA-3' (SEQ ID NO: 11778) |
| C5-3105 21 nt Target: 5'-CCAGUAUUCUAUGUUUUUCAC-3' (SEQ ID NO: 11779) |
| C5-3106 21 nt Target: 5'-CAGUAUUCUAUGUUUUUCACU-3' (SEQ ID NO: 11780) |
| C5-3107 21 nt Target: 5'-AGUAUUCUAUGUUUUUCACUA-3' (SEQ ID NO: 11781) |
| C5-3108 21 nt Target: 5'-GUAUUCUAUGUUUUUCACUAC-3' (SEQ ID NO: 11782) |
| C5-3109 21 nt Target: 5'-UAUUCUAUGUUUUUCACUACC-3' (SEQ ID NO: 11783) |

TABLE 8-continued

| DsiRNA Target Sequences (21 mers) of Human Anti-C5 DsiRNAs Predicted to have > 50% Knockdown Efficacy | |
|---|---|
| C5-3110 | 21 nt Target: 5'-AUUCUAUGUUUUUCACUACCU-3' (SEQ ID NO: 11784) |
| C5-3111 | 21 nt Target: 5'-UUCUAUGUUUUUCACUACCUG-3' (SEQ ID NO: 11785) |
| C5-3112 | 21 nt Target: 5'-UCUAUGUUUUUCACUACCUGG-3' (SEQ ID NO: 11786) |
| C5-3113 | 21 nt Target: 5'-CUAUGUUUUUCACUACCUGGA-3' (SEQ ID NO: 11787) |
| C5-3114 | 21 nt Target: 5'-UAUGUUUUUCACUACCUGGAA-3' (SEQ ID NO: 11788) |
| C5-3115 | 21 nt Target: 5'-AUGUUUUUCACUACCUGGAAA-3' (SEQ ID NO: 11789) |
| C5-3116 | 21 nt Target: 5'-UGUUUUUCACUACCUGGAAAC-3' (SEQ ID NO: 11790) |
| C5-3117 | 21 nt Target: 5'-GUUUUUCACUACCUGGAAACA-3' (SEQ ID NO: 11791) |
| C5-3118 | 21 nt Target: 5'-UUUUUCACUACCUGGAAACAG-3' (SEQ ID NO: 11792) |
| C5-3119 | 21 nt Target: 5'-UUUUCACUACCUGGAAACAGG-3' (SEQ ID NO: 11793) |
| C5-3120 | 21 nt Target: 5'-UUUCACUACCUGGAAACAGGA-3' (SEQ ID NO: 11794) |
| C5-3121 | 21 nt Target: 5'-UUCACUACCUGGAAACAGGAA-3' (SEQ ID NO: 11795) |
| C5-3122 | 21 nt Target: 5'-UCACUACCUGGAAACAGGAAA-3' (SEQ ID NO: 11796) |
| C5-3123 | 21 nt Target: 5'-CACUACCUGGAAACAGGAAAU-3' (SEQ ID NO: 11797) |
| C5-3124 | 21 nt Target: 5'-ACUACCUGGAAACAGGAAAUC-3' (SEQ ID NO: 11798) |
| C5-3125 | 21 nt Target: 5'-CUACCUGGAAACAGGAAAUCA-3' (SEQ ID NO: 11799) |
| C5-3126 | 21 nt Target: 5'-UACCUGGAAACAGGAAAUCAU-3' (SEQ ID NO: 11800) |
| C5-3127 | 21 nt Target: 5'-ACCUGGAAACAGGAAAUCAUU-3' (SEQ ID NO: 11801) |
| C5-3128 | 21 nt Target: 5'-CCUGGAAACAGGAAAUCAUUG-3' (SEQ ID NO: 11802) |
| C5-3129 | 21 nt Target: 5'-CUGGAAACAGGAAAUCAUUGG-3' (SEQ ID NO: 11803) |
| C5-3130 | 21 nt Target: 5'-UGGAAACAGGAAAUCAUUGGA-3' (SEQ ID NO: 11804) |
| C5-3131 | 21 nt Target: 5'-GGAAACAGGAAAUCAUUGGAA-3' (SEQ ID NO: 11805) |
| C5-3132 | 21 nt Target: 5'-GAAACAGGAAAUCAUUGGAAC-3' (SEQ ID NO: 11806) |
| C5-3133 | 21 nt Target: 5'-AAACAGGAAAUCAUUGGAACA-3' (SEQ ID NO: 11807) |
| C5-3134 | 21 nt Target: 5'-AACAGGAAAUCAUUGGAACAU-3' (SEQ ID NO: 11808) |
| C5-3137 | 21 nt Target: 5'-AGGAAAUCAUUGGAACAUUUU-3' (SEQ ID NO: 11809) |
| C5-3138 | 21 nt Target: 5'-GGAAAUCAUUGGAACAUUUUU-3' (SEQ ID NO: 11810) |
| C5-3139 | 21 nt Target: 5'-GAAAUCAUUGGAACAUUUUUC-3' (SEQ ID NO: 11811) |
| C5-3140 | 21 nt Target: 5'-AAAUCAUUGGAACAUUUUUCA-3' (SEQ ID NO: 11812) |
| C5-3141 | 21 nt Target: 5'-AAUCAUUGGAACAUUUUUCAU-3' (SEQ ID NO: 11813) |
| C5-3142 | 21 nt Target: 5'-AUCAUUGGAACAUUUUUCAUU-3' (SEQ ID NO: 11814) |
| C5-3143 | 21 nt Target: 5'-UCAUUGGAACAUUUUUCAUUC-3' (SEQ ID NO: 11815) |
| C5-3163 | 21 nt Target: 5'-CUGACCCAUUAAUUGAAAAGC-3' (SEQ ID NO: 11816) |
| C5-3191 | 21 nt Target: 5'-GAAGAAAAAAUUAAAAGAAGG-3' (SEQ ID NO: 11817) |
| C5-3192 | 21 nt Target: 5'-AAGAAAAAAUUAAAAGAAGGG-3' (SEQ ID NO: 11818) |
| C5-3193 | 21 nt Target: 5'-AGAAAAAAUUAAAAGAAGGGA-3' (SEQ ID NO: 11819) |
| C5-3194 | 21 nt Target: 5'-GAAAAAAUUAAAAGAAGGGAU-3' (SEQ ID NO: 11820) |
| C5-3195 | 21 nt Target: 5'-AAAAAAUUAAAAGAAGGGAUG-3' (SEQ ID NO: 11821) |
| C5-3215 | 21 nt Target: 5'-GUUGAGCAUUAUGUCCUACAG-3' (SEQ ID NO: 11822) |

TABLE 8-continued

DsiRNA Target Sequences (21 mers) of Human Anti-C5
DsiRNAs Predicted to have > 50% Knockdown Efficacy

```
C5-3217    21 nt Target:  5'-UGAGCAUUAUGUCCUACAGAA-3'  (SEQ ID NO: 11823)

C5-3218    21 nt Target:  5'-GAGCAUUAUGUCCUACAGAAA-3'  (SEQ ID NO: 11824)

C5-3219    21 nt Target:  5'-AGCAUUAUGUCCUACAGAAAU-3'  (SEQ ID NO: 11825)

C5-3220    21 nt Target:  5'-GCAUUAUGUCCUACAGAAAUG-3'  (SEQ ID NO: 11826)

C5-3221    21 nt Target:  5'-CAUUAUGUCCUACAGAAAUGC-3'  (SEQ ID NO: 11827)

C5-3222    21 nt Target:  5'-AUUAUGUCCUACAGAAAUGCU-3'  (SEQ ID NO: 11828)

C5-3223    21 nt Target:  5'-UUAUGUCCUACAGAAAUGCUG-3'  (SEQ ID NO: 11829)

C5-3224    21 nt Target:  5'-UAUGUCCUACAGAAAUGCUGA-3'  (SEQ ID NO: 11830)

C5-3225    21 nt Target:  5'-AUGUCCUACAGAAAUGCUGAC-3'  (SEQ ID NO: 11831)

C5-3226    21 nt Target:  5'-UGUCCUACAGAAAUGCUGACU-3'  (SEQ ID NO: 11832)

C5-3227    21 nt Target:  5'-GUCCUACAGAAAUGCUGACUA-3'  (SEQ ID NO: 11833)

C5-3271    21 nt Target:  5'-GAAGUGCUAGCACUUGGUUAA-3'  (SEQ ID NO: 11834)

C5-3272    21 nt Target:  5'-AAGUGCUAGCACUUGGUUAAC-3'  (SEQ ID NO: 11835)

C5-3273    21 nt Target:  5'-AGUGCUAGCACUUGGUUAACA-3'  (SEQ ID NO: 11836)

C5-3274    21 nt Target:  5'-GUGCUAGCACUUGGUUAACAG-3'  (SEQ ID NO: 11837)

C5-3275    21 nt Target:  5'-UGCUAGCACUUGGUUAACAGC-3'  (SEQ ID NO: 11838)

C5-3276    21 nt Target:  5'-GCUAGCACUUGGUUAACAGCU-3'  (SEQ ID NO: 11839)

C5-3277    21 nt Target:  5'-CUAGCACUUGGUUAACAGCUU-3'  (SEQ ID NO: 11840)

C5-3278    21 nt Target:  5'-UAGCACUUGGUUAACAGCUUU-3'  (SEQ ID NO: 11841)

C5-3279    21 nt Target:  5'-AGCACUUGGUUAACAGCUUUU-3'  (SEQ ID NO: 11842)

C5-3280    21 nt Target:  5'-GCACUUGGUUAACAGCUUUUG-3'  (SEQ ID NO: 11843)

C5-3282    21 nt Target:  5'-ACUUGGUUAACAGCUUUUGCU-3'  (SEQ ID NO: 11844)

C5-3283    21 nt Target:  5'-CUUGGUUAACAGCUUUUGCUU-3'  (SEQ ID NO: 11845)

C5-3286    21 nt Target:  5'-GGUUAACAGCUUUUGCUUUAA-3'  (SEQ ID NO: 11846)

C5-3287    21 nt Target:  5'-GUUAACAGCUUUUGCUUUAAG-3'  (SEQ ID NO: 11847)

C5-3288    21 nt Target:  5'-UUAACAGCUUUUGCUUUAAGA-3'  (SEQ ID NO: 11848)

C5-3289    21 nt Target:  5'-UAACAGCUUUUGCUUUAAGAG-3'  (SEQ ID NO: 11849)

C5-3290    21 nt Target:  5'-AACAGCUUUUGCUUUAAGAGU-3'  (SEQ ID NO: 11850)

C5-3291    21 nt Target:  5'-ACAGCUUUUGCUUUAAGAGUA-3'  (SEQ ID NO: 11851)

C5-3292    21 nt Target:  5'-CAGCUUUUGCUUUAAGAGUAC-3'  (SEQ ID NO: 11852)

C5-3293    21 nt Target:  5'-AGCUUUUGCUUUAAGAGUACU-3'  (SEQ ID NO: 11853)

C5-3294    21 nt Target:  5'-GCUUUUGCUUUAAGAGUACUU-3'  (SEQ ID NO: 11854)

C5-3295    21 nt Target:  5'-CUUUUGCUUUAAGAGUACUUG-3'  (SEQ ID NO: 11855)

C5-3296    21 nt Target:  5'-UUUUGCUUUAAGAGUACUUGG-3'  (SEQ ID NO: 11856)

C5-3297    21 nt Target:  5'-UUUGCUUUAAGAGUACUUGGA-3'  (SEQ ID NO: 11857)

C5-3300    21 nt Target:  5'-GCUUUAAGAGUACUUGGACAA-3'  (SEQ ID NO: 11858)

C5-3301    21 nt Target:  5'-CUUUAAGAGUACUUGGACAAG-3'  (SEQ ID NO: 11859)

C5-3331    21 nt Target:  5'-ACGUAGAGCAGAACCAAAAUU-3'  (SEQ ID NO: 11860)
```

TABLE 8-continued

DsiRNA Target Sequences (21 mers) of Human Anti-C5
DsiRNAs Predicted to have > 50% Knockdown Efficacy

| | | |
|---|---|---|
| C5-3355 | 21 nt Target: 5'-UUUGUAAUUCUUUAUUGUGGC-3' | (SEQ ID NO: 11861) |
| C5-3356 | 21 nt Target: 5'-UUGUAAUUCUUUAUUGUGGCU-3' | (SEQ ID NO: 11862) |
| C5-3406 | 21 nt Target: 5'-CUUUCAAGGAAAAUUCACAGU-3' | (SEQ ID NO: 11863) |
| C5-3407 | 21 nt Target: 5'-UUUCAAGGAAAAUUCACAGUA-3' | (SEQ ID NO: 11864) |
| C5-3408 | 21 nt Target: 5'-UUCAAGGAAAAUUCACAGUAU-3' | (SEQ ID NO: 11865) |
| C5-3409 | 21 nt Target: 5'-UCAAGGAAAAUUCACAGUAUC-3' | (SEQ ID NO: 11866) |
| C5-3410 | 21 nt Target: 5'-CAAGGAAAAUUCACAGUAUCA-3' | (SEQ ID NO: 11867) |
| C5-3411 | 21 nt Target: 5'-AAGGAAAAUUCACAGUAUCAA-3' | (SEQ ID NO: 11868) |
| C5-3412 | 21 nt Target: 5'-AGGAAAAUUCACAGUAUCAAC-3' | (SEQ ID NO: 11869) |
| C5-3413 | 21 nt Target: 5'-GGAAAAUUCACAGUAUCAACC-3' | (SEQ ID NO: 11870) |
| C5-3414 | 21 nt Target: 5'-GAAAAUUCACAGUAUCAACCA-3' | (SEQ ID NO: 11871) |
| C5-3415 | 21 nt Target: 5'-AAAAUUCACAGUAUCAACCAA-3' | (SEQ ID NO: 11872) |
| C5-3416 | 21 nt Target: 5'-AAAUUCACAGUAUCAACCAAU-3' | (SEQ ID NO: 11873) |
| C5-3417 | 21 nt Target: 5'-AAUUCACAGUAUCAACCAAUA-3' | (SEQ ID NO: 11874) |
| C5-3418 | 21 nt Target: 5'-AUUCACAGUAUCAACCAAUAA-3' | (SEQ ID NO: 11875) |
| C5-3420 | 21 nt Target: 5'-UCACAGUAUCAACCAAUAAAA-3' | (SEQ ID NO: 11876) |
| C5-3421 | 21 nt Target: 5'-CACAGUAUCAACCAAUAAAAU-3' | (SEQ ID NO: 11877) |
| C5-3422 | 21 nt Target: 5'-ACAGUAUCAACCAAUAAAAUU-3' | (SEQ ID NO: 11878) |
| C5-3423 | 21 nt Target: 5'-CAGUAUCAACCAAUAAAAUUA-3' | (SEQ ID NO: 11879) |
| C5-3424 | 21 nt Target: 5'-AGUAUCAACCAAUAAAAUUAC-3' | (SEQ ID NO: 11880) |
| C5-3425 | 21 nt Target: 5'-GUAUCAACCAAUAAAAUUACA-3' | (SEQ ID NO: 11881) |
| C5-3426 | 21 nt Target: 5'-UAUCAACCAAUAAAAUUACAG-3' | (SEQ ID NO: 11882) |
| C5-3551 | 21 nt Target: 5'-CACAGCUCUAAUUAAAGCUGA-3' | (SEQ ID NO: 11883) |
| C5-3552 | 21 nt Target: 5'-ACAGCUCUAAUUAAAGCUGAC-3' | (SEQ ID NO: 11884) |
| C5-3553 | 21 nt Target: 5'-CAGCUCUAAUUAAAGCUGACA-3' | (SEQ ID NO: 11885) |
| C5-3573 | 21 nt Target: 5'-AACUUUCUGCUUGAAAAUACA-3' | (SEQ ID NO: 11886) |
| C5-3574 | 21 nt Target: 5'-ACUUUCUGCUUGAAAAUACAC-3' | (SEQ ID NO: 11887) |
| C5-3575 | 21 nt Target: 5'-CUUUCUGCUUGAAAAUACACU-3' | (SEQ ID NO: 11888) |
| C5-3576 | 21 nt Target: 5'-UUUCUGCUUGAAAAUACACUG-3' | (SEQ ID NO: 11889) |
| C5-3577 | 21 nt Target: 5'-UUCUGCUUGAAAAUACACUGC-3' | (SEQ ID NO: 11890) |
| C5-3578 | 21 nt Target: 5'-UCUGCUUGAAAAUACACUGCC-3' | (SEQ ID NO: 11891) |
| C5-3579 | 21 nt Target: 5'-CUGCUUGAAAAUACACUGCCA-3' | (SEQ ID NO: 11892) |
| C5-3580 | 21 nt Target: 5'-UGCUUGAAAAUACACUGCCAG-3' | (SEQ ID NO: 11893) |
| C5-3581 | 21 nt Target: 5'-GCUUGAAAAUACACUGCCAGC-3' | (SEQ ID NO: 11894) |
| C5-3582 | 21 nt Target: 5'-CUUGAAAAUACACUGCCAGCC-3' | (SEQ ID NO: 11895) |
| C5-3583 | 21 nt Target: 5'-UUGAAAAUACACUGCCAGCCC-3' | (SEQ ID NO: 11896) |
| C5-3584 | 21 nt Target: 5'-UGAAAAUACACUGCCAGCCCA-3' | (SEQ ID NO: 11897) |
| C5-3585 | 21 nt Target: 5'-GAAAAUACACUGCCAGCCCAG-3' | (SEQ ID NO: 11898) |
| C5-3586 | 21 nt Target: 5'-AAAAUACACUGCCAGCCCAGA-3' | (SEQ ID NO: 11899) |

TABLE 8-continued

DsiRNA Target Sequences (21 mers) of Human Anti-C5
DsiRNAs Predicted to have > 50% Knockdown Efficacy

| | | |
|---|---|---|
| C5-3587 | 21 nt Target: 5'-AAAUACACUGCCAGCCCAGAG-3' | (SEQ ID NO: 11900) |
| C5-3588 | 21 nt Target: 5'-AAUACACUGCCAGCCCAGAGC-3' | (SEQ ID NO: 11901) |
| C5-3589 | 21 nt Target: 5'-AUACACUGCCAGCCCAGAGCA-3' | (SEQ ID NO: 11902) |
| C5-3590 | 21 nt Target: 5'-UACACUGCCAGCCCAGAGCAC-3' | (SEQ ID NO: 11903) |
| C5-3591 | 21 nt Target: 5'-ACACUGCCAGCCCAGAGCACC-3' | (SEQ ID NO: 11904) |
| C5-3592 | 21 nt Target: 5'-CACUGCCAGCCCAGAGCACCU-3' | (SEQ ID NO: 11905) |
| C5-3593 | 21 nt Target: 5'-ACUGCCAGCCCAGAGCACCUU-3' | (SEQ ID NO: 11906) |
| C5-3594 | 21 nt Target: 5'-CUGCCAGCCCAGAGCACCUUU-3' | (SEQ ID NO: 11907) |
| C5-3595 | 21 nt Target: 5'-UGCCAGCCCAGAGCACCUUUA-3' | (SEQ ID NO: 11908) |
| C5-3596 | 21 nt Target: 5'-GCCAGCCCAGAGCACCUUUAC-3' | (SEQ ID NO: 11909) |
| C5-3597 | 21 nt Target: 5'-CCAGCCCAGAGCACCUUUACA-3' | (SEQ ID NO: 11910) |
| C5-3598 | 21 nt Target: 5'-CAGCCCAGAGCACCUUUACAU-3' | (SEQ ID NO: 11911) |
| C5-3599 | 21 nt Target: 5'-AGCCCAGAGCACCUUUACAUU-3' | (SEQ ID NO: 11912) |
| C5-3600 | 21 nt Target: 5'-GCCCAGAGCACCUUUACAUUG-3' | (SEQ ID NO: 11913) |
| C5-3601 | 21 nt Target: 5'-CCCAGAGCACCUUUACAUUGG-3' | (SEQ ID NO: 11914) |
| C5-3602 | 21 nt Target: 5'-CCAGAGCACCUUUACAUUGGC-3' | (SEQ ID NO: 11915) |
| C5-3603 | 21 nt Target: 5'-CAGAGCACCUUUACAUUGGCC-3' | (SEQ ID NO: 11916) |
| C5-3604 | 21 nt Target: 5'-AGAGCACCUUUACAUUGGCCA-3' | (SEQ ID NO: 11917) |
| C5-3605 | 21 nt Target: 5'-GAGCACCUUUACAUUGGCCAU-3' | (SEQ ID NO: 11918) |
| C5-3606 | 21 nt Target: 5'-AGCACCUUUACAUUGGCCAUU-3' | (SEQ ID NO: 11919) |
| C5-3607 | 21 nt Target: 5'-GCACCUUUACAUUGGCCAUUU-3' | (SEQ ID NO: 11920) |
| C5-3608 | 21 nt Target: 5'-CACCUUUACAUUGGCCAUUUC-3' | (SEQ ID NO: 11921) |
| C5-3609 | 21 nt Target: 5'-ACCUUUACAUUGGCCAUUUCU-3' | (SEQ ID NO: 11922) |
| C5-3610 | 21 nt Target: 5'-CCUUUACAUUGGCCAUUUCUG-3' | (SEQ ID NO: 11923) |
| C5-3611 | 21 nt Target: 5'-CUUUACAUUGGCCAUUUCUGC-3' | (SEQ ID NO: 11924) |
| C5-3631 | 21 nt Target: 5'-CGUAUGCUCUUUCCCUGGGAG-3' | (SEQ ID NO: 11925) |
| C5-3632 | 21 nt Target: 5'-GUAUGCUCUUUCCCUGGGAGA-3' | (SEQ ID NO: 11926) |
| C5-3633 | 21 nt Target: 5'-UAUGCUCUUUCCCUGGGAGAU-3' | (SEQ ID NO: 11927) |
| C5-3634 | 21 nt Target: 5'-AUGCUCUUUCCCUGGGAGAUA-3' | (SEQ ID NO: 11928) |
| C5-3635 | 21 nt Target: 5'-UGCUCUUUCCCUGGGAGAUAA-3' | (SEQ ID NO: 11929) |
| C5-3636 | 21 nt Target: 5'-GCUCUUUCCCUGGGAGAUAAA-3' | (SEQ ID NO: 11930) |
| C5-3637 | 21 nt Target: 5'-CUCUUUCCCUGGGAGAUAAAA-3' | (SEQ ID NO: 11931) |
| C5-3638 | 21 nt Target: 5'-UCUUUCCCUGGGAGAUAAAAC-3' | (SEQ ID NO: 11932) |
| C5-3639 | 21 nt Target: 5'-CUUUCCCUGGGAGAUAAAACU-3' | (SEQ ID NO: 11933) |
| C5-3640 | 21 nt Target: 5'-UUUCCCUGGGAGAUAAAACUC-3' | (SEQ ID NO: 11934) |
| C5-3641 | 21 nt Target: 5'-UUCCCUGGGAGAUAAAACUCA-3' | (SEQ ID NO: 11935) |
| C5-3642 | 21 nt Target: 5'-UCCCUGGGAGAUAAAACUCAC-3' | (SEQ ID NO: 11936) |
| C5-3643 | 21 nt Target: 5'-CCCUGGGAGAUAAAACUCACC-3' | (SEQ ID NO: 11937) |

TABLE 8-continued

DsiRNA Target Sequences (21 mers) of Human Anti-C5
DsiRNAs Predicted to have > 50% Knockdown Efficacy

| | | |
|---|---|---|
| C5-3644 | 21 nt Target: 5'-CCUGGGAGAUAAAACUCACCC-3' | (SEQ ID NO: 11938) |
| C5-3645 | 21 nt Target: 5'-CUGGGAGAUAAAACUCACCCA-3' | (SEQ ID NO: 11939) |
| C5-3646 | 21 nt Target: 5'-UGGGAGAUAAAACUCACCCAC-3' | (SEQ ID NO: 11940) |
| C5-3647 | 21 nt Target: 5'-GGGAGAUAAAACUCACCCACA-3' | (SEQ ID NO: 11941) |
| C5-3648 | 21 nt Target: 5'-GGAGAUAAAACUCACCCACAG-3' | (SEQ ID NO: 11942) |
| C5-3649 | 21 nt Target: 5'-GAGAUAAAACUCACCCACAGU-3' | (SEQ ID NO: 11943) |
| C5-3650 | 21 nt Target: 5'-AGAUAAAACUCACCCACAGUU-3' | (SEQ ID NO: 11944) |
| C5-3651 | 21 nt Target: 5'-GAUAAAACUCACCCACAGUUU-3' | (SEQ ID NO: 11945) |
| C5-3671 | 21 nt Target: 5'-UCGUUCAAUUGUUUCAGCUUU-3' | (SEQ ID NO: 11946) |
| C5-3673 | 21 nt Target: 5'-GUUCAAUUGUUUCAGCUUUGA-3' | (SEQ ID NO: 11947) |
| C5-3674 | 21 nt Target: 5'-UUCAAUUGUUUCAGCUUUGAA-3' | (SEQ ID NO: 11948) |
| C5-3675 | 21 nt Target: 5'-UCAAUUGUUUCAGCUUUGAAG-3' | (SEQ ID NO: 11949) |
| C5-3676 | 21 nt Target: 5'-CAAUUGUUUCAGCUUUGAAGA-3' | (SEQ ID NO: 11950) |
| C5-3677 | 21 nt Target: 5'-AAUUGUUUCAGCUUUGAAGAG-3' | (SEQ ID NO: 11951) |
| C5-3678 | 21 nt Target: 5'-AUUGUUUCAGCUUUGAAGAGA-3' | (SEQ ID NO: 11952) |
| C5-3679 | 21 nt Target: 5'-UUGUUUCAGCUUUGAAGAGAG-3' | (SEQ ID NO: 11953) |
| C5-3680 | 21 nt Target: 5'-UGUUUCAGCUUUGAAGAGAGA-3' | (SEQ ID NO: 11954) |
| C5-3681 | 21 nt Target: 5'-GUUUCAGCUUUGAAGAGAGAA-3' | (SEQ ID NO: 11955) |
| C5-3682 | 21 nt Target: 5'-UUUCAGCUUUGAAGAGAGAAG-3' | (SEQ ID NO: 11956) |
| C5-3683 | 21 nt Target: 5'-UUCAGCUUUGAAGAGAGAAGC-3' | (SEQ ID NO: 11957) |
| C5-3684 | 21 nt Target: 5'-UCAGCUUUGAAGAGAGAAGCU-3' | (SEQ ID NO: 11958) |
| C5-3685 | 21 nt Target: 5'-CAGCUUUGAAGAGAGAAGCUU-3' | (SEQ ID NO: 11959) |
| C5-3686 | 21 nt Target: 5'-AGCUUUGAAGAGAGAAGCUUU-3' | (SEQ ID NO: 11960) |
| C5-3687 | 21 nt Target: 5'-GCUUUGAAGAGAGAAGCUUUG-3' | (SEQ ID NO: 11961) |
| C5-3688 | 21 nt Target: 5'-CUUUGAAGAGAGAAGCUUUGG-3' | (SEQ ID NO: 11962) |
| C5-3689 | 21 nt Target: 5'-UUUGAAGAGAGAAGCUUUGGU-3' | (SEQ ID NO: 11963) |
| C5-3693 | 21 nt Target: 5'-AAGAGAGAAGCUUUGGUUAAA-3' | (SEQ ID NO: 11964) |
| C5-3694 | 21 nt Target: 5'-AGAGAGAAGCUUUGGUUAAAG-3' | (SEQ ID NO: 11965) |
| C5-3695 | 21 nt Target: 5'-GAGAGAAGCUUUGGUUAAAGG-3' | (SEQ ID NO: 11966) |
| C5-3698 | 21 nt Target: 5'-AGAAGCUUUGGUUAAAGGUAA-3' | (SEQ ID NO: 11967) |
| C5-3699 | 21 nt Target: 5'-GAAGCUUUGGUUAAAGGUAAU-3' | (SEQ ID NO: 11968) |
| C5-3700 | 21 nt Target: 5'-AAGCUUUGGUUAAAGGUAAUC-3' | (SEQ ID NO: 11969) |
| C5-3701 | 21 nt Target: 5'-AGCUUUGGUUAAAGGUAAUCC-3' | (SEQ ID NO: 11970) |
| C5-3702 | 21 nt Target: 5'-GCUUUGGUUAAAGGUAAUCCA-3' | (SEQ ID NO: 11971) |
| C5-3703 | 21 nt Target: 5'-CUUUGGUUAAAGGUAAUCCAC-3' | (SEQ ID NO: 11972) |
| C5-3704 | 21 nt Target: 5'-UUUGGUUAAAGGUAAUCCACC-3' | (SEQ ID NO: 11973) |
| C5-3705 | 21 nt Target: 5'-UUGGUUAAAGGUAAUCCACCC-3' | (SEQ ID NO: 11974) |
| C5-3706 | 21 nt Target: 5'-UGGUUAAAGGUAAUCCACCCA-3' | (SEQ ID NO: 11975) |
| C5-3707 | 21 nt Target: 5'-GGUUAAAGGUAAUCCACCCAU-3' | (SEQ ID NO: 11976) |

TABLE 8-continued

| DsiRNA Target Sequences (21 mers) of Human Anti-C5 DsiRNAs Predicted to have > 50% Knockdown Efficacy | | |
|---|---|---|
| C5-3708 | 21 nt Target: 5'-GUUAAAGGUAAUCCACCCAUU-3' | (SEQ ID NO: 11977) |
| C5-3709 | 21 nt Target: 5'-UUAAAGGUAAUCCACCCAUUU-3' | (SEQ ID NO: 11978) |
| C5-3710 | 21 nt Target: 5'-UAAAGGUAAUCCACCCAUUUA-3' | (SEQ ID NO: 11979) |
| C5-3711 | 21 nt Target: 5'-AAAGGUAAUCCACCCAUUUAU-3' | (SEQ ID NO: 11980) |
| C5-3712 | 21 nt Target: 5'-AAGGUAAUCCACCCAUUUAUC-3' | (SEQ ID NO: 11981) |
| C5-3713 | 21 nt Target: 5'-AGGUAAUCCACCCAUUUAUCG-3' | (SEQ ID NO: 11982) |
| C5-3714 | 21 nt Target: 5'-GGUAAUCCACCCAUUUAUCGU-3' | (SEQ ID NO: 11983) |
| C5-3715 | 21 nt Target: 5'-GUAAUCCACCCAUUUAUCGUU-3' | (SEQ ID NO: 11984) |
| C5-3716 | 21 nt Target: 5'-UAAUCCACCCAUUUAUCGUUU-3' | (SEQ ID NO: 11985) |
| C5-3717 | 21 nt Target: 5'-AAUCCACCCAUUUAUCGUUUU-3' | (SEQ ID NO: 11986) |
| C5-3718 | 21 nt Target: 5'-AUCCACCCAUUUAUCGUUUUU-3' | (SEQ ID NO: 11987) |
| C5-3719 | 21 nt Target: 5'-UCCACCCAUUUAUCGUUUUUG-3' | (SEQ ID NO: 11988) |
| C5-3720 | 21 nt Target: 5'-CCACCCAUUUAUCGUUUUUGG-3' | (SEQ ID NO: 11989) |
| C5-3721 | 21 nt Target: 5'-CACCCAUUUAUCGUUUUUGGA-3' | (SEQ ID NO: 11990) |
| C5-3723 | 21 nt Target: 5'-CCCAUUUAUCGUUUUUGGAAA-3' | (SEQ ID NO: 11991) |
| C5-3724 | 21 nt Target: 5'-CCAUUUAUCGUUUUUGGAAAG-3' | (SEQ ID NO: 11992) |
| C5-3725 | 21 nt Target: 5'-CAUUUAUCGUUUUUGGAAAGA-3' | (SEQ ID NO: 11993) |
| C5-3726 | 21 nt Target: 5'-AUUUAUCGUUUUUGGAAAGAC-3' | (SEQ ID NO: 11994) |
| C5-3727 | 21 nt Target: 5'-UUUAUCGUUUUUGGAAAGACA-3' | (SEQ ID NO: 11995) |
| C5-3754 | 21 nt Target: 5'-AGCAUAAAGACAGCUCUGUAC-3' | (SEQ ID NO: 11996) |
| C5-3755 | 21 nt Target: 5'-GCAUAAAGACAGCUCUGUACC-3' | (SEQ ID NO: 11997) |
| C5-3756 | 21 nt Target: 5'-CAUAAAGACAGCUCUGUACCU-3' | (SEQ ID NO: 11998) |
| C5-3757 | 21 nt Target: 5'-AUAAAGACAGCUCUGUACCUA-3' | (SEQ ID NO: 11999) |
| C5-3758 | 21 nt Target: 5'-UAAAGACAGCUCUGUACCUAA-3' | (SEQ ID NO: 12000) |
| C5-3759 | 21 nt Target: 5'-AAAGACAGCUCUGUACCUAAC-3' | (SEQ ID NO: 12001) |
| C5-3760 | 21 nt Target: 5'-AAGACAGCUCUGUACCUAACA-3' | (SEQ ID NO: 12002) |
| C5-3761 | 21 nt Target: 5'-AGACAGCUCUGUACCUAACAC-3' | (SEQ ID NO: 12003) |
| C5-3762 | 21 nt Target: 5'-GACAGCUCUGUACCUAACACU-3' | (SEQ ID NO: 12004) |
| C5-3763 | 21 nt Target: 5'-ACAGCUCUGUACCUAACACUG-3' | (SEQ ID NO: 12005) |
| C5-3764 | 21 nt Target: 5'-CAGCUCUGUACCUAACACUGG-3' | (SEQ ID NO: 12006) |
| C5-3765 | 21 nt Target: 5'-AGCUCUGUACCUAACACUGGU-3' | (SEQ ID NO: 12007) |
| C5-3766 | 21 nt Target: 5'-GCUCUGUACCUAACACUGGUA-3' | (SEQ ID NO: 12008) |
| C5-3767 | 21 nt Target: 5'-CUCUGUACCUAACACUGGUAC-3' | (SEQ ID NO: 12009) |
| C5-3787 | 21 nt Target: 5'-CGGCACGUAUGGUAGAAACAA-3' | (SEQ ID NO: 12010) |
| C5-3788 | 21 nt Target: 5'-GGCACGUAUGGUAGAAACAAC-3' | (SEQ ID NO: 12011) |
| C5-3789 | 21 nt Target: 5'-GCACGUAUGGUAGAAACAACU-3' | (SEQ ID NO: 12012) |
| C5-3790 | 21 nt Target: 5'-CACGUAUGGUAGAAACAACUG-3' | (SEQ ID NO: 12013) |
| C5-3791 | 21 nt Target: 5'-ACGUAUGGUAGAAACAACUGC-3' | (SEQ ID NO: 12014) |

TABLE 8-continued

| DsiRNA Target Sequences (21 mers) of Human Anti-C5 DsiRNAs Predicted to have > 50% Knockdown Efficacy | | |
|---|---|---|
| C5-3792 | 21 nt Target: 5'-CGUAUGGUAGAAACAACUGCC-3' | (SEQ ID NO: 12015) |
| C5-3793 | 21 nt Target: 5'-GUAUGGUAGAAACAACUGCCU-3' | (SEQ ID NO: 12016) |
| C5-3794 | 21 nt Target: 5'-UAUGGUAGAAACAACUGCCUA-3' | (SEQ ID NO: 12017) |
| C5-3795 | 21 nt Target: 5'-AUGGUAGAAACAACUGCCUAU-3' | (SEQ ID NO: 12018) |
| C5-3796 | 21 nt Target: 5'-UGGUAGAAACAACUGCCUAUG-3' | (SEQ ID NO: 12019) |
| C5-3797 | 21 nt Target: 5'-GGUAGAAACAACUGCCUAUGC-3' | (SEQ ID NO: 12020) |
| C5-3798 | 21 nt Target: 5'-GUAGAAACAACUGCCUAUGCU-3' | (SEQ ID NO: 12021) |
| C5-3799 | 21 nt Target: 5'-UAGAAACAACUGCCUAUGCUU-3' | (SEQ ID NO: 12022) |
| C5-3800 | 21 nt Target: 5'-AGAAACAACUGCCUAUGCUUU-3' | (SEQ ID NO: 12023) |
| C5-3801 | 21 nt Target: 5'-GAAACAACUGCCUAUGCUUUA-3' | (SEQ ID NO: 12024) |
| C5-3802 | 21 nt Target: 5'-AAACAACUGCCUAUGCUUUAC-3' | (SEQ ID NO: 12025) |
| C5-3803 | 21 nt Target: 5'-AACAACUGCCUAUGCUUUACU-3' | (SEQ ID NO: 12026) |
| C5-3804 | 21 nt Target: 5'-ACAACUGCCUAUGCUUUACUC-3' | (SEQ ID NO: 12027) |
| C5-3805 | 21 nt Target: 5'-CAACUGCCUAUGCUUUACUCA-3' | (SEQ ID NO: 12028) |
| C5-3806 | 21 nt Target: 5'-AACUGCCUAUGCUUUACUCAC-3' | (SEQ ID NO: 12029) |
| C5-3807 | 21 nt Target: 5'-ACUGCCUAUGCUUUACUCACC-3' | (SEQ ID NO: 12030) |
| C5-3808 | 21 nt Target: 5'-CUGCCUAUGCUUUACUCACCA-3' | (SEQ ID NO: 12031) |
| C5-3809 | 21 nt Target: 5'-UGCCUAUGCUUUACUCACCAG-3' | (SEQ ID NO: 12032) |
| C5-3810 | 21 nt Target: 5'-GCCUAUGCUUUACUCACCAGU-3' | (SEQ ID NO: 12033) |
| C5-3811 | 21 nt Target: 5'-CCUAUGCUUUACUCACCAGUC-3' | (SEQ ID NO: 12034) |
| C5-3812 | 21 nt Target: 5'-CUAUGCUUUACUCACCAGUCU-3' | (SEQ ID NO: 12035) |
| C5-3813 | 21 nt Target: 5'-UAUGCUUUACUCACCAGUCUG-3' | (SEQ ID NO: 12036) |
| C5-3816 | 21 nt Target: 5'-GCUUUACUCACCAGUCUGAAC-3' | (SEQ ID NO: 12037) |
| C5-3817 | 21 nt Target: 5'-CUUUACUCACCAGUCUGAACU-3' | (SEQ ID NO: 12038) |
| C5-3818 | 21 nt Target: 5'-UUUACUCACCAGUCUGAACUU-3' | (SEQ ID NO: 12039) |
| C5-3819 | 21 nt Target: 5'-UUACUCACCAGUCUGAACUUG-3' | (SEQ ID NO: 12040) |
| C5-3821 | 21 nt Target: 5'-ACUCACCAGUCUGAACUUGAA-3' | (SEQ ID NO: 12041) |
| C5-3822 | 21 nt Target: 5'-CUCACCAGUCUGAACUUGAAA-3' | (SEQ ID NO: 12042) |
| C5-3823 | 21 nt Target: 5'-UCACCAGUCUGAACUUGAAAG-3' | (SEQ ID NO: 12043) |
| C5-3863 | 21 nt Target: 5'-AGUCAUCAAAUGGCUAUCAGA-3' | (SEQ ID NO: 12044) |
| C5-3864 | 21 nt Target: 5'-GUCAUCAAAUGGCUAUCAGAA-3' | (SEQ ID NO: 12045) |
| C5-3865 | 21 nt Target: 5'-UCAUCAAAUGGCUAUCAGAAG-3' | (SEQ ID NO: 12046) |
| C5-3866 | 21 nt Target: 5'-CAUCAAAUGGCUAUCAGAAGA-3' | (SEQ ID NO: 12047) |
| C5-3867 | 21 nt Target: 5'-AUCAAAUGGCUAUCAGAAGAG-3' | (SEQ ID NO: 12048) |
| C5-3868 | 21 nt Target: 5'-UCAAAUGGCUAUCAGAAGAGC-3' | (SEQ ID NO: 12049) |
| C5-3869 | 21 nt Target: 5'-CAAAUGGCUAUCAGAAGAGCA-3' | (SEQ ID NO: 12050) |
| C5-3870 | 21 nt Target: 5'-AAAUGGCUAUCAGAAGAGCAG-3' | (SEQ ID NO: 12051) |
| C5-3871 | 21 nt Target: 5'-AAUGGCUAUCAGAAGAGCAGA-3' | (SEQ ID NO: 12052) |
| C5-3872 | 21 nt Target: 5'-AUGGCUAUCAGAAGAGCAGAG-3' | (SEQ ID NO: 12053) |

TABLE 8-continued

DsiRNA Target Sequences (21 mers) of Human Anti-C5
DsiRNAs Predicted to have > 50% Knockdown Efficacy

| | | |
|---|---|---|
| C5-3873 | 21 nt Target: 5'-UGGCUAUCAGAAGAGCAGAGG-3' | (SEQ ID NO: 12054) |
| C5-3874 | 21 nt Target: 5'-GGCUAUCAGAAGAGCAGAGGU-3' | (SEQ ID NO: 12055) |
| C5-3875 | 21 nt Target: 5'-GCUAUCAGAAGAGCAGAGGUA-3' | (SEQ ID NO: 12056) |
| C5-3876 | 21 nt Target: 5'-CUAUCAGAAGAGCAGAGGUAU-3' | (SEQ ID NO: 12057) |
| C5-3877 | 21 nt Target: 5'-UAUCAGAAGAGCAGAGGUAUG-3' | (SEQ ID NO: 12058) |
| C5-3878 | 21 nt Target: 5'-AUCAGAAGAGCAGAGGUAUGG-3' | (SEQ ID NO: 12059) |
| C5-3879 | 21 nt Target: 5'-UCAGAAGAGCAGAGGUAUGGA-3' | (SEQ ID NO: 12060) |
| C5-3882 | 21 nt Target: 5'-GAAGAGCAGAGGUAUGGAGGU-3' | (SEQ ID NO: 12061) |
| C5-3883 | 21 nt Target: 5'-AAGAGCAGAGGUAUGGAGGUG-3' | (SEQ ID NO: 12062) |
| C5-3884 | 21 nt Target: 5'-AGAGCAGAGGUAUGGAGGUGG-3' | (SEQ ID NO: 12063) |
| C5-3885 | 21 nt Target: 5'-GAGCAGAGGUAUGGAGGUGGC-3' | (SEQ ID NO: 12064) |
| C5-3886 | 21 nt Target: 5'-AGCAGAGGUAUGGAGGUGGCU-3' | (SEQ ID NO: 12065) |
| C5-3887 | 21 nt Target: 5'-GCAGAGGUAUGGAGGUGGCUU-3' | (SEQ ID NO: 12066) |
| C5-3888 | 21 nt Target: 5'-CAGAGGUAUGGAGGUGGCUUU-3' | (SEQ ID NO: 12067) |
| C5-3889 | 21 nt Target: 5'-AGAGGUAUGGAGGUGGCUUUU-3' | (SEQ ID NO: 12068) |
| C5-3890 | 21 nt Target: 5'-GAGGUAUGGAGGUGGCUUUUA-3' | (SEQ ID NO: 12069) |
| C5-3891 | 21 nt Target: 5'-AGGUAUGGAGGUGGCUUUUAU-3' | (SEQ ID NO: 12070) |
| C5-3892 | 21 nt Target: 5'-GGUAUGGAGGUGGCUUUUAUU-3' | (SEQ ID NO: 12071) |
| C5-3893 | 21 nt Target: 5'-GUAUGGAGGUGGCUUUUAUUC-3' | (SEQ ID NO: 12072) |
| C5-3894 | 21 nt Target: 5'-UAUGGAGGUGGCUUUUAUUCA-3' | (SEQ ID NO: 12073) |
| C5-3895 | 21 nt Target: 5'-AUGGAGGUGGCUUUUAUUCAA-3' | (SEQ ID NO: 12074) |
| C5-3896 | 21 nt Target: 5'-UGGAGGUGGCUUUUAUUCAAC-3' | (SEQ ID NO: 12075) |
| C5-3897 | 21 nt Target: 5'-GGAGGUGGCUUUUAUUCAACC-3' | (SEQ ID NO: 12076) |
| C5-3898 | 21 nt Target: 5'-GAGGUGGCUUUUAUUCAACCC-3' | (SEQ ID NO: 12077) |
| C5-3899 | 21 nt Target: 5'-AGGUGGCUUUUAUUCAACCCA-3' | (SEQ ID NO: 12078) |
| C5-3950 | 21 nt Target: 5'-GGAAUAUUCACUCCUGGUUAA-3' | (SEQ ID NO: 12079) |
| C5-3951 | 21 nt Target: 5'-GAAUAUUCACUCCUGGUUAAA-3' | (SEQ ID NO: 12080) |
| C5-3952 | 21 nt Target: 5'-AAUAUUCACUCCUGGUUAAAC-3' | (SEQ ID NO: 12081) |
| C5-3953 | 21 nt Target: 5'-AUAUUCACUCCUGGUUAAACA-3' | (SEQ ID NO: 12082) |
| C5-4020 | 21 nt Target: 5'-GCCUUACAUAAUUAUAAAAUG-3' | (SEQ ID NO: 12083) |
| C5-4021 | 21 nt Target: 5'-CCUUACAUAAUUAUAAAAUGA-3' | (SEQ ID NO: 12084) |
| C5-4022 | 21 nt Target: 5'-CUUACAUAAUUAUAAAAUGAC-3' | (SEQ ID NO: 12085) |
| C5-4023 | 21 nt Target: 5'-UUACAUAAUUAUAAAAUGACA-3' | (SEQ ID NO: 12086) |
| C5-4024 | 21 nt Target: 5'-UACAUAAUUAUAAAAUGACAG-3' | (SEQ ID NO: 12087) |
| C5-4025 | 21 nt Target: 5'-ACAUAAUUAUAAAAUGACAGA-3' | (SEQ ID NO: 12088) |
| C5-4026 | 21 nt Target: 5'-CAUAAUUAUAAAAUGACAGAC-3' | (SEQ ID NO: 12089) |
| C5-4027 | 21 nt Target: 5'-AUAAUUAUAAAAUGACAGACA-3' | (SEQ ID NO: 12090) |
| C5-4028 | 21 nt Target: 5'-UAAUUAUAAAAUGACAGACAA-3' | (SEQ ID NO: 12091) |

TABLE 8-continued

DsiRNA Target Sequences (21 mers) of Human Anti-C5
DsiRNAs Predicted to have > 50% Knockdown Efficacy

| | | |
|---|---|---|
| C5-4029 | 21 nt Target: 5'-AAUUAUAAAAUGACAGACAAG-3' | (SEQ ID NO: 12092) |
| C5-4030 | 21 nt Target: 5'-AUUAUAAAAUGACAGACAAGA-3' | (SEQ ID NO: 12093) |
| C5-4031 | 21 nt Target: 5'-UUAUAAAAUGACAGACAAGAA-3' | (SEQ ID NO: 12094) |
| C5-4032 | 21 nt Target: 5'-UAUAAAAUGACAGACAAGAAU-3' | (SEQ ID NO: 12095) |
| C5-4033 | 21 nt Target: 5'-AUAAAAUGACAGACAAGAAUU-3' | (SEQ ID NO: 12096) |
| C5-4034 | 21 nt Target: 5'-UAAAAUGACAGACAAGAAUUU-3' | (SEQ ID NO: 12097) |
| C5-4035 | 21 nt Target: 5'-AAAAUGACAGACAAGAAUUUC-3' | (SEQ ID NO: 12098) |
| C5-4036 | 21 nt Target: 5'-AAAUGACAGACAAGAAUUUCC-3' | (SEQ ID NO: 12099) |
| C5-4037 | 21 nt Target: 5'-AAUGACAGACAAGAAUUUCCU-3' | (SEQ ID NO: 12100) |
| C5-4038 | 21 nt Target: 5'-AUGACAGACAAGAAUUUCCUU-3' | (SEQ ID NO: 12101) |
| C5-4039 | 21 nt Target: 5'-UGACAGACAAGAAUUUCCUUG-3' | (SEQ ID NO: 12102) |
| C5-4040 | 21 nt Target: 5'-GACAGACAAGAAUUUCCUUGG-3' | (SEQ ID NO: 12103) |
| C5-4041 | 21 nt Target: 5'-ACAGACAAGAAUUUCCUUGGG-3' | (SEQ ID NO: 12104) |
| C5-4042 | 21 nt Target: 5'-CAGACAAGAAUUUCCUUGGGA-3' | (SEQ ID NO: 12105) |
| C5-4043 | 21 nt Target: 5'-AGACAAGAAUUUCCUUGGGAG-3' | (SEQ ID NO: 12106) |
| C5-4044 | 21 nt Target: 5'-GACAAGAAUUUCCUUGGGAGG-3' | (SEQ ID NO: 12107) |
| C5-4045 | 21 nt Target: 5'-ACAAGAAUUUCCUUGGGAGGC-3' | (SEQ ID NO: 12108) |
| C5-4046 | 21 nt Target: 5'-CAAGAAUUUCCUUGGGAGGCC-3' | (SEQ ID NO: 12109) |
| C5-4047 | 21 nt Target: 5'-AAGAAUUUCCUUGGGAGGCCA-3' | (SEQ ID NO: 12110) |
| C5-4054 | 21 nt Target: 5'-UCCUUGGGAGGCCAGUAGAGG-3' | (SEQ ID NO: 12111) |
| C5-4057 | 21 nt Target: 5'-UUGGGAGGCCAGUAGAGGUGC-3' | (SEQ ID NO: 12112) |
| C5-4058 | 21 nt Target: 5'-UGGGAGGCCAGUAGAGGUGCU-3' | (SEQ ID NO: 12113) |
| C5-4059 | 21 nt Target: 5'-GGGAGGCCAGUAGAGGUGCUU-3' | (SEQ ID NO: 12114) |
| C5-4060 | 21 nt Target: 5'-GGAGGCCAGUAGAGGUGCUUC-3' | (SEQ ID NO: 12115) |
| C5-4061 | 21 nt Target: 5'-GAGGCCAGUAGAGGUGCUUCU-3' | (SEQ ID NO: 12116) |
| C5-4062 | 21 nt Target: 5'-AGGCCAGUAGAGGUGCUUCUC-3' | (SEQ ID NO: 12117) |
| C5-4063 | 21 nt Target: 5'-GGCCAGUAGAGGUGCUUCUCA-3' | (SEQ ID NO: 12118) |
| C5-4064 | 21 nt Target: 5'-GCCAGUAGAGGUGCUUCUCAA-3' | (SEQ ID NO: 12119) |
| C5-4065 | 21 nt Target: 5'-CCAGUAGAGGUGCUUCUCAAU-3' | (SEQ ID NO: 12120) |
| C5-4066 | 21 nt Target: 5'-CAGUAGAGGUGCUUCUCAAUG-3' | (SEQ ID NO: 12121) |
| C5-4067 | 21 nt Target: 5'-AGUAGAGGUGCUUCUCAAUGA-3' | (SEQ ID NO: 12122) |
| C5-4068 | 21 nt Target: 5'-GUAGAGGUGCUUCUCAAUGAU-3' | (SEQ ID NO: 12123) |
| C5-4069 | 21 nt Target: 5'-UAGAGGUGCUUCUCAAUGAUG-3' | (SEQ ID NO: 12124) |
| C5-4070 | 21 nt Target: 5'-AGAGGUGCUUCUCAAUGAUGA-3' | (SEQ ID NO: 12125) |
| C5-4071 | 21 nt Target: 5'-GAGGUGCUUCUCAAUGAUGAC-3' | (SEQ ID NO: 12126) |
| C5-4072 | 21 nt Target: 5'-AGGUGCUUCUCAAUGAUGACC-3' | (SEQ ID NO: 12127) |
| C5-4073 | 21 nt Target: 5'-GGUGCUUCUCAAUGAUGACCU-3' | (SEQ ID NO: 12128) |
| C5-4074 | 21 nt Target: 5'-GUGCUUCUCAAUGAUGACCUC-3' | (SEQ ID NO: 12129) |
| C5-4094 | 21 nt Target: 5'-CAUUGUCAGUACAGGAUUUGG-3' | (SEQ ID NO: 12130) |

TABLE 8-continued

| DsiRNA Target Sequences (21 mers) of Human Anti-C5 DsiRNAs Predicted to have > 50% Knockdown Efficacy |
|---|
| C5-4095 21 nt Target: 5'-AUUGUCAGUACAGGAUUUGGC-3' (SEQ ID NO: 12131) |
| C5-4096 21 nt Target: 5'-UUGUCAGUACAGGAUUUGGCA-3' (SEQ ID NO: 12132) |
| C5-4097 21 nt Target: 5'-UGUCAGUACAGGAUUUGGCAG-3' (SEQ ID NO: 12133) |
| C5-4098 21 nt Target: 5'-GUCAGUACAGGAUUUGGCAGU-3' (SEQ ID NO: 12134) |
| C5-4099 21 nt Target: 5'-UCAGUACAGGAUUUGGCAGUG-3' (SEQ ID NO: 12135) |
| C5-4100 21 nt Target: 5'-CAGUACAGGAUUUGGCAGUGG-3' (SEQ ID NO: 12136) |
| C5-4101 21 nt Target: 5'-AGUACAGGAUUUGGCAGUGGC-3' (SEQ ID NO: 12137) |
| C5-4102 21 nt Target: 5'-GUACAGGAUUUGGCAGUGGCU-3' (SEQ ID NO: 12138) |
| C5-4103 21 nt Target: 5'-UACAGGAUUUGGCAGUGGCUU-3' (SEQ ID NO: 12139) |
| C5-4104 21 nt Target: 5'-ACAGGAUUUGGCAGUGGCUUG-3' (SEQ ID NO: 12140) |
| C5-4106 21 nt Target: 5'-AGGAUUUGGCAGUGGCUUGGC-3' (SEQ ID NO: 12141) |
| C5-4107 21 nt Target: 5'-GGAUUUGGCAGUGGCUUGGCU-3' (SEQ ID NO: 12142) |
| C5-4108 21 nt Target: 5'-GAUUUGGCAGUGGCUUGGCUA-3' (SEQ ID NO: 12143) |
| C5-4109 21 nt Target: 5'-AUUUGGCAGUGGCUUGGCUAC-3' (SEQ ID NO: 12144) |
| C5-4129 21 nt Target: 5'-CAGUACAUGUAACAACUGUAG-3' (SEQ ID NO: 12145) |
| C5-4130 21 nt Target: 5'-AGUACAUGUAACAACUGUAGU-3' (SEQ ID NO: 12146) |
| C5-4131 21 nt Target: 5'-GUACAUGUAACAACUGUAGUU-3' (SEQ ID NO: 12147) |
| C5-4133 21 nt Target: 5'-ACAUGUAACAACUGUAGUUCA-3' (SEQ ID NO: 12148) |
| C5-4134 21 nt Target: 5'-CAUGUAACAACUGUAGUUCAC-3' (SEQ ID NO: 12149) |
| C5-4135 21 nt Target: 5'-AUGUAACAACUGUAGUUCACA-3' (SEQ ID NO: 12150) |
| C5-4136 21 nt Target: 5'-UGUAACAACUGUAGUUCACAA-3' (SEQ ID NO: 12151) |
| C5-4137 21 nt Target: 5'-GUAACAACUGUAGUUCACAAA-3' (SEQ ID NO: 12152) |
| C5-4138 21 nt Target: 5'-UAACAACUGUAGUUCACAAAA-3' (SEQ ID NO: 12153) |
| C5-4139 21 nt Target: 5'-AACAACUGUAGUUCACAAAAC-3' (SEQ ID NO: 12154) |
| C5-4140 21 nt Target: 5'-ACAACUGUAGUUCACAAAACC-3' (SEQ ID NO: 12155) |
| C5-4141 21 nt Target: 5'-CAACUGUAGUUCACAAAACCA-3' (SEQ ID NO: 12156) |
| C5-4142 21 nt Target: 5'-AACUGUAGUUCACAAAACCAG-3' (SEQ ID NO: 12157) |
| C5-4143 21 nt Target: 5'-ACUGUAGUUCACAAAACCAGU-3' (SEQ ID NO: 12158) |
| C5-4144 21 nt Target: 5'-CUGUAGUUCACAAAACCAGUA-3' (SEQ ID NO: 12159) |
| C5-4145 21 nt Target: 5'-UGUAGUUCACAAAACCAGUAC-3' (SEQ ID NO: 12160) |
| C5-4146 21 nt Target: 5'-GUAGUUCACAAAACCAGUACC-3' (SEQ ID NO: 12161) |
| C5-4147 21 nt Target: 5'-UAGUUCACAAAACCAGUACCU-3' (SEQ ID NO: 12162) |
| C5-4148 21 nt Target: 5'-AGUUCACAAAACCAGUACCUC-3' (SEQ ID NO: 12163) |
| C5-4149 21 nt Target: 5'-GUUCACAAAACCAGUACCUCU-3' (SEQ ID NO: 12164) |
| C5-4150 21 nt Target: 5'-UUCACAAAACCAGUACCUCUG-3' (SEQ ID NO: 12165) |
| C5-4151 21 nt Target: 5'-UCACAAAACCAGUACCUCUGA-3' (SEQ ID NO: 12166) |
| C5-4152 21 nt Target: 5'-CACAAAACCAGUACCUCUGAG-3' (SEQ ID NO: 12167) |
| C5-4153 21 nt Target: 5'-ACAAAACCAGUACCUCUGAGG-3' (SEQ ID NO: 12168) |

TABLE 8-continued

DsiRNA Target Sequences (21 mers) of Human Anti-C5
DsiRNAs Predicted to have > 50% Knockdown Efficacy

| | | |
|---|---|---|
| C5-4154 | 21 nt Target: 5'-CAAAACCAGUACCUCUGAGGA-3' | (SEQ ID NO: 12169) |
| C5-4155 | 21 nt Target: 5'-AAAACCAGUACCUCUGAGGAA-3' | (SEQ ID NO: 12170) |
| C5-4156 | 21 nt Target: 5'-AAACCAGUACCUCUGAGGAAG-3' | (SEQ ID NO: 12171) |
| C5-4157 | 21 nt Target: 5'-AACCAGUACCUCUGAGGAAGU-3' | (SEQ ID NO: 12172) |
| C5-4158 | 21 nt Target: 5'-ACCAGUACCUCUGAGGAAGUU-3' | (SEQ ID NO: 12173) |
| C5-4159 | 21 nt Target: 5'-CCAGUACCUCUGAGGAAGUUU-3' | (SEQ ID NO: 12174) |
| C5-4160 | 21 nt Target: 5'-CAGUACCUCUGAGGAAGUUUG-3' | (SEQ ID NO: 12175) |
| C5-4161 | 21 nt Target: 5'-AGUACCUCUGAGGAAGUUUGC-3' | (SEQ ID NO: 12176) |
| C5-4162 | 21 nt Target: 5'-GUACCUCUGAGGAAGUUUGCA-3' | (SEQ ID NO: 12177) |
| C5-4163 | 21 nt Target: 5'-UACCUCUGAGGAAGUUUGCAG-3' | (SEQ ID NO: 12178) |
| C5-4164 | 21 nt Target: 5'-ACCUCUGAGGAAGUUUGCAGC-3' | (SEQ ID NO: 12179) |
| C5-4165 | 21 nt Target: 5'-CCUCUGAGGAAGUUUGCAGCU-3' | (SEQ ID NO: 12180) |
| C5-4166 | 21 nt Target: 5'-CUCUGAGGAAGUUUGCAGCUU-3' | (SEQ ID NO: 12181) |
| C5-4167 | 21 nt Target: 5'-UCUGAGGAAGUUUGCAGCUUU-3' | (SEQ ID NO: 12182) |
| C5-4176 | 21 nt Target: 5'-GUUUGCAGCUUUUAUUUGAAA-3' | (SEQ ID NO: 12183) |
| C5-4177 | 21 nt Target: 5'-UUUGCAGCUUUUAUUUGAAAA-3' | (SEQ ID NO: 12184) |
| C5-4198 | 21 nt Target: 5'-UCGAUACUCAGGAUAUUGAAG-3' | (SEQ ID NO: 12185) |
| C5-4200 | 21 nt Target: 5'-GAUACUCAGGAUAUUGAAGCA-3' | (SEQ ID NO: 12186) |
| C5-4201 | 21 nt Target: 5'-AUACUCAGGAUAUUGAAGCAU-3' | (SEQ ID NO: 12187) |
| C5-4202 | 21 nt Target: 5'-UACUCAGGAUAUUGAAGCAUC-3' | (SEQ ID NO: 12188) |
| C5-4203 | 21 nt Target: 5'-ACUCAGGAUAUUGAAGCAUCC-3' | (SEQ ID NO: 12189) |
| C5-4205 | 21 nt Target: 5'-UCAGGAUAUUGAAGCAUCCCA-3' | (SEQ ID NO: 12190) |
| C5-4206 | 21 nt Target: 5'-CAGGAUAUUGAAGCAUCCCAC-3' | (SEQ ID NO: 12191) |
| C5-4207 | 21 nt Target: 5'-AGGAUAUUGAAGCAUCCCACU-3' | (SEQ ID NO: 12192) |
| C5-4208 | 21 nt Target: 5'-GGAUAUUGAAGCAUCCCACUA-3' | (SEQ ID NO: 12193) |
| C5-4209 | 21 nt Target: 5'-GAUAUUGAAGCAUCCCACUAC-3' | (SEQ ID NO: 12194) |
| C5-4210 | 21 nt Target: 5'-AUAUUGAAGCAUCCCACUACA-3' | (SEQ ID NO: 12195) |
| C5-4211 | 21 nt Target: 5'-UAUUGAAGCAUCCCACUACAG-3' | (SEQ ID NO: 12196) |
| C5-4212 | 21 nt Target: 5'-AUUGAAGCAUCCCACUACAGA-3' | (SEQ ID NO: 12197) |
| C5-4213 | 21 nt Target: 5'-UUGAAGCAUCCCACUACAGAG-3' | (SEQ ID NO: 12198) |
| C5-4214 | 21 nt Target: 5'-UGAAGCAUCCCACUACAGAGG-3' | (SEQ ID NO: 12199) |
| C5-4215 | 21 nt Target: 5'-GAAGCAUCCCACUACAGAGGC-3' | (SEQ ID NO: 12200) |
| C5-4216 | 21 nt Target: 5'-AAGCAUCCCACUACAGAGGCU-3' | (SEQ ID NO: 12201) |
| C5-4217 | 21 nt Target: 5'-AGCAUCCCACUACAGAGGCUA-3' | (SEQ ID NO: 12202) |
| C5-4218 | 21 nt Target: 5'-GCAUCCCACUACAGAGGCUAC-3' | (SEQ ID NO: 12203) |
| C5-4219 | 21 nt Target: 5'-CAUCCCACUACAGAGGCUACG-3' | (SEQ ID NO: 12204) |
| C5-4220 | 21 nt Target: 5'-AUCCCACUACAGAGGCUACGG-3' | (SEQ ID NO: 12205) |
| C5-4221 | 21 nt Target: 5'-UCCCACUACAGAGGCUACGGA-3' | (SEQ ID NO: 12206) |
| C5-4222 | 21 nt Target: 5'-CCCACUACAGAGGCUACGGAA-3' | (SEQ ID NO: 12207) |

TABLE 8-continued

DsiRNA Target Sequences (21 mers) of Human Anti-C5
DsiRNAs Predicted to have > 50% Knockdown Efficacy C5-4223    21 nt Target:  5'-CCACUACAGAGGCUACGGAAA-3'  (SEQ ID NO: 12208)

C5-4224    21 nt Target:  5'-CACUACAGAGGCUACGGAAAC-3'  (SEQ ID NO: 12209)

C5-4225    21 nt Target:  5'-ACUACAGAGGCUACGGAAACU-3'  (SEQ ID NO: 12210)

C5-4226    21 nt Target:  5'-CUACAGAGGCUACGGAAACUC-3'  (SEQ ID NO: 12211)

C5-4227    21 nt Target:  5'-UACAGAGGCUACGGAAACUCU-3'  (SEQ ID NO: 12212)

C5-4228    21 nt Target:  5'-ACAGAGGCUACGGAAACUCUG-3'  (SEQ ID NO: 12213)

C5-4229    21 nt Target:  5'-CAGAGGCUACGGAAACUCUGA-3'  (SEQ ID NO: 12214)

C5-4230    21 nt Target:  5'-AGAGGCUACGGAAACUCUGAU-3'  (SEQ ID NO: 12215)

C5-4231    21 nt Target:  5'-GAGGCUACGGAAACUCUGAUU-3'  (SEQ ID NO: 12216)

C5-4232    21 nt Target:  5'-AGGCUACGGAAACUCUGAUUA-3'  (SEQ ID NO: 12217)

C5-4233    21 nt Target:  5'-GGCUACGGAAACUCUGAUUAC-3'  (SEQ ID NO: 12218)

C5-4234    21 nt Target:  5'-GCUACGGAAACUCUGAUUACA-3'  (SEQ ID NO: 12219)

C5-4235    21 nt Target:  5'-CUACGGAAACUCUGAUUACAA-3'  (SEQ ID NO: 12220)

C5-4236    21 nt Target:  5'-UACGGAAACUCUGAUUACAAA-3'  (SEQ ID NO: 12221)

C5-4237    21 nt Target:  5'-ACGGAAACUCUGAUUACAAAC-3'  (SEQ ID NO: 12222)

C5-4238    21 nt Target:  5'-CGGAAACUCUGAUUACAAACG-3'  (SEQ ID NO: 12223)

C5-4239    21 nt Target:  5'-GGAAACUCUGAUUACAAACGC-3'  (SEQ ID NO: 12224)

C5-4240    21 nt Target:  5'-GAAACUCUGAUUACAAACGCA-3'  (SEQ ID NO: 12225)

C5-4241    21 nt Target:  5'-AAACUCUGAUUACAAACGCAU-3'  (SEQ ID NO: 12226)

C5-4242    21 nt Target:  5'-AACUCUGAUUACAAACGCAUA-3'  (SEQ ID NO: 12227)

C5-4243    21 nt Target:  5'-ACUCUGAUUACAAACGCAUAG-3'  (SEQ ID NO: 12228)

C5-4244    21 nt Target:  5'-CUCUGAUUACAAACGCAUAGU-3'  (SEQ ID NO: 12229)

C5-4245    21 nt Target:  5'-UCUGAUUACAAACGCAUAGUA-3'  (SEQ ID NO: 12230)

C5-4246    21 nt Target:  5'-CUGAUUACAAACGCAUAGUAG-3'  (SEQ ID NO: 12231)

C5-4247    21 nt Target:  5'-UGAUUACAAACGCAUAGUAGC-3'  (SEQ ID NO: 12232)

C5-4248    21 nt Target:  5'-GAUUACAAACGCAUAGUAGCA-3'  (SEQ ID NO: 12233)

C5-4249    21 nt Target:  5'-AUUACAAACGCAUAGUAGCAU-3'  (SEQ ID NO: 12234)

C5-4250    21 nt Target:  5'-UUACAAACGCAUAGUAGCAUG-3'  (SEQ ID NO: 12235)

C5-4251    21 nt Target:  5'-UACAAACGCAUAGUAGCAUGU-3'  (SEQ ID NO: 12236)

C5-4252    21 nt Target:  5'-ACAAACGCAUAGUAGCAUGUG-3'  (SEQ ID NO: 12237)

C5-4253    21 nt Target:  5'-CAAACGCAUAGUAGCAUGUGC-3'  (SEQ ID NO: 12238)

C5-4254    21 nt Target:  5'-AAACGCAUAGUAGCAUGUGCC-3'  (SEQ ID NO: 12239)

C5-4255    21 nt Target:  5'-AACGCAUAGUAGCAUGUGCCA-3'  (SEQ ID NO: 12240)

C5-4256    21 nt Target:  5'-ACGCAUAGUAGCAUGUGCCAG-3'  (SEQ ID NO: 12241)

C5-4257    21 nt Target:  5'-CGCAUAGUAGCAUGUGCCAGC-3'  (SEQ ID NO: 12242)

C5-4258    21 nt Target:  5'-GCAUAGUAGCAUGUGCCAGCU-3'  (SEQ ID NO: 12243)

C5-4259    21 nt Target:  5'-CAUAGUAGCAUGUGCCAGCUA-3'  (SEQ ID NO: 12244)

C5-4260    21 nt Target:  5'-AUAGUAGCAUGUGCCAGCUAC-3'  (SEQ ID NO: 12245)

TABLE 8-continued

DsiRNA Target Sequences (21 mers) of Human Anti-C5
DsiRNAs Predicted to have > 50% Knockdown Efficacy

| ID | Target | |
|---|---|---|
| C5-4261 | 21 nt Target: 5'-UAGUAGCAUGUGCCAGCUACA-3' | (SEQ ID NO: 12246) |
| C5-4321 | 21 nt Target: 5'-CGGUGAUGGACAUCUCCUUGC-3' | (SEQ ID NO: 12247) |
| C5-4322 | 21 nt Target: 5'-GGUGAUGGACAUCUCCUUGCC-3' | (SEQ ID NO: 12248) |
| C5-4323 | 21 nt Target: 5'-GUGAUGGACAUCUCCUUGCCU-3' | (SEQ ID NO: 12249) |
| C5-4324 | 21 nt Target: 5'-UGAUGGACAUCUCCUUGCCUA-3' | (SEQ ID NO: 12250) |
| C5-4325 | 21 nt Target: 5'-GAUGGACAUCUCCUUGCCUAC-3' | (SEQ ID NO: 12251) |
| C5-4326 | 21 nt Target: 5'-AUGGACAUCUCCUUGCCUACU-3' | (SEQ ID NO: 12252) |
| C5-4327 | 21 nt Target: 5'-UGGACAUCUCCUUGCCUACUG-3' | (SEQ ID NO: 12253) |
| C5-4328 | 21 nt Target: 5'-GGACAUCUCCUUGCCUACUGG-3' | (SEQ ID NO: 12254) |
| C5-4329 | 21 nt Target: 5'-GACAUCUCCUUGCCUACUGGA-3' | (SEQ ID NO: 12255) |
| C5-4330 | 21 nt Target: 5'-ACAUCUCCUUGCCUACUGGAA-3' | (SEQ ID NO: 12256) |
| C5-4331 | 21 nt Target: 5'-CAUCUCCUUGCCUACUGGAAU-3' | (SEQ ID NO: 12257) |
| C5-4332 | 21 nt Target: 5'-AUCUCCUUGCCUACUGGAAUC-3' | (SEQ ID NO: 12258) |
| C5-4333 | 21 nt Target: 5'-UCUCCUUGCCUACUGGAAUCA-3' | (SEQ ID NO: 12259) |
| C5-4353 | 21 nt Target: 5'-AGUGCAAAUGAAGAAGACUUA-3' | (SEQ ID NO: 12260) |
| C5-4354 | 21 nt Target: 5'-GUGCAAAUGAAGAAGACUUAA-3' | (SEQ ID NO: 12261) |
| C5-4355 | 21 nt Target: 5'-UGCAAAUGAAGAAGACUUAAA-3' | (SEQ ID NO: 12262) |
| C5-4356 | 21 nt Target: 5'-GCAAAUGAAGAAGACUUAAAA-3' | (SEQ ID NO: 12263) |
| C5-4357 | 21 nt Target: 5'-CAAAUGAAGAAGACUUAAAAG-3' | (SEQ ID NO: 12264) |
| C5-4358 | 21 nt Target: 5'-AAAUGAAGAAGACUUAAAAGC-3' | (SEQ ID NO: 12265) |
| C5-4378 | 21 nt Target: 5'-CCCUUGUGGAAGGGGUGGAUC-3' | (SEQ ID NO: 12266) |
| C5-4379 | 21 nt Target: 5'-CCUUGUGGAAGGGGUGGAUCA-3' | (SEQ ID NO: 12267) |
| C5-4399 | 21 nt Target: 5'-AACUAUUCACUGAUUACCAAA-3' | (SEQ ID NO: 12268) |
| C5-4400 | 21 nt Target: 5'-ACUAUUCACUGAUUACCAAAU-3' | (SEQ ID NO: 12269) |
| C5-4420 | 21 nt Target: 5'-UCAAAGAUGGACAUGUUAUUC-3' | (SEQ ID NO: 12270) |
| C5-4421 | 21 nt Target: 5'-CAAAGAUGGACAUGUUAUUCU-3' | (SEQ ID NO: 12271) |
| C5-4422 | 21 nt Target: 5'-AAAGAUGGACAUGUUAUUCUG-3' | (SEQ ID NO: 12272) |
| C5-4425 | 21 nt Target: 5'-GAUGGACAUGUUAUUCUGCAA-3' | (SEQ ID NO: 12273) |
| C5-4427 | 21 nt Target: 5'-UGGACAUGUUAUUCUGCAACU-3' | (SEQ ID NO: 12274) |
| C5-4431 | 21 nt Target: 5'-CAUGUUAUUCUGCAACUGAAU-3' | (SEQ ID NO: 12275) |
| C5-4432 | 21 nt Target: 5'-AUGUUAUUCUGCAACUGAAUU-3' | (SEQ ID NO: 12276) |
| C5-4433 | 21 nt Target: 5'-UGUUAUUCUGCAACUGAAUUC-3' | (SEQ ID NO: 12277) |
| C5-4434 | 21 nt Target: 5'-GUUAUUCUGCAACUGAAUUCG-3' | (SEQ ID NO: 12278) |
| C5-4492 | 21 nt Target: 5'-UAUUUGAACUCUUUGAAGUUG-3' | (SEQ ID NO: 12279) |
| C5-4493 | 21 nt Target: 5'-AUUUGAACUCUUUGAAGUUGG-3' | (SEQ ID NO: 12280) |
| C5-4494 | 21 nt Target: 5'-UUUGAACUCUUUGAAGUUGGG-3' | (SEQ ID NO: 12281) |
| C5-4495 | 21 nt Target: 5'-UUGAACUCUUUGAAGUUGGGU-3' | (SEQ ID NO: 12282) |
| C5-4496 | 21 nt Target: 5'-UGAACUCUUUGAAGUUGGGUU-3' | (SEQ ID NO: 12283) |
| C5-4497 | 21 nt Target: 5'-GAACUCUUUGAAGUUGGGUUU-3' | (SEQ ID NO: 12284) |

TABLE 8-continued

| DsiRNA Target Sequences (21 mers) of Human Anti-C5 DsiRNAs Predicted to have > 50% Knockdown Efficacy |
|---|
| C5-4498 21 nt Target: 5'-AACUCUUUGAAGUUGGGUUUC-3' (SEQ ID NO: 12285) |
| C5-4499 21 nt Target: 5'-ACUCUUUGAAGUUGGGUUUCU-3' (SEQ ID NO: 12286) |
| C5-4519 21 nt Target: 5'-UCAGUCCUGCCACUUUCACAG-3' (SEQ ID NO: 12287) |
| C5-4520 21 nt Target: 5'-CAGUCCUGCCACUUUCACAGU-3' (SEQ ID NO: 12288) |
| C5-4521 21 nt Target: 5'-AGUCCUGCCACUUUCACAGUG-3' (SEQ ID NO: 12289) |
| C5-4522 21 nt Target: 5'-GUCCUGCCACUUUCACAGUGU-3' (SEQ ID NO: 12290) |
| C5-4523 21 nt Target: 5'-UCCUGCCACUUUCACAGUGUA-3' (SEQ ID NO: 12291) |
| C5-4543 21 nt Target: 5'-ACGAAUACCACAGACCAGAUA-3' (SEQ ID NO: 12292) |
| C5-4544 21 nt Target: 5'-CGAAUACCACAGACCAGAUAA-3' (SEQ ID NO: 12293) |
| C5-4545 21 nt Target: 5'-GAAUACCACAGACCAGAUAAA-3' (SEQ ID NO: 12294) |
| C5-4546 21 nt Target: 5'-AAUACCACAGACCAGAUAAAC-3' (SEQ ID NO: 12295) |
| C5-4547 21 nt Target: 5'-AUACCACAGACCAGAUAAACA-3' (SEQ ID NO: 12296) |
| C5-4548 21 nt Target: 5'-UACCACAGACCAGAUAAACAG-3' (SEQ ID NO: 12297) |
| C5-4549 21 nt Target: 5'-ACCACAGACCAGAUAAACAGU-3' (SEQ ID NO: 12298) |
| C5-4550 21 nt Target: 5'-CCACAGACCAGAUAAACAGUG-3' (SEQ ID NO: 12299) |
| C5-4551 21 nt Target: 5'-CACAGACCAGAUAAACAGUGU-3' (SEQ ID NO: 12300) |
| C5-4552 21 nt Target: 5'-ACAGACCAGAUAAACAGUGUA-3' (SEQ ID NO: 12301) |
| C5-4553 21 nt Target: 5'-CAGACCAGAUAAACAGUGUAC-3' (SEQ ID NO: 12302) |
| C5-4554 21 nt Target: 5'-AGACCAGAUAAACAGUGUACC-3' (SEQ ID NO: 12303) |
| C5-4555 21 nt Target: 5'-GACCAGAUAAACAGUGUACCA-3' (SEQ ID NO: 12304) |
| C5-4556 21 nt Target: 5'-ACCAGAUAAACAGUGUACCAU-3' (SEQ ID NO: 12305) |
| C5-4557 21 nt Target: 5'-CCAGAUAAACAGUGUACCAUG-3' (SEQ ID NO: 12306) |
| C5-4560 21 nt Target: 5'-GAUAAACAGUGUACCAUGUUU-3' (SEQ ID NO: 12307) |
| C5-4562 21 nt Target: 5'-UAAACAGUGUACCAUGUUUUA-3' (SEQ ID NO: 12308) |
| C5-4564 21 nt Target: 5'-AACAGUGUACCAUGUUUUAUA-3' (SEQ ID NO: 12309) |
| C5-4565 21 nt Target: 5'-ACAGUGUACCAUGUUUUAUAG-3' (SEQ ID NO: 12310) |
| C5-4566 21 nt Target: 5'-CAGUGUACCAUGUUUUAUAGC-3' (SEQ ID NO: 12311) |
| C5-4567 21 nt Target: 5'-AGUGUACCAUGUUUUAUAGCA-3' (SEQ ID NO: 12312) |
| C5-4568 21 nt Target: 5'-GUGUACCAUGUUUUAUAGCAC-3' (SEQ ID NO: 12313) |
| C5-4569 21 nt Target: 5'-UGUACCAUGUUUUAUAGCACU-3' (SEQ ID NO: 12314) |
| C5-4570 21 nt Target: 5'-GUACCAUGUUUUAUAGCACUU-3' (SEQ ID NO: 12315) |
| C5-4571 21 nt Target: 5'-UACCAUGUUUUAUAGCACUUC-3' (SEQ ID NO: 12316) |
| C5-4572 21 nt Target: 5'-ACCAUGUUUUAUAGCACUUCC-3' (SEQ ID NO: 12317) |
| C5-4573 21 nt Target: 5'-CCAUGUUUUAUAGCACUUCCA-3' (SEQ ID NO: 12318) |
| C5-4574 21 nt Target: 5'-CAUGUUUUAUAGCACUUCCAA-3' (SEQ ID NO: 12319) |
| C5-4575 21 nt Target: 5'-AUGUUUUAUAGCACUUCCAAU-3' (SEQ ID NO: 12320) |
| C5-4576 21 nt Target: 5'-UGUUUUAUAGCACUUCCAAUA-3' (SEQ ID NO: 12321) |
| C5-4577 21 nt Target: 5'-GUUUUAUAGCACUUCCAAUAU-3' (SEQ ID NO: 12322) |

TABLE 8-continued

DsiRNA Target Sequences (21 mers) of Human Anti-C5
DsiRNAs Predicted to have > 50% Knockdown Efficacy

| | | |
|---|---|---|
| C5-4578 | 21 nt Target: 5'-UUUUAUAGCACUUCCAAUAUC-3' | (SEQ ID NO: 12323) |
| C5-4579 | 21 nt Target: 5'-UUUAUAGCACUUCCAAUAUCA-3' | (SEQ ID NO: 12324) |
| C5-4581 | 21 nt Target: 5'-UAUAGCACUUCCAAUAUCAAA-3' | (SEQ ID NO: 12325) |
| C5-4582 | 21 nt Target: 5'-AUAGCACUUCCAAUAUCAAAA-3' | (SEQ ID NO: 12326) |
| C5-4583 | 21 nt Target: 5'-UAGCACUUCCAAUAUCAAAAU-3' | (SEQ ID NO: 12327) |
| C5-4584 | 21 nt Target: 5'-AGCACUUCCAAUAUCAAAAUU-3' | (SEQ ID NO: 12328) |
| C5-4585 | 21 nt Target: 5'-GCACUUCCAAUAUCAAAAUUC-3' | (SEQ ID NO: 12329) |
| C5-4586 | 21 nt Target: 5'-CACUUCCAAUAUCAAAAUUCA-3' | (SEQ ID NO: 12330) |
| C5-4587 | 21 nt Target: 5'-ACUUCCAAUAUCAAAAUUCAG-3' | (SEQ ID NO: 12331) |
| C5-4588 | 21 nt Target: 5'-CUUCCAAUAUCAAAAUUCAGA-3' | (SEQ ID NO: 12332) |
| C5-4589 | 21 nt Target: 5'-UUCCAAUAUCAAAAUUCAGAA-3' | (SEQ ID NO: 12333) |
| C5-4590 | 21 nt Target: 5'-UCCAAUAUCAAAAUUCAGAAA-3' | (SEQ ID NO: 12334) |
| C5-4591 | 21 nt Target: 5'-CCAAUAUCAAAAUUCAGAAAG-3' | (SEQ ID NO: 12335) |
| C5-4592 | 21 nt Target: 5'-CAAUAUCAAAAUUCAGAAAGU-3' | (SEQ ID NO: 12336) |
| C5-4593 | 21 nt Target: 5'-AAUAUCAAAAUUCAGAAAGUC-3' | (SEQ ID NO: 12337) |
| C5-4594 | 21 nt Target: 5'-AUAUCAAAAUUCAGAAAGUCU-3' | (SEQ ID NO: 12338) |
| C5-4595 | 21 nt Target: 5'-UAUCAAAAUUCAGAAAGUCUG-3' | (SEQ ID NO: 12339) |
| C5-4596 | 21 nt Target: 5'-AUCAAAAUUCAGAAAGUCUGU-3' | (SEQ ID NO: 12340) |
| C5-4597 | 21 nt Target: 5'-UCAAAAUUCAGAAAGUCUGUG-3' | (SEQ ID NO: 12341) |
| C5-4598 | 21 nt Target: 5'-CAAAAUUCAGAAAGUCUGUGA-3' | (SEQ ID NO: 12342) |
| C5-4599 | 21 nt Target: 5'-AAAAUUCAGAAAGUCUGUGAA-3' | (SEQ ID NO: 12343) |
| C5-4600 | 21 nt Target: 5'-AAAUUCAGAAAGUCUGUGAAG-3' | (SEQ ID NO: 12344) |
| C5-4605 | 21 nt Target: 5'-CAGAAAGUCUGUGAAGGAGCC-3' | (SEQ ID NO: 12345) |
| C5-4637 | 21 nt Target: 5'-UGUAGAAGCUGAUUGUGGGCA-3' | (SEQ ID NO: 12346) |
| C5-4638 | 21 nt Target: 5'-GUAGAAGCUGAUUGUGGGCAA-3' | (SEQ ID NO: 12347) |
| C5-4639 | 21 nt Target: 5'-UAGAAGCUGAUUGUGGGCAAA-3' | (SEQ ID NO: 12348) |
| C5-4640 | 21 nt Target: 5'-AGAAGCUGAUUGUGGGCAAAU-3' | (SEQ ID NO: 12349) |
| C5-4641 | 21 nt Target: 5'-GAAGCUGAUUGUGGGCAAAUG-3' | (SEQ ID NO: 12350) |
| C5-4642 | 21 nt Target: 5'-AAGCUGAUUGUGGGCAAAUGC-3' | (SEQ ID NO: 12351) |
| C5-4643 | 21 nt Target: 5'-AGCUGAUUGUGGGCAAAUGCA-3' | (SEQ ID NO: 12352) |
| C5-4644 | 21 nt Target: 5'-GCUGAUUGUGGGCAAAUGCAG-3' | (SEQ ID NO: 12353) |
| C5-4664 | 21 nt Target: 5'-GGAAGAAUUGGAUCUGACAAU-3' | (SEQ ID NO: 12354) |
| C5-4665 | 21 nt Target: 5'-GAAGAAUUGGAUCUGACAAUC-3' | (SEQ ID NO: 12355) |
| C5-4666 | 21 nt Target: 5'-AAGAAUUGGAUCUGACAAUCU-3' | (SEQ ID NO: 12356) |
| C5-4667 | 21 nt Target: 5'-AGAAUUGGAUCUGACAAUCUC-3' | (SEQ ID NO: 12357) |
| C5-4668 | 21 nt Target: 5'-GAAUUGGAUCUGACAAUCUCU-3' | (SEQ ID NO: 12358) |
| C5-4669 | 21 nt Target: 5'-AAUUGGAUCUGACAAUCUCUG-3' | (SEQ ID NO: 12359) |
| C5-4670 | 21 nt Target: 5'-AUUGGAUCUGACAAUCUCUGC-3' | (SEQ ID NO: 12360) |
| C5-4671 | 21 nt Target: 5'-UUGGAUCUGACAAUCUCUGCA-3' | (SEQ ID NO: 12361) |

TABLE 8-continued

DsiRNA Target Sequences (21 mers) of Human Anti-C5
DsiRNAs Predicted to have > 50% Knockdown Efficacy C5-4672   21 nt Target:  5'-UGGAUCUGACAAUCUCUGCAG-3'  (SEQ ID NO: 12362)

C5-4673   21 nt Target:  5'-GGAUCUGACAAUCUCUGCAGA-3'  (SEQ ID NO: 12363)

C5-4674   21 nt Target:  5'-GAUCUGACAAUCUCUGCAGAG-3'  (SEQ ID NO: 12364)

C5-4675   21 nt Target:  5'-AUCUGACAAUCUCUGCAGAGA-3'  (SEQ ID NO: 12365)

C5-4676   21 nt Target:  5'-UCUGACAAUCUCUGCAGAGAC-3'  (SEQ ID NO: 12366)

C5-4696   21 nt Target:  5'-CAAGAAAACAAACAGCAUGUA-3'  (SEQ ID NO: 12367)

C5-4697   21 nt Target:  5'-AAGAAAACAAACAGCAUGUAA-3'  (SEQ ID NO: 12368)

C5-4722   21 nt Target:  5'-GAGAUUGCAUAUGCUUAUAAA-3'  (SEQ ID NO: 12369)

C5-4723   21 nt Target:  5'-AGAUUGCAUAUGCUUAUAAAG-3'  (SEQ ID NO: 12370)

C5-4724   21 nt Target:  5'-GAUUGCAUAUGCUUAUAAAGU-3'  (SEQ ID NO: 12371)

C5-4725   21 nt Target:  5'-AUUGCAUAUGCUUAUAAAGUU-3'  (SEQ ID NO: 12372)

C5-4726   21 nt Target:  5'-UUGCAUAUGCUUAUAAAGUUA-3'  (SEQ ID NO: 12373)

C5-4769   21 nt Target:  5'-AAAUGUUUUGUCAAGUACAA-3'  (SEQ ID NO: 12374)

C5-4770   21 nt Target:  5'-AAUGUUUUGUCAAGUACAAG-3'  (SEQ ID NO: 12375)

C5-4771   21 nt Target:  5'-AUGUUUUGUCAAGUACAAGG-3'  (SEQ ID NO: 12376)

C5-4772   21 nt Target:  5'-UGUUUUGUCAAGUACAAGGC-3'  (SEQ ID NO: 12377)

C5-4773   21 nt Target:  5'-GUUUUGUCAAGUACAAGGCA-3'  (SEQ ID NO: 12378)

C5-4774   21 nt Target:  5'-UUUUGUCAAGUACAAGGCAA-3'  (SEQ ID NO: 12379)

C5-4775   21 nt Target:  5'-UUUGUCAAGUACAAGGCAAC-3'  (SEQ ID NO: 12380)

C5-4776   21 nt Target:  5'-UUGUCAAGUACAAGGCAACC-3'  (SEQ ID NO: 12381)

C5-4777   21 nt Target:  5'-UGUCAAGUACAAGGCAACCC-3'  (SEQ ID NO: 12382)

C5-4778   21 nt Target:  5'-GUCAAGUACAAGGCAACCCU-3'  (SEQ ID NO: 12383)

C5-4779   21 nt Target:  5'-UCAAGUACAAGGCAACCCUU-3'  (SEQ ID NO: 12384)

C5-4780   21 nt Target:  5'-CAAGUACAAGGCAACCCUUC-3'  (SEQ ID NO: 12385)

C5-4781   21 nt Target:  5'-AAGUACAAGGCAACCCUUCU-3'  (SEQ ID NO: 12386)

C5-4782   21 nt Target:  5'-AGUACAAGGCAACCCUUCUG-3'  (SEQ ID NO: 12387)

C5-4783   21 nt Target:  5'-GUACAAGGCAACCCUUCUGG-3'  (SEQ ID NO: 12388)

C5-4784   21 nt Target:  5'-UACAAGGCAACCCUUCUGGA-3'  (SEQ ID NO: 12389)

C5-4785   21 nt Target:  5'-ACAAGGCAACCCUUCUGGAU-3'  (SEQ ID NO: 12390)

C5-4786   21 nt Target:  5'-CAAGGCAACCCUUCUGGAUA-3'  (SEQ ID NO: 12391)

C5-4787   21 nt Target:  5'-AAGGCAACCCUUCUGGAUAU-3'  (SEQ ID NO: 12392)

C5-4788   21 nt Target:  5'-AGGCAACCCUUCUGGAUAUC-3'  (SEQ ID NO: 12393)

C5-4789   21 nt Target:  5'-GGCAACCCUUCUGGAUAUCU-3'  (SEQ ID NO: 12394)

C5-4790   21 nt Target:  5'-GCAACCCUUCUGGAUAUCUA-3'  (SEQ ID NO: 12395)

C5-4791   21 nt Target:  5'-CAACCCUUCUGGAUAUCUAC-3'  (SEQ ID NO: 12396)

C5-4792   21 nt Target:  5'-AACCCUUCUGGAUAUCUACA-3'  (SEQ ID NO: 12397)

C5-4793   21 nt Target:  5'-ACCCUUCUGGAUAUCUACAA-3'  (SEQ ID NO: 12398)

C5-4794   21 nt Target:  5'-CCCUUCUGGAUAUCUACAAA-3'  (SEQ ID NO: 12399)

TABLE 8-continued

DsiRNA Target Sequences (21 mers) of Human Anti-C5
DsiRNAs Predicted to have > 50% Knockdown Efficacy

| | | |
|---|---|---|
| C5-4795 | 21 nt Target: 5'-CCCUUCUGGAUAUCUACAAAA-3' | (SEQ ID NO: 12400) |
| C5-4796 | 21 nt Target: 5'-CCUUCUGGAUAUCUACAAAAC-3' | (SEQ ID NO: 12401) |
| C5-4797 | 21 nt Target: 5'-CUUCUGGAUAUCUACAAAACU-3' | (SEQ ID NO: 12402) |
| C5-4798 | 21 nt Target: 5'-UUCUGGAUAUCUACAAAACUG-3' | (SEQ ID NO: 12403) |
| C5-4799 | 21 nt Target: 5'-UCUGGAUAUCUACAAAACUGG-3' | (SEQ ID NO: 12404) |
| C5-4800 | 21 nt Target: 5'-CUGGAUAUCUACAAAACUGGG-3' | (SEQ ID NO: 12405) |
| C5-4801 | 21 nt Target: 5'-UGGAUAUCUACAAAACUGGGG-3' | (SEQ ID NO: 12406) |
| C5-4802 | 21 nt Target: 5'-GGAUAUCUACAAAACUGGGGA-3' | (SEQ ID NO: 12407) |
| C5-4803 | 21 nt Target: 5'-GAUAUCUACAAAACUGGGGAA-3' | (SEQ ID NO: 12408) |
| C5-4804 | 21 nt Target: 5'-AUAUCUACAAAACUGGGGAAG-3' | (SEQ ID NO: 12409) |
| C5-4805 | 21 nt Target: 5'-UAUCUACAAAACUGGGGAAGC-3' | (SEQ ID NO: 12410) |
| C5-4806 | 21 nt Target: 5'-AUCUACAAAACUGGGGAAGCU-3' | (SEQ ID NO: 12411) |
| C5-4807 | 21 nt Target: 5'-UCUACAAAACUGGGGAAGCUG-3' | (SEQ ID NO: 12412) |
| C5-4808 | 21 nt Target: 5'-CUACAAAACUGGGGAAGCUGU-3' | (SEQ ID NO: 12413) |
| C5-4809 | 21 nt Target: 5'-UACAAAACUGGGGAAGCUGUU-3' | (SEQ ID NO: 12414) |
| C5-4810 | 21 nt Target: 5'-ACAAAACUGGGGAAGCUGUUG-3' | (SEQ ID NO: 12415) |
| C5-4811 | 21 nt Target: 5'-CAAAACUGGGGAAGCUGUUGC-3' | (SEQ ID NO: 12416) |
| C5-4812 | 21 nt Target: 5'-AAAACUGGGGAAGCUGUUGCU-3' | (SEQ ID NO: 12417) |
| C5-4813 | 21 nt Target: 5'-AAACUGGGGAAGCUGUUGCUG-3' | (SEQ ID NO: 12418) |
| C5-4814 | 21 nt Target: 5'-AACUGGGGAAGCUGUUGCUGA-3' | (SEQ ID NO: 12419) |
| C5-4849 | 21 nt Target: 5'-UUACCUUCAUUAAAAAGGUAA-3' | (SEQ ID NO: 12420) |
| C5-4850 | 21 nt Target: 5'-UACCUUCAUUAAAAAGGUAAC-3' | (SEQ ID NO: 12421) |
| C5-4851 | 21 nt Target: 5'-ACCUUCAUUAAAAAGGUAACC-3' | (SEQ ID NO: 12422) |
| C5-4852 | 21 nt Target: 5'-CCUUCAUUAAAAAGGUAACCU-3' | (SEQ ID NO: 12423) |
| C5-4853 | 21 nt Target: 5'-CUUCAUUAAAAAGGUAACCUG-3' | (SEQ ID NO: 12424) |
| C5-4891 | 21 nt Target: 5'-UAAAAGGAAGACAGUACUUAA-3' | (SEQ ID NO: 12425) |
| C5-4892 | 21 nt Target: 5'-AAAAGGAAGACAGUACUUAAU-3' | (SEQ ID NO: 12426) |
| C5-4893 | 21 nt Target: 5'-AAAGGAAGACAGUACUUAAUU-3' | (SEQ ID NO: 12427) |
| C5-4894 | 21 nt Target: 5'-AAGGAAGACAGUACUUAAUUA-3' | (SEQ ID NO: 12428) |
| C5-4895 | 21 nt Target: 5'-AGGAAGACAGUACUUAAUUAU-3' | (SEQ ID NO: 12429) |
| C5-4896 | 21 nt Target: 5'-GGAAGACAGUACUUAAUUAUG-3' | (SEQ ID NO: 12430) |
| C5-4897 | 21 nt Target: 5'-GAAGACAGUACUUAAUUAUGG-3' | (SEQ ID NO: 12431) |
| C5-4898 | 21 nt Target: 5'-AAGACAGUACUUAAUUAUGGG-3' | (SEQ ID NO: 12432) |
| C5-4927 | 21 nt Target: 5'-CCCUCCAGAUAAAAUACAAUU-3' | (SEQ ID NO: 12433) |
| C5-4928 | 21 nt Target: 5'-CCUCCAGAUAAAAUACAAUUU-3' | (SEQ ID NO: 12434) |
| C5-4930 | 21 nt Target: 5'-UCCAGAUAAAAUACAAUUUCA-3' | (SEQ ID NO: 12435) |
| C5-4950 | 21 nt Target: 5'-AGUUUCAGGUACAUCUACCCU-3' | (SEQ ID NO: 12436) |
| C5-4951 | 21 nt Target: 5'-GUUUCAGGUACAUCUACCCUU-3' | (SEQ ID NO: 12437) |
| C5-4952 | 21 nt Target: 5'-UUUCAGGUACAUCUACCCUUU-3' | (SEQ ID NO: 12438) |

TABLE 8-continued

| DsiRNA Target Sequences (21 mers) of Human Anti-C5 DsiRNAs Predicted to have > 50% Knockdown Efficacy |
|---|
| C5-4953 21 nt Target: 5'-UUCAGGUACAUCUACCCUUUA-3' (SEQ ID NO: 12439) |
| C5-4954 21 nt Target: 5'-UCAGGUACAUCUACCCUUUAG-3' (SEQ ID NO: 12440) |
| C5-4955 21 nt Target: 5'-CAGGUACAUCUACCCUUUAGA-3' (SEQ ID NO: 12441) |
| C5-4956 21 nt Target: 5'-AGGUACAUCUACCCUUUAGAU-3' (SEQ ID NO: 12442) |
| C5-4957 21 nt Target: 5'-GGUACAUCUACCCUUUAGAUU-3' (SEQ ID NO: 12443) |
| C5-4958 21 nt Target: 5'-GUACAUCUACCCUUUAGAUUC-3' (SEQ ID NO: 12444) |
| C5-4959 21 nt Target: 5'-UACAUCUACCCUUUAGAUUCC-3' (SEQ ID NO: 12445) |
| C5-4960 21 nt Target: 5'-ACAUCUACCCUUUAGAUUCCU-3' (SEQ ID NO: 12446) |
| C5-4961 21 nt Target: 5'-CAUCUACCCUUUAGAUUCCUU-3' (SEQ ID NO: 12447) |
| C5-4962 21 nt Target: 5'-AUCUACCCUUUAGAUUCCUUG-3' (SEQ ID NO: 12448) |
| C5-4963 21 nt Target: 5'-UCUACCCUUUAGAUUCCUUGA-3' (SEQ ID NO: 12449) |
| C5-4964 21 nt Target: 5'-CUACCCUUUAGAUUCCUUGAC-3' (SEQ ID NO: 12450) |
| C5-4965 21 nt Target: 5'-UACCCUUUAGAUUCCUUGACC-3' (SEQ ID NO: 12451) |
| C5-4966 21 nt Target: 5'-ACCCUUUAGAUUCCUUGACCU-3' (SEQ ID NO: 12452) |
| C5-4967 21 nt Target: 5'-CCCUUUAGAUUCCUUGACCUG-3' (SEQ ID NO: 12453) |
| C5-4968 21 nt Target: 5'-CCUUUAGAUUCCUUGACCUGG-3' (SEQ ID NO: 12454) |
| C5-4969 21 nt Target: 5'-CUUUAGAUUCCUUGACCUGGA-3' (SEQ ID NO: 12455) |
| C5-4970 21 nt Target: 5'-UUUAGAUUCCUUGACCUGGAU-3' (SEQ ID NO: 12456) |
| C5-4971 21 nt Target: 5'-UUAGAUUCCUUGACCUGGAUU-3' (SEQ ID NO: 12457) |
| C5-4972 21 nt Target: 5'-UAGAUUCCUUGACCUGGAUUG-3' (SEQ ID NO: 12458) |
| C5-4973 21 nt Target: 5'-AGAUUCCUUGACCUGGAUUGA-3' (SEQ ID NO: 12459) |
| C5-4974 21 nt Target: 5'-GAUUCCUUGACCUGGAUUGAA-3' (SEQ ID NO: 12460) |
| C5-4975 21 nt Target: 5'-AUUCCUUGACCUGGAUUGAAU-3' (SEQ ID NO: 12461) |
| C5-4976 21 nt Target: 5'-UUCCUUGACCUGGAUUGAAUA-3' (SEQ ID NO: 12462) |
| C5-4977 21 nt Target: 5'-UCCUUGACCUGGAUUGAAUAC-3' (SEQ ID NO: 12463) |
| C5-4978 21 nt Target: 5'-CCUUGACCUGGAUUGAAUACU-3' (SEQ ID NO: 12464) |
| C5-4979 21 nt Target: 5'-CUUGACCUGGAUUGAAUACUG-3' (SEQ ID NO: 12465) |
| C5-4980 21 nt Target: 5'-UUGACCUGGAUUGAAUACUGG-3' (SEQ ID NO: 12466) |
| C5-4981 21 nt Target: 5'-UGACCUGGAUUGAAUACUGGC-3' (SEQ ID NO: 12467) |
| C5-4982 21 nt Target: 5'-GACCUGGAUUGAAUACUGGCC-3' (SEQ ID NO: 12468) |
| C5-4983 21 nt Target: 5'-ACCUGGAUUGAAUACUGGCCU-3' (SEQ ID NO: 12469) |
| C5-4984 21 nt Target: 5'-CCUGGAUUGAAUACUGGCCUA-3' (SEQ ID NO: 12470) |
| C5-4985 21 nt Target: 5'-CUGGAUUGAAUACUGGCCUAG-3' (SEQ ID NO: 12471) |
| C5-5009 21 nt Target: 5'-CACAACAUGUUCAUCGUGUCA-3' (SEQ ID NO: 12472) |
| C5-5010 21 nt Target: 5'-ACAACAUGUUCAUCGUGUCAA-3' (SEQ ID NO: 12473) |
| C5-5011 21 nt Target: 5'-CAACAUGUUCAUCGUGUCAAG-3' (SEQ ID NO: 12474) |
| C5-5012 21 nt Target: 5'-AACAUGUUCAUCGUGUCAAGC-3' (SEQ ID NO: 12475) |
| C5-5014 21 nt Target: 5'-CAUGUUCAUCGUGUCAAGCAU-3' (SEQ ID NO: 12476) |

TABLE 8-continued

DsiRNA Target Sequences (21 mers) of Human Anti-C5
DsiRNAs Predicted to have > 50% Knockdown Efficacy

| ID | | |
|---|---|---|
| C5-5015 | 21 nt Target: 5'-AUGUUCAUCGUGUCAAGCAUU-3' | (SEQ ID NO: 12477) |
| C5-5016 | 21 nt Target: 5'-UGUUCAUCGUGUCAAGCAUUU-3' | (SEQ ID NO: 12478) |
| C5-5017 | 21 nt Target: 5'-GUUCAUCGUGUCAAGCAUUUU-3' | (SEQ ID NO: 12479) |
| C5-5019 | 21 nt Target: 5'-UCAUCGUGUCAAGCAUUUUUA-3' | (SEQ ID NO: 12480) |
| C5-5020 | 21 nt Target: 5'-CAUCGUGUCAAGCAUUUUUAG-3' | (SEQ ID NO: 12481) |
| C5-5021 | 21 nt Target: 5'-AUCGUGUCAAGCAUUUUUAGC-3' | (SEQ ID NO: 12482) |
| C5-5023 | 21 nt Target: 5'-CGUGUCAAGCAUUUUUAGCUA-3' | (SEQ ID NO: 12483) |
| C5-5024 | 21 nt Target: 5'-GUGUCAAGCAUUUUUAGCUAA-3' | (SEQ ID NO: 12484) |
| C5-5025 | 21 nt Target: 5'-UGUCAAGCAUUUUUAGCUAAU-3' | (SEQ ID NO: 12485) |
| C5-5026 | 21 nt Target: 5'-GUCAAGCAUUUUUAGCUAAUU-3' | (SEQ ID NO: 12486) |
| C5-5028 | 21 nt Target: 5'-CAAGCAUUUUUAGCUAAUUUA-3' | (SEQ ID NO: 12487) |
| C5-5029 | 21 nt Target: 5'-AAGCAUUUUUAGCUAAUUUAG-3' | (SEQ ID NO: 12488) |
| C5-5030 | 21 nt Target: 5'-AGCAUUUUUAGCUAAUUUAGA-3' | (SEQ ID NO: 12489) |
| C5-5031 | 21 nt Target: 5'-GCAUUUUUAGCUAAUUUAGAU-3' | (SEQ ID NO: 12490) |
| C5-5032 | 21 nt Target: 5'-CAUUUUUAGCUAAUUUAGAUG-3' | (SEQ ID NO: 12491) |
| C5-5033 | 21 nt Target: 5'-AUUUUUAGCUAAUUUAGAUGA-3' | (SEQ ID NO: 12492) |
| C5-5034 | 21 nt Target: 5'-UUUUUAGCUAAUUUAGAUGAA-3' | (SEQ ID NO: 12493) |
| C5-5035 | 21 nt Target: 5'-UUUUAGCUAAUUUAGAUGAAU-3' | (SEQ ID NO: 12494) |
| C5-5036 | 21 nt Target: 5'-UUUAGCUAAUUUAGAUGAAUU-3' | (SEQ ID NO: 12495) |
| C5-5037 | 21 nt Target: 5'-UUAGCUAAUUUAGAUGAAUUU-3' | (SEQ ID NO: 12496) |
| C5-5038 | 21 nt Target: 5'-UAGCUAAUUUAGAUGAAUUUG-3' | (SEQ ID NO: 12497) |
| C5-5039 | 21 nt Target: 5'-AGCUAAUUUAGAUGAAUUUGC-3' | (SEQ ID NO: 12498) |
| C5-5065 | 21 nt Target: 5'-AUAUCUUUUUAAAUGGAUGCU-3' | (SEQ ID NO: 12499) |
| C5-5066 | 21 nt Target: 5'-UAUCUUUUUAAAUGGAUGCUA-3' | (SEQ ID NO: 12500) |
| C5-5067 | 21 nt Target: 5'-AUCUUUUUAAAUGGAUGCUAA-3' | (SEQ ID NO: 12501) |
| C5-5068 | 21 nt Target: 5'-UCUUUUUAAAUGGAUGCUAAA-3' | (SEQ ID NO: 12502) |
| C5-5069 | 21 nt Target: 5'-CUUUUUAAAUGGAUGCUAAAA-3' | (SEQ ID NO: 12503) |
| C5-5070 | 21 nt Target: 5'-UUUUUAAAUGGAUGCUAAAAU-3' | (SEQ ID NO: 12504) |
| C5-5071 | 21 nt Target: 5'-UUUUAAAUGGAUGCUAAAAUU-3' | (SEQ ID NO: 12505) |
| C5-5072 | 21 nt Target: 5'-UUUAAAUGGAUGCUAAAAUUC-3' | (SEQ ID NO: 12506) |
| C5-5073 | 21 nt Target: 5'-UUAAAUGGAUGCUAAAAUUCC-3' | (SEQ ID NO: 12507) |
| C5-5074 | 21 nt Target: 5'-UAAAUGGAUGCUAAAAUUCCU-3' | (SEQ ID NO: 12508) |
| C5-5075 | 21 nt Target: 5'-AAAUGGAUGCUAAAAUUCCUG-3' | (SEQ ID NO: 12509) |
| C5-5077 | 21 nt Target: 5'-AUGGAUGCUAAAAUUCCUGAA-3' | (SEQ ID NO: 12510) |
| C5-5078 | 21 nt Target: 5'-UGGAUGCUAAAAUUCCUGAAG-3' | (SEQ ID NO: 12511) |
| C5-5079 | 21 nt Target: 5'-GGAUGCUAAAAUUCCUGAAGU-3' | (SEQ ID NO: 12512) |
| C5-5080 | 21 nt Target: 5'-GAUGCUAAAAUUCCUGAAGUU-3' | (SEQ ID NO: 12513) |
| C5-5081 | 21 nt Target: 5'-AUGCUAAAAUUCCUGAAGUUC-3' | (SEQ ID NO: 12514) |
| C5-5082 | 21 nt Target: 5'-UGCUAAAAUUCCUGAAGUUCA-3' | (SEQ ID NO: 12515) |

TABLE 8-continued

| DsiRNA Target Sequences (21 mers) of Human Anti-C5 DsiRNAs Predicted to have > 50% Knockdown Efficacy | | |
|---|---|---|
| C5-5083 | 21 nt Target: 5'-GCUAAAAUUCCUGAAGUUCAG-3' | (SEQ ID NO: 12516) |
| C5-5084 | 21 nt Target: 5'-CUAAAAUUCCUGAAGUUCAGC-3' | (SEQ ID NO: 12517) |
| C5-5085 | 21 nt Target: 5'-UAAAAUUCCUGAAGUUCAGCU-3' | (SEQ ID NO: 12518) |
| C5-5086 | 21 nt Target: 5'-AAAAUUCCUGAAGUUCAGCUG-3' | (SEQ ID NO: 12519) |
| C5-5087 | 21 nt Target: 5'-AAAUUCCUGAAGUUCAGCUGC-3' | (SEQ ID NO: 12520) |
| C5-5088 | 21 nt Target: 5'-AAUUCCUGAAGUUCAGCUGCA-3' | (SEQ ID NO: 12521) |
| C5-5089 | 21 nt Target: 5'-AUUCCUGAAGUUCAGCUGCAU-3' | (SEQ ID NO: 12522) |
| C5-5090 | 21 nt Target: 5'-UUCCUGAAGUUCAGCUGCAUA-3' | (SEQ ID NO: 12523) |
| C5-5091 | 21 nt Target: 5'-UCCUGAAGUUCAGCUGCAUAC-3' | (SEQ ID NO: 12524) |
| C5-5092 | 21 nt Target: 5'-CCUGAAGUUCAGCUGCAUACA-3' | (SEQ ID NO: 12525) |
| C5-5093 | 21 nt Target: 5'-CUGAAGUUCAGCUGCAUACAG-3' | (SEQ ID NO: 12526) |
| C5-5094 | 21 nt Target: 5'-UGAAGUUCAGCUGCAUACAGU-3' | (SEQ ID NO: 12527) |
| C5-5095 | 21 nt Target: 5'-GAAGUUCAGCUGCAUACAGUU-3' | (SEQ ID NO: 12528) |
| C5-5096 | 21 nt Target: 5'-AAGUUCAGCUGCAUACAGUUU-3' | (SEQ ID NO: 12529) |
| C5-5097 | 21 nt Target: 5'-AGUUCAGCUGCAUACAGUUUG-3' | (SEQ ID NO: 12530) |
| C5-5098 | 21 nt Target: 5'-GUUCAGCUGCAUACAGUUUGC-3' | (SEQ ID NO: 12531) |
| C5-5099 | 21 nt Target: 5'-UUCAGCUGCAUACAGUUUGCA-3' | (SEQ ID NO: 12532) |
| C5-5100 | 21 nt Target: 5'-UCAGCUGCAUACAGUUUGCAC-3' | (SEQ ID NO: 12533) |
| C5-5101 | 21 nt Target: 5'-CAGCUGCAUACAGUUUGCACU-3' | (SEQ ID NO: 12534) |
| C5-5102 | 21 nt Target: 5'-AGCUGCAUACAGUUUGCACUU-3' | (SEQ ID NO: 12535) |
| C5-5103 | 21 nt Target: 5'-GCUGCAUACAGUUUGCACUUA-3' | (SEQ ID NO: 12536) |
| C5-5104 | 21 nt Target: 5'-CUGCAUACAGUUUGCACUUAU-3' | (SEQ ID NO: 12537) |
| C5-5105 | 21 nt Target: 5'-UGCAUACAGUUUGCACUUAUG-3' | (SEQ ID NO: 12538) |
| C5-5106 | 21 nt Target: 5'-GCAUACAGUUUGCACUUAUGG-3' | (SEQ ID NO: 12539) |
| C5-5107 | 21 nt Target: 5'-CAUACAGUUUGCACUUAUGGA-3' | (SEQ ID NO: 12540) |
| C5-5108 | 21 nt Target: 5'-AUACAGUUUGCACUUAUGGAC-3' | (SEQ ID NO: 12541) |
| C5-5109 | 21 nt Target: 5'-UACAGUUUGCACUUAUGGACU-3' | (SEQ ID NO: 12542) |
| C5-5110 | 21 nt Target: 5'-ACAGUUUGCACUUAUGGACUC-3' | (SEQ ID NO: 12543) |
| C5-5111 | 21 nt Target: 5'-CAGUUUGCACUUAUGGACUCC-3' | (SEQ ID NO: 12544) |
| C5-5112 | 21 nt Target: 5'-AGUUUGCACUUAUGGACUCCU-3' | (SEQ ID NO: 12545) |
| C5-5113 | 21 nt Target: 5'-GUUUGCACUUAUGGACUCCUG-3' | (SEQ ID NO: 12546) |
| C5-5114 | 21 nt Target: 5'-UUUGCACUUAUGGACUCCUGU-3' | (SEQ ID NO: 12547) |
| C5-5115 | 21 nt Target: 5'-UUGCACUUAUGGACUCCUGUU-3' | (SEQ ID NO: 12548) |
| C5-5116 | 21 nt Target: 5'-UGCACUUAUGGACUCCUGUUG-3' | (SEQ ID NO: 12549) |
| C5-5117 | 21 nt Target: 5'-GCACUUAUGGACUCCUGUUGU-3' | (SEQ ID NO: 12550) |
| C5-5118 | 21 nt Target: 5'-CACUUAUGGACUCCUGUUGUU-3' | (SEQ ID NO: 12551) |
| C5-5119 | 21 nt Target: 5'-ACUUAUGGACUCCUGUUGUUG-3' | (SEQ ID NO: 12552) |
| C5-5120 | 21 nt Target: 5'-CUUAUGGACUCCUGUUGUUGA-3' | (SEQ ID NO: 12553) |

TABLE 8-continued

| DsiRNA Target Sequences (21 mers) of Human Anti-C5 DsiRNAs Predicted to have > 50% Knockdown Efficacy | | |
|---|---|---|
| C5-5122 | 21 nt Target: 5'-UAUGGACUCCUGUUGUUGAAG-3' | (SEQ ID NO: 12554) |
| C5-5178 | 21 nt Target: 5'-AUAGCUGGUCUUAUUUGUAAA-3' | (SEQ ID NO: 12555) |
| C5-5179 | 21 nt Target: 5'-UAGCUGGUCUUAUUUGUAAAG-3' | (SEQ ID NO: 12556) |
| C5-5180 | 21 nt Target: 5'-AGCUGGUCUUAUUUGUAAAGC-3' | (SEQ ID NO: 12557) |
| C5-5181 | 21 nt Target: 5'-GCUGGUCUUAUUUGUAAAGCU-3' | (SEQ ID NO: 12558) |
| C5-5182 | 21 nt Target: 5'-CUGGUCUUAUUUGUAAAGCUC-3' | (SEQ ID NO: 12559) |
| C5-5183 | 21 nt Target: 5'-UGGUCUUAUUUGUAAAGCUCA-3' | (SEQ ID NO: 12560) |
| C5-5184 | 21 nt Target: 5'-GGUCUUAUUUGUAAAGCUCAC-3' | (SEQ ID NO: 12561) |
| C5-5185 | 21 nt Target: 5'-GUCUUAUUUGUAAAGCUCACU-3' | (SEQ ID NO: 12562) |
| C5-5186 | 21 nt Target: 5'-UCUUAUUUGUAAAGCUCACUU-3' | (SEQ ID NO: 12563) |
| C5-5187 | 21 nt Target: 5'-CUUAUUUGUAAAGCUCACUUU-3' | (SEQ ID NO: 12564) |
| C5-5188 | 21 nt Target: 5'-UUAUUUGUAAAGCUCACUUUA-3' | (SEQ ID NO: 12565) |
| C5-5189 | 21 nt Target: 5'-UAUUUGUAAAGCUCACUUUAC-3' | (SEQ ID NO: 12566) |
| C5-5190 | 21 nt Target: 5'-AUUUGUAAAGCUCACUUUACU-3' | (SEQ ID NO: 12567) |
| C5-5191 | 21 nt Target: 5'-UUUGUAAAGCUCACUUUACUU-3' | (SEQ ID NO: 12568) |
| C5-5192 | 21 nt Target: 5'-UUGUAAAGCUCACUUUACUUA-3' | (SEQ ID NO: 12569) |
| C5-5193 | 21 nt Target: 5'-UGUAAAGCUCACUUUACUUAG-3' | (SEQ ID NO: 12570) |
| C5-5194 | 21 nt Target: 5'-GUAAAGCUCACUUUACUUAGA-3' | (SEQ ID NO: 12571) |
| C5-5195 | 21 nt Target: 5'-UAAAGCUCACUUUACUUAGAA-3' | (SEQ ID NO: 12572) |
| C5-5196 | 21 nt Target: 5'-AAAGCUCACUUUACUUAGAAU-3' | (SEQ ID NO: 12573) |
| C5-5197 | 21 nt Target: 5'-AAGCUCACUUUACUUAGAAUU-3' | (SEQ ID NO: 12574) |
| C5-5198 | 21 nt Target: 5'-AGCUCACUUUACUUAGAAUUA-3' | (SEQ ID NO: 12575) |
| C5-5199 | 21 nt Target: 5'-GCUCACUUUACUUAGAAUUAG-3' | (SEQ ID NO: 12576) |
| C5-5200 | 21 nt Target: 5'-CUCACUUUACUUAGAAUUAGU-3' | (SEQ ID NO: 12577) |
| C5-5201 | 21 nt Target: 5'-UCACUUUACUUAGAAUUAGUG-3' | (SEQ ID NO: 12578) |
| C5-5202 | 21 nt Target: 5'-CACUUUACUUAGAAUUAGUGG-3' | (SEQ ID NO: 12579) |
| C5-5203 | 21 nt Target: 5'-ACUUUACUUAGAAUUAGUGGC-3' | (SEQ ID NO: 12580) |
| C5-5204 | 21 nt Target: 5'-CUUUACUUAGAAUUAGUGGCA-3' | (SEQ ID NO: 12581) |
| C5-5205 | 21 nt Target: 5'-UUUACUUAGAAUUAGUGGCAC-3' | (SEQ ID NO: 12582) |
| C5-5206 | 21 nt Target: 5'-UUACUUAGAAUUAGUGGCACU-3' | (SEQ ID NO: 12583) |
| C5-5207 | 21 nt Target: 5'-UACUUAGAAUUAGUGGCACUU-3' | (SEQ ID NO: 12584) |
| C5-5208 | 21 nt Target: 5'-ACUUAGAAUUAGUGGCACUUG-3' | (SEQ ID NO: 12585) |
| C5-5209 | 21 nt Target: 5'-CUUAGAAUUAGUGGCACUUGC-3' | (SEQ ID NO: 12586) |
| C5-5210 | 21 nt Target: 5'-UUAGAAUUAGUGGCACUUGCU-3' | (SEQ ID NO: 12587) |
| C5-5211 | 21 nt Target: 5'-UAGAAUUAGUGGCACUUGCUU-3' | (SEQ ID NO: 12588) |
| C5-5212 | 21 nt Target: 5'-AGAAUUAGUGGCACUUGCUUU-3' | (SEQ ID NO: 12589) |
| C5-5213 | 21 nt Target: 5'-GAAUUAGUGGCACUUGCUUUU-3' | (SEQ ID NO: 12590) |
| C5-5214 | 21 nt Target: 5'-AAUUAGUGGCACUUGCUUUUA-3' | (SEQ ID NO: 12591) |
| C5-5215 | 21 nt Target: 5'-AUUAGUGGCACUUGCUUUUAU-3' | (SEQ ID NO: 12592) |

TABLE 8-continued

DsiRNA Target Sequences (21 mers) of Human Anti-C5
DsiRNAs Predicted to have > 50% Knockdown Efficacy

| | | |
|---|---|---|
| C5-5216 | 21 nt Target: 5'-UUAGUGGCACUUGCUUUUAUU-3' | (SEQ ID NO: 12593) |
| C5-5217 | 21 nt Target: 5'-UAGUGGCACUUGCUUUUAUUA-3' | (SEQ ID NO: 12594) |
| C5-5218 | 21 nt Target: 5'-AGUGGCACUUGCUUUUAUUAG-3' | (SEQ ID NO: 12595) |
| C5-5219 | 21 nt Target: 5'-GUGGCACUUGCUUUUAUUAGA-3' | (SEQ ID NO: 12596) |
| C5-5220 | 21 nt Target: 5'-UGGCACUUGCUUUUAUUAGAG-3' | (SEQ ID NO: 12597) |
| C5-5221 | 21 nt Target: 5'-GGCACUUGCUUUUAUUAGAGA-3' | (SEQ ID NO: 12598) |
| C5-5222 | 21 nt Target: 5'-GCACUUGCUUUUAUUAGAGAA-3' | (SEQ ID NO: 12599) |
| C5-5223 | 21 nt Target: 5'-CACUUGCUUUUAUUAGAGAAU-3' | (SEQ ID NO: 12600) |
| C5-5228 | 21 nt Target: 5'-GCUUUUAUUAGAGAAUGAUUU-3' | (SEQ ID NO: 12601) |
| C5-5252 | 21 nt Target: 5'-AUGCUGUAACUUUCUGAAAUA-3' | (SEQ ID NO: 12602) |
| C5-5253 | 21 nt Target: 5'-UGCUGUAACUUUCUGAAAUAA-3' | (SEQ ID NO: 12603) |
| C5-5254 | 21 nt Target: 5'-GCUGUAACUUUCUGAAAUAAC-3' | (SEQ ID NO: 12604) |
| C5-5255 | 21 nt Target: 5'-CUGUAACUUUCUGAAAUAACA-3' | (SEQ ID NO: 12605) |
| C5-5256 | 21 nt Target: 5'-UGUAACUUUCUGAAAUAACAU-3' | (SEQ ID NO: 12606) |
| C5-5257 | 21 nt Target: 5'-GUAACUUUCUGAAAUAACAUG-3' | (SEQ ID NO: 12607) |
| C5-5258 | 21 nt Target: 5'-UAACUUUCUGAAAUAACAUGG-3' | (SEQ ID NO: 12608) |
| C5-5259 | 21 nt Target: 5'-AACUUUCUGAAAUAACAUGGC-3' | (SEQ ID NO: 12609) |
| C5-5260 | 21 nt Target: 5'-ACUUUCUGAAAUAACAUGGCC-3' | (SEQ ID NO: 12610) |
| C5-5261 | 21 nt Target: 5'-CUUUCUGAAAUAACAUGGCCU-3' | (SEQ ID NO: 12611) |
| C5-5262 | 21 nt Target: 5'-UUUCUGAAAUAACAUGGCCUU-3' | (SEQ ID NO: 12612) |
| C5-5263 | 21 nt Target: 5'-UUCUGAAAUAACAUGGCCUUG-3' | (SEQ ID NO: 12613) |
| C5-5264 | 21 nt Target: 5'-UCUGAAAUAACAUGGCCUUGG-3' | (SEQ ID NO: 12614) |
| C5-5265 | 21 nt Target: 5'-CUGAAAUAACAUGGCCUUGGA-3' | (SEQ ID NO: 12615) |
| C5-5266 | 21 nt Target: 5'-UGAAAUAACAUGGCCUUGGAG-3' | (SEQ ID NO: 12616) |
| C5-5267 | 21 nt Target: 5'-GAAAUAACAUGGCCUUGGAGG-3' | (SEQ ID NO: 12617) |
| C5-5268 | 21 nt Target: 5'-AAAUAACAUGGCCUUGGAGGG-3' | (SEQ ID NO: 12618) |
| C5-5269 | 21 nt Target: 5'-AAUAACAUGGCCUUGGAGGGC-3' | (SEQ ID NO: 12619) |
| C5-5270 | 21 nt Target: 5'-AUAACAUGGCCUUGGAGGGCA-3' | (SEQ ID NO: 12620) |
| C5-5271 | 21 nt Target: 5'-UAACAUGGCCUUGGAGGGCAU-3' | (SEQ ID NO: 12621) |
| C5-5272 | 21 nt Target: 5'-AACAUGGCCUUGGAGGGCAUG-3' | (SEQ ID NO: 12622) |
| C5-5273 | 21 nt Target: 5'-ACAUGGCCUUGGAGGGCAUGA-3' | (SEQ ID NO: 12623) |
| C5-5274 | 21 nt Target: 5'-CAUGGCCUUGGAGGGCAUGAA-3' | (SEQ ID NO: 12624) |
| C5-5275 | 21 nt Target: 5'-AUGGCCUUGGAGGGCAUGAAG-3' | (SEQ ID NO: 12625) |
| C5-5276 | 21 nt Target: 5'-UGGCCUUGGAGGGCAUGAAGA-3' | (SEQ ID NO: 12626) |
| C5-5277 | 21 nt Target: 5'-GGCCUUGGAGGGCAUGAAGAC-3' | (SEQ ID NO: 12627) |
| C5-5278 | 21 nt Target: 5'-GCCUUGGAGGGCAUGAAGACA-3' | (SEQ ID NO: 12628) |
| C5-5279 | 21 nt Target: 5'-CCUUGGAGGGCAUGAAGACAG-3' | (SEQ ID NO: 12629) |
| C5-5280 | 21 nt Target: 5'-CUUGGAGGGCAUGAAGACAGA-3' | (SEQ ID NO: 12630) |

TABLE 8-continued

DsiRNA Target Sequences (21 mers) of Human Anti-C5
DsiRNAs Predicted to have > 50% Knockdown Efficacy

| | | |
|---|---|---|
| C5-5281 | 21 nt Target: 5'-UUGGAGGGCAUGAAGACAGAU-3' | (SEQ ID NO: 12631) |
| C5-5282 | 21 nt Target: 5'-UGGAGGGCAUGAAGACAGAUA-3' | (SEQ ID NO: 12632) |
| C5-5283 | 21 nt Target: 5'-GGAGGGCAUGAAGACAGAUAC-3' | (SEQ ID NO: 12633) |
| C5-5284 | 21 nt Target: 5'-GAGGGCAUGAAGACAGAUACU-3' | (SEQ ID NO: 12634) |
| C5-5285 | 21 nt Target: 5'-AGGGCAUGAAGACAGAUACUC-3' | (SEQ ID NO: 12635) |
| C5-5286 | 21 nt Target: 5'-GGGCAUGAAGACAGAUACUCC-3' | (SEQ ID NO: 12636) |
| C5-5287 | 21 nt Target: 5'-GGCAUGAAGACAGAUACUCCU-3' | (SEQ ID NO: 12637) |
| C5-5288 | 21 nt Target: 5'-GCAUGAAGACAGAUACUCCUC-3' | (SEQ ID NO: 12638) |
| C5-5289 | 21 nt Target: 5'-CAUGAAGACAGAUACUCCUCC-3' | (SEQ ID NO: 12639) |
| C5-5290 | 21 nt Target: 5'-AUGAAGACAGAUACUCCUCCA-3' | (SEQ ID NO: 12640) |
| C5-5291 | 21 nt Target: 5'-UGAAGACAGAUACUCCUCCAA-3' | (SEQ ID NO: 12641) |
| C5-5292 | 21 nt Target: 5'-GAAGACAGAUACUCCUCCAAG-3' | (SEQ ID NO: 12642) |
| C5-5293 | 21 nt Target: 5'-AAGACAGAUACUCCUCCAAGG-3' | (SEQ ID NO: 12643) |
| C5-5294 | 21 nt Target: 5'-AGACAGAUACUCCUCCAAGGU-3' | (SEQ ID NO: 12644) |
| C5-5296 | 21 nt Target: 5'-ACAGAUACUCCUCCAAGGUUA-3' | (SEQ ID NO: 12645) |
| C5-5297 | 21 nt Target: 5'-CAGAUACUCCUCCAAGGUUAU-3' | (SEQ ID NO: 12646) |
| C5-5298 | 21 nt Target: 5'-AGAUACUCCUCCAAGGUUAUU-3' | (SEQ ID NO: 12647) |
| C5-5299 | 21 nt Target: 5'-GAUACUCCUCCAAGGUUAUUG-3' | (SEQ ID NO: 12648) |
| C5-5300 | 21 nt Target: 5'-AUACUCCUCCAAGGUUAUUGG-3' | (SEQ ID NO: 12649) |
| C5-5301 | 21 nt Target: 5'-UACUCCUCCAAGGUUAUUGGA-3' | (SEQ ID NO: 12650) |
| C5-5302 | 21 nt Target: 5'-ACUCCUCCAAGGUUAUUGGAC-3' | (SEQ ID NO: 12651) |
| C5-5303 | 21 nt Target: 5'-CUCCUCCAAGGUUAUUGGACA-3' | (SEQ ID NO: 12652) |
| C5-5304 | 21 nt Target: 5'-UCCUCCAAGGUUAUUGGACAC-3' | (SEQ ID NO: 12653) |
| C5-5305 | 21 nt Target: 5'-CCUCCAAGGUUAUUGGACACC-3' | (SEQ ID NO: 12654) |
| C5-5306 | 21 nt Target: 5'-CUCCAAGGUUAUUGGACACCG-3' | (SEQ ID NO: 12655) |
| C5-5307 | 21 nt Target: 5'-UCCAAGGUUAUUGGACACCGG-3' | (SEQ ID NO: 12656) |
| C5-5308 | 21 nt Target: 5'-CCAAGGUUAUUGGACACCGGA-3' | (SEQ ID NO: 12657) |
| C5-5309 | 21 nt Target: 5'-CAAGGUUAUUGGACACCGGAA-3' | (SEQ ID NO: 12658) |
| C5-5310 | 21 nt Target: 5'-AAGGUUAUUGGACACCGGAAA-3' | (SEQ ID NO: 12659) |
| C5-5311 | 21 nt Target: 5'-AGGUUAUUGGACACCGGAAAC-3' | (SEQ ID NO: 12660) |
| C5-5312 | 21 nt Target: 5'-GGUUAUUGGACACCGGAAACA-3' | (SEQ ID NO: 12661) |
| C5-5313 | 21 nt Target: 5'-GUUAUUGGACACCGGAAACAA-3' | (SEQ ID NO: 12662) |
| C5-5314 | 21 nt Target: 5'-UUAUUGGACACCGGAAACAAU-3' | (SEQ ID NO: 12663) |
| C5-5315 | 21 nt Target: 5'-UAUUGGACACCGGAAACAAUA-3' | (SEQ ID NO: 12664) |
| C5-5316 | 21 nt Target: 5'-AUUGGACACCGGAAACAAUAA-3' | (SEQ ID NO: 12665) |
| C5-5317 | 21 nt Target: 5'-UUGGACACCGGAAACAAUAAA-3' | (SEQ ID NO: 12666) |
| C5-5318 | 21 nt Target: 5'-UGGACACCGGAAACAAUAAAU-3' | (SEQ ID NO: 12667) |
| C5-5319 | 21 nt Target: 5'-GGACACCGGAAACAAUAAAUU-3' | (SEQ ID NO: 12668) |
| C5-5339 | 21 nt Target: 5'-UGGAACACCUCCUCAAACCUA-3' | (SEQ ID NO: 12669) |

TABLE 8-continued

DsiRNA Target Sequences (21 mers) of Human Anti-C5
DsiRNAs Predicted to have > 50% Knockdown Efficacy

| | | |
|---|---|---|
| C5-5340 | 21 nt Target: 5'-GGAACACCUCCUCAAACCUAC-3' | (SEQ ID NO: 12670) |
| C5-5341 | 21 nt Target: 5'-GAACACCUCCUCAAACCUACC-3' | (SEQ ID NO: 12671) |
| C5-5342 | 21 nt Target: 5'-AACACCUCCUCAAACCUACCA-3' | (SEQ ID NO: 12672) |
| C5-5343 | 21 nt Target: 5'-ACACCUCCUCAAACCUACCAC-3' | (SEQ ID NO: 12673) |
| C5-5344 | 21 nt Target: 5'-CACCUCCUCAAACCUACCACU-3' | (SEQ ID NO: 12674) |
| C5-5380 | 21 nt Target: 5'-GGGCCGAAAGAACAGUCCAUU-3' | (SEQ ID NO: 12675) |
| C5-5381 | 21 nt Target: 5'-GGCCGAAAGAACAGUCCAUUG-3' | (SEQ ID NO: 12676) |
| C5-5382 | 21 nt Target: 5'-GCCGAAAGAACAGUCCAUUGA-3' | (SEQ ID NO: 12677) |
| C5-5383 | 21 nt Target: 5'-CCGAAAGAACAGUCCAUUGAA-3' | (SEQ ID NO: 12678) |
| C5-5384 | 21 nt Target: 5'-CGAAAGAACAGUCCAUUGAAA-3' | (SEQ ID NO: 12679) |
| C5-5404 | 21 nt Target: 5'-AGGGAGUAUUACAAAAACAUG-3' | (SEQ ID NO: 12680) |
| C5-5405 | 21 nt Target: 5'-GGGAGUAUUACAAAAACAUGG-3' | (SEQ ID NO: 12681) |
| C5-5406 | 21 nt Target: 5'-GGAGUAUUACAAAAACAUGGC-3' | (SEQ ID NO: 12682) |
| C5-5407 | 21 nt Target: 5'-GAGUAUUACAAAAACAUGGCC-3' | (SEQ ID NO: 12683) |
| C5-5408 | 21 nt Target: 5'-AGUAUUACAAAAACAUGGCCU-3' | (SEQ ID NO: 12684) |
| C5-5409 | 21 nt Target: 5'-GUAUUACAAAAACAUGGCCUU-3' | (SEQ ID NO: 12685) |
| C5-5410 | 21 nt Target: 5'-UAUUACAAAAACAUGGCCUUU-3' | (SEQ ID NO: 12686) |
| C5-5411 | 21 nt Target: 5'-AUUACAAAAACAUGGCCUUUG-3' | (SEQ ID NO: 12687) |
| C5-5412 | 21 nt Target: 5'-UUACAAAAACAUGGCCUUUGC-3' | (SEQ ID NO: 12688) |
| C5-5413 | 21 nt Target: 5'-UACAAAAACAUGGCCUUUGCU-3' | (SEQ ID NO: 12689) |
| C5-5414 | 21 nt Target: 5'-ACAAAAACAUGGCCUUUGCUU-3' | (SEQ ID NO: 12690) |
| C5-5415 | 21 nt Target: 5'-CAAAAACAUGGCCUUUGCUUG-3' | (SEQ ID NO: 12691) |
| C5-5416 | 21 nt Target: 5'-AAAAACAUGGCCUUUGCUUGA-3' | (SEQ ID NO: 12692) |
| C5-5417 | 21 nt Target: 5'-AAAACAUGGCCUUUGCUUGAA-3' | (SEQ ID NO: 12693) |
| C5-5418 | 21 nt Target: 5'-AAACAUGGCCUUUGCUUGAAA-3' | (SEQ ID NO: 12694) |
| C5-5419 | 21 nt Target: 5'-AACAUGGCCUUUGCUUGAAAG-3' | (SEQ ID NO: 12695) |
| C5-5420 | 21 nt Target: 5'-ACAUGGCCUUUGCUUGAAAGA-3' | (SEQ ID NO: 12696) |
| C5-5421 | 21 nt Target: 5'-CAUGGCCUUUGCUUGAAAGAA-3' | (SEQ ID NO: 12697) |
| C5-5422 | 21 nt Target: 5'-AUGGCCUUUGCUUGAAAGAAA-3' | (SEQ ID NO: 12698) |
| C5-5423 | 21 nt Target: 5'-UGGCCUUUGCUUGAAAGAAAA-3' | (SEQ ID NO: 12699) |
| C5-5424 | 21 nt Target: 5'-GGCCUUUGCUUGAAAGAAAAU-3' | (SEQ ID NO: 12700) |
| C5-5425 | 21 nt Target: 5'-GCCUUUGCUUGAAAGAAAAUA-3' | (SEQ ID NO: 12701) |
| C5-5426 | 21 nt Target: 5'-CCUUUGCUUGAAAGAAAAUAC-3' | (SEQ ID NO: 12702) |
| C5-5427 | 21 nt Target: 5'-CUUUGCUUGAAAGAAAAUACC-3' | (SEQ ID NO: 12703) |
| C5-5428 | 21 nt Target: 5'-UUUGCUUGAAAGAAAAUACCA-3' | (SEQ ID NO: 12704) |
| C5-5451 | 21 nt Target: 5'-GAACAGGAAACUGAUCAUUAA-3' | (SEQ ID NO: 12705) |
| C5-5452 | 21 nt Target: 5'-AACAGGAAACUGAUCAUUAAA-3' | (SEQ ID NO: 12706) |
| C5-5453 | 21 nt Target: 5'-ACAGGAAACUGAUCAUUAAAG-3' | (SEQ ID NO: 12707) |

TABLE 8-continued

DsiRNA Target Sequences (21 mers) of Human Anti-C5
DsiRNAs Predicted to have > 50% Knockdown Efficacy

| | | |
|---|---|---|
| C5-5454 | 21 nt Target: 5'-CAGGAAACUGAUCAUUAAAGC-3' | (SEQ ID NO: 12708) |
| C5-5455 | 21 nt Target: 5'-AGGAAACUGAUCAUUAAAGCC-3' | (SEQ ID NO: 12709) |
| C5-5456 | 21 nt Target: 5'-GGAAACUGAUCAUUAAAGCCU-3' | (SEQ ID NO: 12710) |
| C5-5457 | 21 nt Target: 5'-GAAACUGAUCAUUAAAGCCUG-3' | (SEQ ID NO: 12711) |
| C5-5458 | 21 nt Target: 5'-AAACUGAUCAUUAAAGCCUGA-3' | (SEQ ID NO: 12712) |
| C5-5459 | 21 nt Target: 5'-AACUGAUCAUUAAAGCCUGAG-3' | (SEQ ID NO: 12713) |
| C5-5460 | 21 nt Target: 5'-ACUGAUCAUUAAAGCCUGAGU-3' | (SEQ ID NO: 12714) |
| C5-5461 | 21 nt Target: 5'-CUGAUCAUUAAAGCCUGAGUU-3' | (SEQ ID NO: 12715) |
| C5-5462 | 21 nt Target: 5'-UGAUCAUUAAAGCCUGAGUUU-3' | (SEQ ID NO: 12716) |
| C5-5463 | 21 nt Target: 5'-GAUCAUUAAAGCCUGAGUUUG-3' | (SEQ ID NO: 12717) |
| C5-5466 | 21 nt Target: 5'-CAUUAAAGCCUGAGUUUGCUU-3' | (SEQ ID NO: 12718) |
| C5-5467 | 21 nt Target: 5'-AUUAAAGCCUGAGUUUGCUUU-3' | (SEQ ID NO: 12719) |

TABLE 9

"Blunt/Blunt" DsiRNAs Corresponding to Human Anti-C5
DsiRNAs Predicted to have >50% Knockdown Efficacy

5'-UCCUGCUACCUCCAACCAUGGGCCUUU-3' (SEQ ID NO: 12720)

3'-AGGACGAUGGAGGUUGGUACCCGGAAA-5' (SEQ ID NO: 5790)

C5-40 Target:
5'-TCCTGCTACCTCCAACCATGGGCCTTT-3' (SEQ ID NO: 8100)

5'-CCUGCUACCUCCAACCAUGGGCCUUU-3' (SEQ ID NO: 12721)

3'-GGACGAUGGAGGUUGGUACCCGGAAA-5' (SEQ ID NO: 5791)

C5-41 Target:
5'-CCTGCTACCTCCAACCATGGGCCTTTT-3' (SEQ ID NO: 8101)

5'-CUGCUACCUCCAACCAUGGGCCUUUG-3' (SEQ ID NO: 12722)

3'-GACGAUGGAGGUUGGUACCCGGAAAAC-5' (SEQ ID NO: 5792)

C5-42 Target:
5'-CTGCTACCTCCAACCATGGGCCTTTTG-3' (SEQ ID NO: 8102)

5'-UGCUACCUCCAACCAUGGGCCUUUUG-3' (SEQ ID NO: 12723)

3'-ACGAUGGAGGUUGGUACCCGGAAAACC-5' (SEQ ID NO: 5793)

C5-43 Target:
5'-TGCTACCTCCAACCATGGGCCTTTTGG-3' (SEQ ID NO: 8103)

5'-UACCUCCAACCAUGGGCCUUUUGGGAA-3' (SEQ ID NO: 12724)

3'-AUGGAGGUUGGUACCCGGAAAACCCUU-5' (SEQ ID NO: 5794)

C5-46 Target:
5'-TACCTCCAACCATGGGCCTTTTGGGAA-3' (SEQ ID NO: 8104)

5'-ACCUCCAACCAUGGGCCUUUUGGGAAU-3' (SEQ ID NO: 12725)

3'-UGGAGGUUGGUACCCGGAAAACCCUUA-5' (SEQ ID NO: 5795)

C5-47 Target:
5'-ACCTCCAACCATGGGCCTTTTGGGAAT-3' (SEQ ID NO: 8105)

5'-CCUCCAACCAUGGGCCUUUUGGGAAUA-3' (SEQ ID NO: 12726)

3'-GGAGGUUGGUACCCGGAAAACCCUUAU-5' (SEQ ID NO: 5796)

C5-48 Target:
5'-CCTCCAACCATGGGCCTTTTGGGAATA-3' (SEQ ID NO: 8106)

5'-CUCCAACCAUGGGCCUUUUGGGAAUAC-3' (SEQ ID NO: 12727)

3'-GAGGUUGGUACCCGGAAAACCCUUAUG-5' (SEQ ID NO: 5797)

C5-49 Target:
5'-CTCCAACCATGGGCCTTTTGGGAATAC-3' (SEQ ID NO: 8107)

5'-UCCAACCAUGGGCCUUUUGGGAAUACU-3' (SEQ ID NO: 12728)

3'-AGGUUGGUACCCGGAAAACCCUUAUGA-5' (SEQ ID NO: 5798)

C5-50 Target:
5'-TCCAACCATGGGCCTTTTGGGAATACT-3' (SEQ ID NO: 8108)

5'-CCAACCAUGGGCCUUUUGGGAAUACUU-3' (SEQ ID NO: 12729)

3'-GGUUGGUACCCGGAAAACCCUUAUGAA-5' (SEQ ID NO: 5799)

C5-51 Target:
5'-CCAACCATGGGCCTTTTGGGAATACTT-3' (SEQ ID NO: 8109)

5'-CAACCAUGGGCCUUUUGGGAAUACUUU-3' (SEQ ID NO: 12730)

3'-GUUGGUACCCGGAAAACCCUUAUGAAA-5' (SEQ ID NO: 5800)

C5-52 Target:
5'-CAACCATGGGCCTTTTGGGAATACTTT-3' (SEQ ID NO: 8110)

5'-AACCAUGGGCCUUUUGGGAAUACUUUG-3' (SEQ ID NO: 12731)

3'-UUGGUACCCGGAAAACCCUUAUGAAAC-5' (SEQ ID NO: 5801)

C5-53 Target:
5'-AACCATGGGCCTTTTGGGAATACTTTG-3' (SEQ ID NO: 8111)

5'-ACCAUGGGCCUUUUGGGAAUACUUUGU-3' (SEQ ID NO: 12732)

3'-UGGUACCCGGAAAACCCUUAUGAAACA-5' (SEQ ID NO: 5802)

TABLE 9-continued

"Blunt/Blunt" DsiRNAs Corresponding to Human Anti-C5 DsiRNAs Predicted to have >50% Knockdown Efficacy C5-54 Target:
5'-ACCATGGGCCTTTTGGGAATACTTTGT-3' (SEQ ID NO: 8112)

5'-CCAUGGGCCUUUUGGGAAUACUUUGUU-3' (SEQ ID NO: 12733)

3'-GGUACCCGGAAAACCCUUAUGAAACAA-5' (SEQ ID NO: 5803)

C5-55 Target:
5'-CCATGGGCCTTTTGGGAATACTTTGTT-3' (SEQ ID NO: 8113)

5'-CAUGGGCCUUUUGGGAAUACUUUGUUU-3' (SEQ ID NO: 12734)

3'-GUACCCGGAAAACCCUUAUGAAACAAA-5' (SEQ ID NO: 5804)

C5-56 Target:
5'-CATGGGCCTTTTGGGAATACTTTGTTT-3' (SEQ ID NO: 8114)

5'-AUGGGCCUUUUGGGAAUACUUUGUUUU-3' (SEQ ID NO: 12735)

3'-UACCCGGAAAACCCUUAUGAAACAAAA-5' (SEQ ID NO: 5805)

C5-57 Target:
5'-ATGGGCCTTTTGGGAATACTTTGTTTT-3' (SEQ ID NO: 8115)

5'-UGGGCCUUUUGGGAAUACUUUGUUUUU-3' (SEQ ID NO: 12736)

3'-ACCCGGAAAACCCUUAUGAAACAAAAA-5' (SEQ ID NO: 5806)

C5-58 Target:
5'-TGGGCCTTTTGGGAATACTTTGTTTTT-3' (SEQ ID NO: 8116)

5'-GGGCCUUUUGGGAAUACUUUGUUUUUU-3' (SEQ ID NO: 12737)

3'-CCCGGAAAACCCUUAUGAAACAAAAAA-5' (SEQ ID NO: 5807)

C5-59 Target:
5'-GGGCCTTTTGGGAATACTTTGTTTTTT-3' (SEQ ID NO: 8117)

5'-GGCCUUUUGGGAAUACUUUGUUUUUUA-3' (SEQ ID NO: 12738)

3'-CCGGAAAACCCUUAUGAAACAAAAAAU-5' (SEQ ID NO: 5808)

C5-60 Target:
5'-GGCCTTTTGGGAATACTTTGTTTTTTA-3' (SEQ ID NO: 8118)

5'-GCCUUUUGGGAAUACUUUGUUUUUUAA-3' (SEQ ID NO: 12739)

3'-CGGAAAACCCUUAUGAAACAAAAAAUU-5' (SEQ ID NO: 5809)

C5-61 Target:
5'-GCCTTTTGGGAATACTTTGTTTTTTAA-3' (SEQ ID NO: 8119)

5'-CCUUUUGGGAAUACUUUGUUUUUUAAU-3' (SEQ ID NO: 12740)

3'-GGAAAACCCUUAUGAAACAAAAAAUUA-5' (SEQ ID NO: 5810)

C5-62 Target:
5'-CCTTTTGGGAATACTTTGTTTTTTAAT-3' (SEQ ID NO: 8120)

5'-CUUUUGGGAAUACUUUGUUUUUUAAUC-3' (SEQ ID NO: 12741)

3'-GAAAACCCUUAUGAAACAAAAAAUUAG-5' (SEQ ID NO: 5811)

C5-63 Target:
5'-CTTTTGGGAATACTTTGTTTTTTAATC-3' (SEQ ID NO: 8121)

5'-UUUUGGGAAUACUUUGUUUUUUAAUCU-3' (SEQ ID NO: 12742)

3'-AAAACCCUUAUGAAACAAAAAAUUAGA-5' (SEQ ID NO: 5812)

C5-64 Target:
5'-TTTTGGGAATACTTTGTTTTTTAATCT-3' (SEQ ID NO: 8122)

5'-UUUGGGAAUACUUUGUUUUUUAAUCUU-3' (SEQ ID NO: 12743)

3'-AAACCCUUAUGAAACAAAAAAUUAGAA-5' (SEQ ID NO: 5813)

C5-65 Target:
5'-TTTGGGAATACTTTGTTTTTTAATCTT-3' (SEQ ID NO: 8123)

5'-UUGGGAAUACUUUGUUUUUUAAUCUUC-3' (SEQ ID NO: 12744)

3'-AACCCUUAUGAAACAAAAAAUUAGAAG-5' (SEQ ID NO: 5814)

C5-66 Target:
5'-TTGGGAATACTTTGTTTTTTAATCTTC-3' (SEQ ID NO: 8124)

5'-UGGGAAUACUUUGUUUUUUAAUCUUCC-3' (SEQ ID NO: 12745)

3'-ACCCUUAUGAAACAAAAAAUUAGAAGG-5' (SEQ ID NO: 5815)

C5-67 Target:
5'-TGGGAATACTTTGTTTTTTAATCTTCC-3' (SEQ ID NO: 8125)

5'-GGGAAUACUUUGUUUUUUAAUCUUCCU-3' (SEQ ID NO: 12746)

3'-CCCUUAUGAAACAAAAAAUUAGAAGGA-5' (SEQ ID NO: 5816)

C5-68 Target:
5'-GGGAATACTTTGTTTTTTAATCTTCCT-3' (SEQ ID NO: 8126)

5'-GGAAUACUUUGUUUUUUAAUCUUCCUG-3' (SEQ ID NO: 12747)

3'-CCUUAUGAAACAAAAAAUUAGAAGGAC-5' (SEQ ID NO: 5817)

C5-69 Target:
5'-GGAATACTTTGTTTTTTAATCTTCCTG-3' (SEQ ID NO: 8127)

5'-GAAUACUUUGUUUUUUAAUCUUCCUGG-3' (SEQ ID NO: 12748)

3'-CUUAUGAAACAAAAAAUUAGAAGGACC-5' (SEQ ID NO: 5818)

C5-70 Target:
5'-GAATACTTTGTTTTTTAATCTTCCTGG-3' (SEQ ID NO: 8128)

5'-AAUACUUUGUUUUUUAAUCUUCCUGGG-3' (SEQ ID NO: 12749)

3'-UUAUGAAACAAAAAAUUAGAAGGACCC-5' (SEQ ID NO: 5819)

C5-71 Target:
5'-AATACTTTGTTTTTTAATCTTCCTGGG-3' (SEQ ID NO: 8129)

5'-AUACUUUGUUUUUUAAUCUUCCUGGGG-3' (SEQ ID NO: 12750)

3'-UAUGAAACAAAAAAUUAGAAGGACCCC-5' (SEQ ID NO: 5820)

C5-72 Target:
5'-ATACTTTGTTTTTTAATCTTCCTGGGG-3' (SEQ ID NO: 8130)

5'-UACUUUGUUUUUUAAUCUUCCUGGGGA-3' (SEQ ID NO: 12751)

3'-AUGAAACAAAAAAUUAGAAGGACCCCU-5' (SEQ ID NO: 5821)

C5-73 Target:
5'-TACTTTGTTTTTTAATCTTCCTGGGGA-3' (SEQ ID NO: 8131)

5'-ACUUUGUUUUUUAAUCUUCCUGGGGAA-3' (SEQ ID NO: 12752)

3'-UGAAACAAAAAAUUAGAAGGACCCCUU-5' (SEQ ID NO: 5822)

TABLE 9-continued

"Blunt/Blunt" DsiRNAs Corresponding to Human Anti-C5 DsiRNAs Predicted to have >50% Knockdown Efficacy C5-74 Target:
5'-ACTTTGTTTTTAATCTTCCTGGGGAA-3' (SEQ ID NO: 8132)

5'-CUUUGUUUUUAAUCUUCCUGGGGAAA-3' (SEQ ID NO: 12753)

3'-GAAACAAAAAAUUAGAAGGACCCCUUU-5' (SEQ ID NO: 5823)

C5-75 Target:
5'-CTTTGTTTTTAATCTTCCTGGGGAAA-3' (SEQ ID NO: 8133)

5'-UUUGUUUUUAAUCUUCCUGGGGAAAA-3' (SEQ ID NO: 12754)

3'-AAACAAAAAAUUAGAAGGACCCCUUUU-5' (SEQ ID NO: 5824)

C5-76 Target:
5'-TTTGTTTTTAATCTTCCTGGGGAAAA-3' (SEQ ID NO: 8134)

5'-UUGUUUUUAAUCUUCCUGGGGAAAAC-3' (SEQ ID NO: 12755)

3'-AACAAAAAAUUAGAAGGACCCCUUUUG-5' (SEQ ID NO: 5825)

C5-77 Target:
5'-TTGTTTTTAATCTTCCTGGGGAAAAC-3' (SEQ ID NO: 8135)

5'-CCUGGGGACAGGAGCAAACAUAUGUCA-3' (SEQ ID NO: 12756)

3'-GGACCCCUGUCCUCGUUUGUAUACAGU-5' (SEQ ID NO: 5826)

C5-103 Target:
5'-CCTGGGGACAGGAGCAAACATATGTCA-3' (SEQ ID NO: 8136)

5'-CUGGGGACAGGAGCAAACAUAUGUCAU-3' (SEQ ID NO: 12757)

3'-GACCCCUGUCCUCGUUUGUAUACAGUA-5' (SEQ ID NO: 5827)

C5-104 Target:
5'-CTGGGGACAGGAGCAAACATATGTCAT-3' (SEQ ID NO: 8137)

5'-UGGGGACAGGAGCAAACAUAUGUCAUU-3' (SEQ ID NO: 12758)

3'-ACCCCUGUCCUCGUUUGUAUACAGUAA-5' (SEQ ID NO: 5828)

C5-105 Target:
5'-TGGGGACAGGAGCAAACATATGTCATT-3' (SEQ ID NO: 8138)

5'-GGGGACAGGAGCAAACAUAUGUCAUUU-3' (SEQ ID NO: 12759)

3'-CCCCUGUCCUCGUUUGUAUACAGUAAA-5' (SEQ ID NO: 5829)

C5-106 Target:
5'-GGGGACAGGAGCAAACATATGTCATTT-3' (SEQ ID NO: 8139)

5'-GGGACAGGAGCAAACAUAUGUCAUUUC-3' (SEQ ID NO: 12760)

3'-CCCUGUCCUCGUUUGUAUACAGUAAAG-5' (SEQ ID NO: 5830)

C5-107 Target:
5'-GGGACAGGAGCAAACATATGTCATTTC-3' (SEQ ID NO: 8140)

5'-GGACAGGAGCAAACAUAUGUCAUUUCA-3' (SEQ ID NO: 12761)

3'-CCUGUCCUCGUUUGUAUACAGUAAAGU-5' (SEQ ID NO: 5831)

C5-108 Target:
5'-GGACAGGAGCAAACATATGTCATTTCA-3' (SEQ ID NO: 8141)

5'-GACAGGAGCAAACAUAUGUCAUUUCAG-3' (SEQ ID NO: 12762)

3'-CUGUCCUCGUUUGUAUACAGUAAAGUC-5' (SEQ ID NO: 5832)

C5-109 Target:
5'-GACAGGAGCAAACATATGTCATTTCAG-3' (SEQ ID NO: 8142)

5'-ACAGGAGCAAACAUAUGUCAUUUCAGC-3' (SEQ ID NO: 12763)

3'-UGUCCUCGUUUGUAUACAGUAAAGUCG-5' (SEQ ID NO: 5833)

C5-110 Target:
5'-ACAGGAGCAAACATATGTCATTTCAGC-3' (SEQ ID NO: 8143)

5'-CAGGAGCAAACAUAUGUCAUUUCAGCA-3' (SEQ ID NO: 12764)

3'-GUCCUCGUUUGUAUACAGUAAAGUCGU-5' (SEQ ID NO: 5834)

C5-111 Target:
5'-CAGGAGCAAACATATGTCATTTCAGCA-3' (SEQ ID NO: 8144)

5'-AGGAGCAAACAUAUGUCAUUUCAGCAC-3' (SEQ ID NO: 12765)

3'-UCCUCGUUUGUAUACAGUAAAGUCGUG-5' (SEQ ID NO: 5835)

C5-112 Target:
5'-AGGAGCAAACATATGTCATTTCAGCAC-3' (SEQ ID NO: 8145)

5'-GGAGCAAACAUAUGUCAUUUCAGCACC-3' (SEQ ID NO: 12766)

3'-CCUCGUUUGUAUACAGUAAAGUCGUGG-5' (SEQ ID NO: 5836)

C5-113 Target:
5'-GGAGCAAACATATGTCATTTCAGCACC-3' (SEQ ID NO: 8146)

5'-GAGCAAACAUAUGUCAUUUCAGCACCA-3' (SEQ ID NO: 12767)

3'-CUCGUUUGUAUACAGUAAAGUCGUGGU-5' (SEQ ID NO: 5837)

C5-114 Target:
5'-GAGCAAACATATGTCATTTCAGCACCA-3' (SEQ ID NO: 8147)

5'-AGCAAACAUAUGUCAUUUCAGCACCAA-3' (SEQ ID NO: 12768)

3'-UCGUUUGUAUACAGUAAAGUCGUGGUU-5' (SEQ ID NO: 5838)

C5-115 Target:
5'-AGCAAACATATGTCATTTCAGCACCAA-3' (SEQ ID NO: 8148)

5'-GCAAACAUAUGUCAUUUCAGCACCAAA-3' (SEQ ID NO: 12769)

3'-CGUUUGUAUACAGUAAAGUCGUGGUUU-5' (SEQ ID NO: 5839)

C5-116 Target:
5'-GCAAACATATGTCATTTCAGCACCAAA-3' (SEQ ID NO: 8149)

5'-CAAACAUAUGUCAUUUCAGCACCAAAA-3' (SEQ ID NO: 12770)

3'-GUUUGUAUACAGUAAAGUCGUGGUUUU-5' (SEQ ID NO: 5840)

C5-117 Target:
5'-CAAACATATGTCATTTCAGCACCAAAA-3' (SEQ ID NO: 8150)

5'-AAACAUAUGUCAUUUCAGCACCAAAAA-3' (SEQ ID NO: 12771)

3'-UUUGUAUACAGUAAAGUCGUGGUUUUU-5' (SEQ ID NO: 5841)

C5-118 Target:
5'-AAACATATGTCATTTCAGCACCAAAAA-3' (SEQ ID NO: 8151)

5'-AACAUAUGUCAUUUCAGCACCAAAAAU-3' (SEQ ID NO: 12772)

3'-UUGUAUACAGUAAAGUCGUGGUUUUUA-5' (SEQ ID NO: 5842)

TABLE 9-continued

"Blunt/Blunt" DsiRNAs Corresponding to Human Anti-C5 DsiRNAs Predicted to have >50% Knockdown Efficacy C5-119 Target:
5'-AACATATGTCATTTCAGCACCAAAAAT-3' (SEQ ID NO: 8152)

5'-CAUAUGUCAUUUCAGCACCAAAAAUAU-3' (SEQ ID NO: 12773)

3'-GUAUACAGUAAAGUCGUGGUUUUUAUA-5' (SEQ ID NO: 5843)

C5-121 Target:
5'-CATATGTCATTTCAGCACCAAAAATAT-3' (SEQ ID NO: 8153)

5'-AUAUGUCAUUUCAGCACCAAAAAUAUU-3' (SEQ ID NO: 12774)

3'-UAUACAGUAAAGUCGUGGUUUUUAUAA-5' (SEQ ID NO: 5844)

C5-122 Target:
5'-ATATGTCATTTCAGCACCAAAAATATT-3' (SEQ ID NO: 8154)

5'-UAUGUCAUUUCAGCACCAAAAAUAUUC-3' (SEQ ID NO: 12775)

3'-AUACAGUAAAGUCGUGGUUUUUAUAAG-5' (SEQ ID NO: 5845)

C5-123 Target:
5'-TATGTCATTTCAGCACCAAAAATATTC-3' (SEQ ID NO: 8155)

5'-AUGUCAUUUCAGCACCAAAAAUAUUCC-3' (SEQ ID NO: 12776)

3'-UACAGUAAAGUCGUGGUUUUUAUAAGG-5' (SEQ ID NO: 5846)

C5-124 Target:
5'-ATGTCATTTCAGCACCAAAAATATTCC-3' (SEQ ID NO: 8156)

5'-UGUCAUUUCAGCACCAAAAAUAUUCCG-3' (SEQ ID NO: 12777)

3'-ACAGUAAAGUCGUGGUUUUUAUAAGGC-5' (SEQ ID NO: 5847)

C5-125 Target:
5'-TGTCATTTCAGCACCAAAAATATTCCG-3' (SEQ ID NO: 8157)

5'-GUCAUUUCAGCACCAAAAAUAUUCCGU-3' (SEQ ID NO: 12778)

3'-CAGUAAAGUCGUGGUUUUUAUAAGGCA-5' (SEQ ID NO: 5848)

C5-126 Target:
5'-GTCATTTCAGCACCAAAAATATTCCGT-3' (SEQ ID NO: 8158)

5'-UCAUUUCAGCACCAAAAAUAUUCCGUG-3' (SEQ ID NO: 12779)

3'-AGUAAAGUCGUGGUUUUUAUAAGGCAC-5' (SEQ ID NO: 5849)

C5-127 Target:
5'-TCATTTCAGCACCAAAAATATTCCGTG-3' (SEQ ID NO: 8159)

5'-CAUUUCAGCACCAAAAAUAUUCCGUGU-3' (SEQ ID NO: 12780)

3'-GUAAAGUCGUGGUUUUUAUAAGGCACA-5' (SEQ ID NO: 5850)

C5-128 Target:
5'-CATTTCAGCACCAAAAATATTCCGTGT-3' (SEQ ID NO: 8160)

5'-AUUUCAGCACCAAAAAUAUUCCGUGUU-3' (SEQ ID NO: 12781)

3'-UAAAGUCGUGGUUUUUAUAAGGCACAA-5' (SEQ ID NO: 5851)

C5-129 Target:
5'-ATTTCAGCACCAAAAATATTCCGTGTT-3' (SEQ ID NO: 8161)

5'-UUUCAGCACCAAAAAUAUUCCGUGUUG-3' (SEQ ID NO: 12782)

3'-AAAGUCGUGGUUUUUAUAAGGCACAAC-5' (SEQ ID NO: 5852)

C5-130 Target:
5'-TTTCAGCACCAAAAATATTCCGTGTTG-3' (SEQ ID NO: 8162)

5'-UUCAGCACCAAAAAUAUUCCGUGUUGG-3' (SEQ ID NO: 12783)

3'-AAGUCGUGGUUUUUAUAAGGCACAACC-5' (SEQ ID NO: 5853)

C5-131 Target:
5'-TTCAGCACCAAAAATATTCCGTGTTGG-3' (SEQ ID NO: 8163)

5'-UCAGCACCAAAAAUAUUCCGUGUUGGA-3' (SEQ ID NO: 12784)

3'-AGUCGUGGUUUUUAUAAGGCACAACCU-5' (SEQ ID NO: 5854)

C5-132 Target:
5'-TCAGCACCAAAAATATTCCGTGTTGGA-3' (SEQ ID NO: 8164)

5'-CAGCACCAAAAAUAUUCCGUGUUGGAG-3' (SEQ ID NO: 12785)

3'-GUCGUGGUUUUUAUAAGGCACAACCUC-5' (SEQ ID NO: 5855)

C5-133 Target:
5'-CAGCACCAAAAATATTCCGTGTTGGAG-3' (SEQ ID NO: 8165)

5'-AGCACCAAAAAUAUUCCGUGUUGGAGC-3' (SEQ ID NO: 12786)

3'-UCGUGGUUUUUAUAAGGCACAACCUCG-5' (SEQ ID NO: 5856)

C5-134 Target:
5'-AGCACCAAAAATATTCCGTGTTGGAGC-3' (SEQ ID NO: 8166)

5'-GCACCAAAAAUAUUCCGUGUUGGAGCA-3' (SEQ ID NO: 12787)

3'-CGUGGUUUUUAUAAGGCACAACCUCGU-5' (SEQ ID NO: 5857)

C5-135 Target:
5'-GCACCAAAAATATTCCGTGTTGGAGCA-3' (SEQ ID NO: 8167)

5'-CACCAAAAAUAUUCCGUGUUGGAGCAU-3' (SEQ ID NO: 12788)

3'-GUGGUUUUUAUAAGGCACAACCUCGUA-5' (SEQ ID NO: 5858)

C5-136 Target:
5'-CACCAAAAATATTCCGTGTTGGAGCAT-3' (SEQ ID NO: 8168)

5'-ACCAAAAAUAUUCCGUGUUGGAGCAUC-3' (SEQ ID NO: 12789)

3'-UGGUUUUUAUAAGGCACAACCUCGUAG-5' (SEQ ID NO: 5859)

C5-137 Target:
5'-ACCAAAAATATTCCGTGTTGGAGCATC-3' (SEQ ID NO: 8169)

5'-CCAAAAAUAUUCCGUGUUGGAGCAUCU-3' (SEQ ID NO: 12790)

3'-GGUUUUUAUAAGGCACAACCUCGUAGA-5' (SEQ ID NO: 5860)

C5-138 Target:
5'-CCAAAAATATTCCGTGTTGGAGCATCT-3' (SEQ ID NO: 8170)

5'-CAAAAAUAUUCCGUGUUGGAGCAUCUG-3' (SEQ ID NO: 12791)

3'-GUUUUUAUAAGGCACAACCUCGUAGAC-5' (SEQ ID NO: 5861)

C5-139 Target:
5'-CAAAAATATTCCGTGTTGGAGCATCTG-3' (SEQ ID NO: 8171)

5'-AAAAAUAUUCCGUGUUGGAGCAUCUGA-3' (SEQ ID NO: 12792)

3'-UUUUUAUAAGGCACAACCUCGUAGACU-5' (SEQ ID NO: 5862)

TABLE 9-continued

"Blunt/Blunt" DsiRNAs Corresponding to Human Anti-C5 DsiRNAs Predicted to have >50% Knockdown Efficacy C5-140 Target:
5'-AAAAATATTCCGTGTTGGAGCATCTGA-3' (SEQ ID NO: 8172)

5'-AAAAUAUUCCGUGUUGGAGCAUCUGAA-3' (SEQ ID NO: 12793)

3'-UUUUAUAAGGCACAACCUCGUAGACUU-5' (SEQ ID NO: 5863)

C5-141 Target:
5'-AAAATATTCCGTGTTGGAGCATCTGAA-3' (SEQ ID NO: 8173)

5'-AAAUAUUCCGUGUUGGAGCAUCUGAAA-3' (SEQ ID NO: 12794)

3'-UUUAUAAGGCACAACCUCGUAGACUUU-5' (SEQ ID NO: 5864)

C5-142 Target:
5'-AAATATTCCGTGTTGGAGCATCTGAAA-3' (SEQ ID NO: 8174)

5'-AAUAUUCCGUGUUGGAGCAUCUGAAAA-3' (SEQ ID NO: 12795)

3'-UUAUAAGGCACAACCUCGUAGACUUUU-5' (SEQ ID NO: 5865)

C5-143 Target:
5'-AATATTCCGTGTTGGAGCATCTGAAAA-3' (SEQ ID NO: 8175)

5'-AUAUUCCGUGUUGGAGCAUCUGAAAAU-3' (SEQ ID NO: 12796)

3'-UAUAAGGCACAACCUCGUAGACUUUUA-5' (SEQ ID NO: 5866)

C5-144 Target:
5'-ATATTCCGTGTTGGAGCATCTGAAAAT-3' (SEQ ID NO: 8176)

5'-UAUUCCGUGUUGGAGCAUCUGAAAAUA-3' (SEQ ID NO: 12797)

3'-AUAAGGCACAACCUCGUAGACUUUUAU-5' (SEQ ID NO: 5867)

C5-145 Target:
5'-TATTCCGTGTTGGAGCATCTGAAAATA-3' (SEQ ID NO: 8177)

5'-AUUCCGUGUUGGAGCAUCUGAAAAUAU-3' (SEQ ID NO: 12798)

3'-UAAGGCACAACCUCGUAGACUUUUAUA-5' (SEQ ID NO: 5868)

C5-146 Target:
5'-ATTCCGTGTTGGAGCATCTGAAAATAT-3' (SEQ ID NO: 8178)

5'-UUCCGUGUUGGAGCAUCUGAAAAUAUU-3' (SEQ ID NO: 12799)

3'-AAGGCACAACCUCGUAGACUUUUAUAA-5' (SEQ ID NO: 5869)

C5-147 Target:
5'-TTCCGTGTTGGAGCATCTGAAAATATT-3' (SEQ ID NO: 8179)

5'-UCCGUGUUGGAGCAUCUGAAAAUAUUG-3' (SEQ ID NO: 12800)

3'-AGGCACAACCUCGUAGACUUUUAUAAC-5' (SEQ ID NO: 5870)

C5-148 Target:
5'-TCCGTGTTGGAGCATCTGAAAATATTG-3' (SEQ ID NO: 8180)

5'-CCGUGUUGGAGCAUCUGAAAAUAUUGU-3' (SEQ ID NO: 12801)

3'-GGCACAACCUCGUAGACUUUUAUAACA-5' (SEQ ID NO: 5871)

C5-149 Target:
5'-CCGTGTTGGAGCATCTGAAAATATTGT-3' (SEQ ID NO: 8181)

5'-AAGUUUAUGGAUACACUGAAGCAUUUG-3' (SEQ ID NO: 12802)

3'-UUCAAAUACCUAUGUGACUUCGUAAAC-5' (SEQ ID NO: 5872)

C5-181 Target:
5'-AAGTTTATGGATACACTGAAGCATTTG-3' (SEQ ID NO: 8182)

5'-UUUAUGGAUACACUGAAGCAUUUGAUG-3' (SEQ ID NO: 12803)

3'-AAAUACCUAUGUGACUUCGUAAACUAC-5' (SEQ ID NO: 5873)

C5-184 Target:
5'-TTTATGGATACACTGAAGCATTTGATG-3' (SEQ ID NO: 8183)

5'-UAUGGAUACACUGAAGCAUUUGAUGCA-3' (SEQ ID NO: 12804)

3'-AUACCUAUGUGACUUCGUAAACUACGU-5' (SEQ ID NO: 5874)

C5-186 Target:
5'-TATGGATACACTGAAGCATTTGATGCA-3' (SEQ ID NO: 8184)

5'-ACUGAAGCAUUUGAUGCAACAAUCUCU-3' (SEQ ID NO: 12805)

3'-UGACUUCGUAAACUACGUUGUUAGAGA-5' (SEQ ID NO: 5875)

C5-195 Target:
5'-ACTGAAGCATTTGATGCAACAATCTCT-3' (SEQ ID NO: 8185)

5'-UGAAGCAUUUGAUGCAACAAUCUCUAU-3' (SEQ ID NO: 12806)

3'-ACUUCGUAAACUACGUUGUUAGAGAUA-5' (SEQ ID NO: 5876)

C5-197 Target:
5'-TGAAGCATTTGATGCAACAATCTCTAT-3' (SEQ ID NO: 8186)

5'-AAGCAUUUGAUGCAACAAUCUCUAUUA-3' (SEQ ID NO: 12807)

3'-UUCGUAAACUACGUUGUUAGAGAUAAU-5' (SEQ ID NO: 5877)

C5-199 Target:
5'-AAGCATTTGATGCAACAATCTCTATTA-3' (SEQ ID NO: 8187)

5'-GCAUUUGAUGCAACAAUCUCUAUUAAA-3' (SEQ ID NO: 12808)

3'-CGUAAACUACGUUGUUAGAGAUAAUUU-5' (SEQ ID NO: 5878)

C5-201 Target:
5'-GCATTTGATGCAACAATCTCTATTAAA-3' (SEQ ID NO: 8188)

5'-CAUUUGAUGCAACAAUCUCUAUUAAAA-3' (SEQ ID NO: 12809)

3'-GUAAACUACGUUGUUAGAGAUAAUUUU-5' (SEQ ID NO: 5879)

C5-202 Target:
5'-CATTTGATGCAACAATCTCTATTAAAA-3' (SEQ ID NO: 8189)

5'-AUUUGAUGCAACAAUCUCUAUUAAAAG-3' (SEQ ID NO: 12810)

3'-UAAACUACGUUGUUAGAGAUAAUUUUC-5' (SEQ ID NO: 5880)

C5-203 Target:
5'-ATTTGATGCAACAATCTCTATTAAAAG-3' (SEQ ID NO: 8190)

5'-AUGCAACAAUCUCUAUUAAAAGUUAUC-3' (SEQ ID NO: 12811)

3'-UACGUUGUUAGAGAUAAUUUUCAAUAG-5' (SEQ ID NO: 5881)

C5-208 Target:
5'-ATGCAACAATCTCTATTAAAAGTTATC-3' (SEQ ID NO: 8191)

5'-UGCAACAAUCUCUAUUAAAAGUUAUCC-3' (SEQ ID NO: 12812)

3'-ACGUUGUUAGAGAUAAUUUUCAAUAGG-5' (SEQ ID NO: 5882)

TABLE 9-continued

"Blunt/Blunt" DsiRNAs Corresponding to Human Anti-C5 DsiRNAs Predicted to have >50% Knockdown Efficacy C5-209 Target:
5'-TGCAACAATCTCTATTAAAAGTTATCC-3' (SEQ ID NO: 8192)

5'-GCAACAAUCUCUAUUAAAAGUUAUCCU-3' (SEQ ID NO: 12813)

3'-CGUUGUUAGAGAUAAUUUUCAAUAGGA-5' (SEQ ID NO: 5883)

C5-210 Target:
5'-GCAACAATCTCTATTAAAAGTTATCCT-3' (SEQ ID NO: 8193)

5'-ACAAUCUCUAUUAAAAGUUAUCCUGAU-3' (SEQ ID NO: 12814)

3'-UGUUAGAGAUAAUUUUCAAUAGGACUA-5' (SEQ ID NO: 5884)

C5-213 Target:
5'-ACAATCTCTATTAAAAGTTATCCTGAT-3' (SEQ ID NO: 8194)

5'-CAAUCUCUAUUAAAAGUUAUCCUGAUA-3' (SEQ ID NO: 12815)

3'-GUUAGAGAUAAUUUUCAAUAGGACUAU-5' (SEQ ID NO: 5885)

C5-214 Target:
5'-CAATCTCTATTAAAAGTTATCCTGATA-3' (SEQ ID NO: 8195)

5'-AAUCUCUAUUAAAAGUUAUCCUGAUAA-3' (SEQ ID NO: 12816)

3'-UUAGAGAUAAUUUUCAAUAGGACUAUU-5' (SEQ ID NO: 5886)

C5-215 Target:
5'-AATCTCTATTAAAAGTTATCCTGATAA-3' (SEQ ID NO: 8196)

5'-AUCUCUAUUAAAAGUUAUCCUGAUAAA-3' (SEQ ID NO: 12817)

3'-UAGAGAUAAUUUUCAAUAGGACUAUUU-5' (SEQ ID NO: 5887)

C5-216 Target:
5'-ATCTCTATTAAAAGTTATCCTGATAAA-3' (SEQ ID NO: 8197)

5'-UCUCUAUUAAAAGUUAUCCUGAUAAAA-3' (SEQ ID NO: 12818)

3'-AGAGAUAAUUUUCAAUAGGACUAUUUU-5' (SEQ ID NO: 5888)

C5-217 Target:
5'-TCTCTATTAAAAGTTATCCTGATAAAA-3' (SEQ ID NO: 8198)

5'-UCUAUUAAAAGUUAUCCUGAUAAAAA-3' (SEQ ID NO: 12819)

3'-AGAUAAUUUUCAAUAGGACUAUUUUU-5' (SEQ ID NO: 5889)

C5-219 Target:
5'-TCTATTAAAAGTTATCCTGATAAAAAA-3' (SEQ ID NO: 8199)

5'-UAUUAAAGUUAUCCUGAUAAAAAAUU-3' (SEQ ID NO: 12820)

3'-AUAAUUUUCAAUAGGACUAUUUUUUAA-5' (SEQ ID NO: 5890)

C5-221 Target:
5'-TATTAAAAGTTATCCTGATAAAAAATT-3' (SEQ ID NO: 8200)

5'-AUUAAAGUUAUCCUGAUAAAAAAUUU-3' (SEQ ID NO: 12821)

3'-UAAUUUUCAAUAGGACUAUUUUUUAAA-5' (SEQ ID NO: 5891)

C5-222 Target:
5'-ATTAAAAGTTATCCTGATAAAAAATTT-3' (SEQ ID NO: 8201)

5'-AAAAGUUAUCCUGAUAAAAAAUUUAGU-3' (SEQ ID NO: 12822)

3'-UUUUCAAUAGGACUAUUUUUUAAAUCA-5' (SEQ ID NO: 5892)

TABLE 9-continued

"Blunt/Blunt" DsiRNAs Corresponding to Human Anti-C5 DsiRNAs Predicted to have >50% Knockdown Efficacy C5-225 Target:
5'-AAAAGTTATCCTGATAAAAAATTTAGT-3' (SEQ ID NO: 8202)

5'-AAAGUUAUCCUGAUAAAAAAUUUAGUU-3' (SEQ ID NO: 12823)

3'-UUUCAAUAGGACUAUUUUUUAAAUCAA-5' (SEQ ID NO: 5893)

C5-226 Target:
5'-AAAGTTATCCTGATAAAAAATTTAGTT-3' (SEQ ID NO: 8203)

5'-GUUAUCCUGAUAAAAAAUUUAGUUACU-3' (SEQ ID NO: 12824)

3'-CAAUAGGACUAUUUUUUAAAUCAAUGA-5' (SEQ ID NO: 5894)

C5-229 Target:
5'-GTTATCCTGATAAAAAATTTAGTTACT-3' (SEQ ID NO: 8204)

5'-UUAUCCUGAUAAAAAAUUUAGUUACUC-3' (SEQ ID NO: 12825)

3'-AAUAGGACUAUUUUUUAAAUCAAUGAG-5' (SEQ ID NO: 5895)

C5-230 Target:
5'-TTATCCTGATAAAAAATTTAGTTACTC-3' (SEQ ID NO: 8205)

5'-UAUCCUGAUAAAAAAUUUAGUUACUCC-3' (SEQ ID NO: 12826)

3'-AUAGGACUAUUUUUUAAAUCAAUGAGG-5' (SEQ ID NO: 5896)

C5-231 Target:
5'-TATCCTGATAAAAAATTTAGTTACTCC-3' (SEQ ID NO: 8206)

5'-AUCCUGAUAAAAAAUUUAGUUACUCCU-3' (SEQ ID NO: 12827)

3'-UAGGACUAUUUUUUAAAUCAAUGAGGA-5' (SEQ ID NO: 5897)

C5-232 Target:
5'-ATCCTGATAAAAAATTTAGTTACTCCT-3' (SEQ ID NO: 8207)

5'-UCCUGAUAAAAAAUUUAGUUACUCCUC-3' (SEQ ID NO: 12828)

3'-AGGACUAUUUUUUAAAUCAAUGAGGAG-5' (SEQ ID NO: 5898)

C5-233 Target:
5'-TCCTGATAAAAAATTTAGTTACTCCTC-3' (SEQ ID NO: 8208)

5'-CCUGAUAAAAAAUUUAGUUACUCCUCA-3' (SEQ ID NO: 12829)

3'-GGACUAUUUUUUAAAUCAAUGAGGAGU-5' (SEQ ID NO: 5899)

C5-234 Target:
5'-CCTGATAAAAAATTTAGTTACTCCTCA-3' (SEQ ID NO: 8209)

5'-CUGAUAAAAAAUUUAGUUACUCCUCAG-3' (SEQ ID NO: 12830)

3'-GACUAUUUUUUAAAUCAAUGAGGAGUC-5' (SEQ ID NO: 5900)

C5-235 Target:
5'-CTGATAAAAAATTTAGTTACTCCTCAG-3' (SEQ ID NO: 8210)

5'-UGAUAAAAAAUUUAGUUACUCCUCAGG-3' (SEQ ID NO: 12831)

3'-ACUAUUUUUUAAAUCAAUGAGGAGUCC-5' (SEQ ID NO: 5901)

C5-236 Target:
5'-TGATAAAAAATTTAGTTACTCCTCAGG-3' (SEQ ID NO: 8211)

5'-GAUAAAAAAUUUAGUUACUCCUCAGGC-3' (SEQ ID NO: 12832)

3'-CUAUUUUUUAAAUCAAUGAGGAGUCCG-5' (SEQ ID NO: 5902)

TABLE 9-continued

"Blunt/Blunt" DsiRNAs Corresponding to Human Anti-C5 DsiRNAs Predicted to have >50% Knockdown Efficacy C5-237 Target:
5'-GATAAAAAATTTAGTTACTCCTCAGGC-3' (SEQ ID NO: 8212)

5'-AUAAAAAAUUUAGUUACUCCUCAGGCC-3' (SEQ ID NO: 12833)

3'-UAUUUUUUAAAUCAAUGAGGAGUCCGG-5' (SEQ ID NO: 5903)

C5-238 Target:
5'-ATAAAAAATTTAGTTACTCCTCAGGCC-3' (SEQ ID NO: 8213)

5'-UAAAAAAUUUAGUUACUCCUCAGGCCA-3' (SEQ ID NO: 12834)

3'-AUUUUUUAAAUCAAUGAGGAGUCCGGU-5' (SEQ ID NO: 5904)

C5-239 Target:
5'-TAAAAAATTTAGTTACTCCTCAGGCCA-3' (SEQ ID NO: 8214)

5'-AAAAAAUUUAGUUACUCCUCAGGCCAU-3' (SEQ ID NO: 12835)

3'-UUUUUUAAAUCAAUGAGGAGUCCGGUA-5' (SEQ ID NO: 5905)

C5-240 Target:
5'-AAAAAATTTAGTTACTCCTCAGGCCAT-3' (SEQ ID NO: 8215)

5'-AAAAAUUUAGUUACUCCUCAGGCCAUG-3' (SEQ ID NO: 12836)

3'-UUUUUAAAUCAAUGAGGAGUCCGGUAC-5' (SEQ ID NO: 5906)

C5-241 Target:
5'-AAAAATTTAGTTACTCCTCAGGCCATG-3' (SEQ ID NO: 8216)

5'-AAAAUUUAGUUACUCCUCAGGCCAUGU-3' (SEQ ID NO: 12837)

3'-UUUUAAAUCAAUGAGGAGUCCGGUACA-5' (SEQ ID NO: 5907)

C5-242 Target:
5'-AAAATTTAGTTACTCCTCAGGCCATGT-3' (SEQ ID NO: 8217)

5'-AAAUUUAGUUACUCCUCAGGCCAUGUU-3' (SEQ ID NO: 12838)

3'-UUUAAAUCAAUGAGGAGUCCGGUACAA-5' (SEQ ID NO: 5908)

C5-243 Target:
5'-AAATTTAGTTACTCCTCAGGCCATGTT-3' (SEQ ID NO: 8218)

5'-AAUUUAGUUACUCCUCAGGCCAUGUUC-3' (SEQ ID NO: 12839)

3'-UUAAAUCAAUGAGGAGUCCGGUACAAG-5' (SEQ ID NO: 5909)

C5-244 Target:
5'-AATTTAGTTACTCCTCAGGCCATGTTC-3' (SEQ ID NO: 8219)

5'-AUUUAGUUACUCCUCAGGCCAUGUUCA-3' (SEQ ID NO: 12840)

3'-UAAAUCAAUGAGGAGUCCGGUACAAGU-5' (SEQ ID NO: 5910)

C5-245 Target:
5'-ATTTAGTTACTCCTCAGGCCATGTTCA-3' (SEQ ID NO: 8220)

5'-UUUAGUUACUCCUCAGGCCAUGUUCAU-3' (SEQ ID NO: 12841)

3'-AAAUCAAUGAGGAGUCCGGUACAAGUA-5' (SEQ ID NO: 5911)

C5-246 Target:
5'-TTTAGTTACTCCTCAGGCCATGTTCAT-3' (SEQ ID NO: 8221)

5'-UUAGUUACUCCUCAGGCCAUGUUCAUU-3' (SEQ ID NO: 12842)

3'-AAUCAAUGAGGAGUCCGGUACAAGUAA-5' (SEQ ID NO: 5912)

C5-247 Target:
5'-TTAGTTACTCCTCAGGCCATGTTCATT-3' (SEQ ID NO: 8222)

5'-UAGUUACUCCUCAGGCCAUGUUCAUUU-3' (SEQ ID NO: 12843)

3'-AUCAAUGAGGAGUCCGGUACAAGUAAA-5' (SEQ ID NO: 5913)

C5-248 Target:
5'-TAGTTACTCCTCAGGCCATGTTCATTT-3' (SEQ ID NO: 8223)

5'-AGUUACUCCUCAGGCCAUGUUCAUUUA-3' (SEQ ID NO: 12844)

3'-UCAAUGAGGAGUCCGGUACAAGUAAAU-5' (SEQ ID NO: 5914)

C5-249 Target:
5'-AGTTACTCCTCAGGCCATGTTCATTTA-3' (SEQ ID NO: 8224)

5'-GUUACUCCUCAGGCCAUGUUCAUUUAU-3' (SEQ ID NO: 12845)

3'-CAAUGAGGAGUCCGGUACAAGUAAAUA-5' (SEQ ID NO: 5915)

C5-250 Target:
5'-GTTACTCCTCAGGCCATGTTCATTTAT-3' (SEQ ID NO: 8225)

5'-UUACUCCUCAGGCCAUGUUCAUUUAUC-3' (SEQ ID NO: 12846)

3'-AAUGAGGAGUCCGGUACAAGUAAAUAG-5' (SEQ ID NO: 5916)

C5-251 Target:
5'-TTACTCCTCAGGCCATGTTCATTTATC-3' (SEQ ID NO: 8226)

5'-UACUCCUCAGGCCAUGUUCAUUUAUCC-3' (SEQ ID NO: 12847)

3'-AUGAGGAGUCCGGUACAAGUAAAUAGG-5' (SEQ ID NO: 5917)

C5-252 Target:
5'-TACTCCTCAGGCCATGTTCATTTATCC-3' (SEQ ID NO: 8227)

5'-ACUCCUCAGGCCAUGUUCAUUUAUCCU-3' (SEQ ID NO: 12848)

3'-UGAGGAGUCCGGUACAAGUAAAUAGGA-5' (SEQ ID NO: 5918)

C5-253 Target:
5'-ACTCCTCAGGCCATGTTCATTTATCCT-3' (SEQ ID NO: 8228)

5'-CUCCUCAGGCCAUGUUCAUUUAUCCUC-3' (SEQ ID NO: 12849)

3'-GAGGAGUCCGGUACAAGUAAAUAGGAG-5' (SEQ ID NO: 5919)

C5-254 Target:
5'-CTCCTCAGGCCATGTTCATTTATCCTC-3' (SEQ ID NO: 8229)

5'-UCCUCAGGCCAUGUUCAUUUAUCCUCA-3' (SEQ ID NO: 12850)

3'-AGGAGUCCGGUACAAGUAAAUAGGAGU-5' (SEQ ID NO: 5920)

C5-255 Target:
5'-TCCTCAGGCCATGTTCATTTATCCTCA-3' (SEQ ID NO: 8230)

5'-CCUCAGGCCAUGUUCAUUUAUCCUCAG-3' (SEQ ID NO: 12851)

3'-GGAGUCCGGUACAAGUAAAUAGGAGUC-5' (SEQ ID NO: 5921)

C5-256 Target:
5'-CCTCAGGCCATGTTCATTTATCCTCAG-3' (SEQ ID NO: 8231)

5'-CUCAGGCCAUGUUCAUUUAUCCUCAGA-3' (SEQ ID NO: 12852)

3'-GAGUCCGGUACAAGUAAAUAGGAGUCU-5' (SEQ ID NO: 5922)

TABLE 9-continued

"Blunt/Blunt" DsiRNAs Corresponding to Human Anti-C5 DsiRNAs Predicted to have >50% Knockdown Efficacy C5-257 Target:
5'-CTCAGGCCATGTTCATTTATCCTCAGA-3' (SEQ ID NO: 8232)

5'-UCAGGCCAUGUUCAUUUAUCCUCAGAG-3' (SEQ ID NO: 12853)

3'-AGUCCGGUACAAGUAAAUAGGAGUCUC-5' (SEQ ID NO: 5923)

C5-258 Target:
5'-TCAGGCCATGTTCATTTATCCTCAGAG-3' (SEQ ID NO: 8233)

5'-CAGGCCAUGUUCAUUUAUCCUCAGAGA-3' (SEQ ID NO: 12854)

3'-GUCCGGUACAAGUAAAUAGGAGUCUCU-5' (SEQ ID NO: 5924)

C5-259 Target:
5'-CAGGCCATGTTCATTTATCCTCAGAGA-3' (SEQ ID NO: 8234)

5'-AGGCCAUGUUCAUUUAUCCUCAGAGAA-3' (SEQ ID NO: 12855)

3'-UCCGGUACAAGUAAAUAGGAGUCUCUU-5' (SEQ ID NO: 5925)

C5-260 Target:
5'-AGGCCATGTTCATTTATCCTCAGAGAA-3' (SEQ ID NO: 8235)

5'-GGCCAUGUUCAUUUAUCCUCAGAGAAU-3' (SEQ ID NO: 12856)

3'-CCGGUACAAGUAAAUAGGAGUCUCUUA-5' (SEQ ID NO: 5926)

C5-261 Target:
5'-GGCCATGTTCATTTATCCTCAGAGAAT-3' (SEQ ID NO: 8236)

5'-GCCAUGUUCAUUUAUCCUCAGAGAAUA-3' (SEQ ID NO: 12857)

3'-CGGUACAAGUAAAUAGGAGUCUCUUAU-5' (SEQ ID NO: 5927)

C5-262 Target:
5'-GCCATGTTCATTTATCCTCAGAGAATA-3' (SEQ ID NO: 8237)

5'-CCAUGUUCAUUUAUCCUCAGAGAAUAA-3' (SEQ ID NO: 12858)

3'-GGUACAAGUAAAUAGGAGUCUCUUAUU-5' (SEQ ID NO: 5928)

C5-263 Target:
5'-CCATGTTCATTTATCCTCAGAGAATAA-3' (SEQ ID NO: 8238)

5'-CAUGUUCAUUUAUCCUCAGAGAAUAAA-3' (SEQ ID NO: 12859)

3'-GUACAAGUAAAUAGGAGUCUCUUAUUU-5' (SEQ ID NO: 5929)

C5-264 Target:
5'-CATGTTCATTTATCCTCAGAGAATAAA-3' (SEQ ID NO: 8239)

5'-GUUCAUUUAUCCUCAGAGAAUAAAUUC-3' (SEQ ID NO: 12860)

3'-CAAGUAAAUAGGAGUCUCUUAUUUAAG-5' (SEQ ID NO: 5930)

C5-267 Target:
5'-GTTCATTTATCCTCAGAGAATAAATTC-3' (SEQ ID NO: 8240)

5'-UUCAUUUAUCCUCAGAGAAUAAAUUCC-3' (SEQ ID NO: 12861)

3'-AAGUAAAUAGGAGUCUCUUAUUUAAGG-5' (SEQ ID NO: 5931)

C5-268 Target:
5'-TTCATTTATCCTCAGAGAATAAATTCC-3' (SEQ ID NO: 8241)

5'-UCAUUUAUCCUCAGAGAAUAAAUUCCA-3' (SEQ ID NO: 12862)

3'-AGUAAAUAGGAGUCUCUUAUUUAAGGU-5' (SEQ ID NO: 5932)

TABLE 9-continued

"Blunt/Blunt" DsiRNAs Corresponding to Human Anti-C5 DsiRNAs Predicted to have >50% Knockdown Efficacy C5-269 Target:
5'-TCATTTATCCTCAGAGAATAAATTCCA-3' (SEQ ID NO: 8242)

5'-CAUUUAUCCUCAGAGAAUAAAUUCCAA-3' (SEQ ID NO: 12863)

3'-GUAAAUAGGAGUCUCUUAUUUAAGGUU-5' (SEQ ID NO: 5933)

C5-270 Target:
5'-CATTTATCCTCAGAGAATAAATTCCAA-3' (SEQ ID NO: 8243)

5'-AUUUAUCCUCAGAGAAUAAAUUCCAAA-3' (SEQ ID NO: 12864)

3'-UAAAUAGGAGUCUCUUAUUUAAGGUUU-5' (SEQ ID NO: 5934)

C5-271 Target:
5'-ATTTATCCTCAGAGAATAAATTCCAAA-3' (SEQ ID NO: 8244)

5'-UUUAUCCUCAGAGAAUAAAUUCCAAAA-3' (SEQ ID NO: 12865)

3'-AAAUAGGAGUCUCUUAUUUAAGGUUUU-5' (SEQ ID NO: 5935)

C5-272 Target:
5'-TTTATCCTCAGAGAATAAATTCCAAAA-3' (SEQ ID NO: 8245)

5'-UUAUCCUCAGAGAAUAAAUUCCAAAAC-3' (SEQ ID NO: 12866)

3'-AAUAGGAGUCUCUUAUUUAAGGUUUUG-5' (SEQ ID NO: 5936)

C5-273 Target:
5'-TTATCCTCAGAGAATAAATTCCAAAAC-3' (SEQ ID NO: 8246)

5'-UAUCCUCAGAGAAUAAAUUCCAAAACU-3' (SEQ ID NO: 12867)

3'-AUAGGAGUCUCUUAUUUAAGGUUUUGA-5' (SEQ ID NO: 5937)

C5-274 Target:
5'-TATCCTCAGAGAATAAATTCCAAAACT-3' (SEQ ID NO: 8247)

5'-AUCCUCAGAGAAUAAAUUCCAAAACUC-3' (SEQ ID NO: 12868)

3'-UAGGAGUCUCUUAUUUAAGGUUUUGAG-5' (SEQ ID NO: 5938)

C5-275 Target:
5'-ATCCTCAGAGAATAAATTCCAAAACTC-3' (SEQ ID NO: 8248)

5'-UCCUCAGAGAAUAAAUUCCAAAACUCU-3' (SEQ ID NO: 12869)

3'-AGGAGUCUCUUAUUUAAGGUUUUGAGA-5' (SEQ ID NO: 5939)

C5-276 Target:
5'-TCCTCAGAGAATAAATTCCAAAACTCT-3' (SEQ ID NO: 8249)

5'-CCUCAGAGAAUAAAUUCCAAAACUCUG-3' (SEQ ID NO: 12870)

3'-GGAGUCUCUUAUUUAAGGUUUUGAGAC-5' (SEQ ID NO: 5940)

C5-277 Target:
5'-CCTCAGAGAATAAATTCCAAAACTCTG-3' (SEQ ID NO: 8250)

5'-CUCAGAGAAUAAAUUCCAAAACUCUGC-3' (SEQ ID NO: 12871)

3'-GAGUCUCUUAUUUAAGGUUUUGAGACG-5' (SEQ ID NO: 5941)

C5-278 Target:
5'-CTCAGAGAATAAATTCCAAAACTCTGC-3' (SEQ ID NO: 8251)

5'-UCAGAGAAUAAAUUCCAAAACUCUGCA-3' (SEQ ID NO: 12872)

3'-AGUCUCUUAUUUAAGGUUUUGAGACGU-5' (SEQ ID NO: 5942)

TABLE 9-continued

"Blunt/Blunt" DsiRNAs Corresponding to Human Anti-C5 DsiRNAs Predicted to have >50% Knockdown Efficacy C5-279 Target:
5'-TCAGAGAATAAATTCCAAAACTCTGCA-3' (SEQ ID NO: 8252)

5'-CAGAGAAUAAAUUCCAAAACUCUGCAA-3' (SEQ ID NO: 12873)

3'-GUCUCUUAUUUAAGGUUUUGAGACGUU-5' (SEQ ID NO: 5943)

C5-280 Target:
5'-CAGAGAATAAATTCCAAAACTCTGCAA-3' (SEQ ID NO: 8253)

5'-AGAGAAUAAAUUCCAAAACUCUGCAAU-3' (SEQ ID NO: 12874)

3'-UCUCUUAUUUAAGGUUUUGAGACGUUA-5' (SEQ ID NO: 5944)

C5-281 Target:
5'-AGAGAATAAATTCCAAAACTCTGCAAT-3' (SEQ ID NO: 8254)

5'-AAUCUUAACAAUACAACCAAAACAAUU-3' (SEQ ID NO: 12875)

3'-UUAGAAUUGUUAUGUUGGUUUUGUUAA-5' (SEQ ID NO: 5945)

C5-305 Target:
5'-AATCTTAACAATACAACCAAAACAATT-3' (SEQ ID NO: 8255)

5'-AUCUUAACAAUACAACCAAAACAAUUG-3' (SEQ ID NO: 12876)

3'-UAGAAUUGUUAUGUUGGUUUUGUUAAC-5' (SEQ ID NO: 5946)

C5-306 Target:
5'-ATCTTAACAATACAACCAAAACAATTG-3' (SEQ ID NO: 8256)

5'-UCUUAACAAUACAACCAAAACAAUUGC-3' (SEQ ID NO: 12877)

3'-AGAAUUGUUAUGUUGGUUUUGUUAACG-5' (SEQ ID NO: 5947)

C5-307 Target:
5'-TCTTAACAATACAACCAAAACAATTGC-3' (SEQ ID NO: 8257)

5'-CUUAACAAUACAACCAAAACAAUUGCC-3' (SEQ ID NO: 12878)

3'-GAAUUGUUAUGUUGGUUUUGUUAACGG-5' (SEQ ID NO: 5948)

C5-308 Target:
5'-CTTAACAATACAACCAAAACAATTGCC-3' (SEQ ID NO: 8258)

5'-UUAACAAUACAACCAAAACAAUUGCCU-3' (SEQ ID NO: 12879)

3'-AAUUGUUAUGUUGGUUUUGUUAACGGA-5' (SEQ ID NO: 5949)

C5-309 Target:
5'-TTAACAATACAACCAAAACAATTGCCT-3' (SEQ ID NO: 8259)

5'-UAACAAUACAACCAAAACAAUUGCCUG-3' (SEQ ID NO: 12880)

3'-AUUGUUAUGUUGGUUUUGUUAACGGAC-5' (SEQ ID NO: 5950)

C5-310 Target:
5'-TAACAATACAACCAAAACAATTGCCTG-3' (SEQ ID NO: 8260)

5'-AACAAUACAACCAAAACAAUUGCCUGG-3' (SEQ ID NO: 12881)

3'-UUGUUAUGUUGGUUUUGUUAACGGACC-5' (SEQ ID NO: 5951)

C5-311 Target:
5'-AACAATACAACCAAAACAATTGCCTGG-3' (SEQ ID NO: 8261)

5'-GUAUUUGGAAGUUGUAUCAAAGCAUUU-3' (SEQ ID NO: 12882)

3'-CAUAAACCUUCAACAUAGUUUCGUAAA-5' (SEQ ID NO: 5952)

TABLE 9-continued

"Blunt/Blunt" DsiRNAs Corresponding to Human Anti-C5 DsiRNAs Predicted to have >50% Knockdown Efficacy C5-362 Target:
5'-GTATTTGGAAGTTGTATCAAAGCATTT-3' (SEQ ID NO: 8262)

5'-UAUUUGGAAGUUGUAUCAAAGCAUUUU-3' (SEQ ID NO: 12883)

3'-AUAAACCUUCAACAUAGUUUCGUAAAA-5' (SEQ ID NO: 5953)

C5-363 Target:
5'-TATTTGGAAGTTGTATCAAAGCATTTT-3' (SEQ ID NO: 8263)

5'-UGUAUCAAAGCAUUUUUCAAAAUCAAA-3' (SEQ ID NO: 12884)

3'-ACAUAGUUUCGUAAAAAGUUUUAGUUU-5' (SEQ ID NO: 5954)

C5-374 Target:
5'-TGTATCAAAGCATTTTTCAAAATCAAA-3' (SEQ ID NO: 8264)

5'-GUAUCAAAGCAUUUUUCAAAAUCAAAA-3' (SEQ ID NO: 12885)

3'-CAUAGUUUCGUAAAAAGUUUUAGUUUU-5' (SEQ ID NO: 5955)

C5-375 Target:
5'-GTATCAAAGCATTTTTCAAAATCAAAA-3' (SEQ ID NO: 8265)

5'-UAUCAAAGCAUUUUUCAAAAUCAAAAA-3' (SEQ ID NO: 12886)

3'-AUAGUUUCGUAAAAAGUUUUAGUUUUU-5' (SEQ ID NO: 5956)

C5-376 Target:
5'-TATCAAAGCATTTTTCAAAATCAAAAA-3' (SEQ ID NO: 8266)

5'-AUCAAAGCAUUUUUCAAAAUCAAAAAG-3' (SEQ ID NO: 12887)

3'-UAGUUUCGUAAAAAGUUUUAGUUUUUC-5' (SEQ ID NO: 5957)

C5-377 Target:
5'-ATCAAAGCATTTTTCAAAATCAAAAAG-3' (SEQ ID NO: 8267)

5'-UCAAAGCAUUUUUCAAAAUCAAAAAGA-3' (SEQ ID NO: 12888)

3'-AGUUUCGUAAAAAGUUUUAGUUUUUCU-5' (SEQ ID NO: 5958)

C5-378 Target:
5'-TCAAAGCATTTTTCAAAATCAAAAAGA-3' (SEQ ID NO: 8268)

5'-UGCCAAUAACCUAUGACAAUGGAUUUC-3' (SEQ ID NO: 12889)

3'-ACGGUUAUUGGAUACUGUUACCUAAAG-5' (SEQ ID NO: 5959)

C5-406 Target:
5'-TGCCAATAACCTATGACAATGGATTTC-3' (SEQ ID NO: 8269)

5'-GCCAAUAACCUAUGACAAUGGAUUUCU-3' (SEQ ID NO: 12890)

3'-CGGUUAUUGGAUACUGUUACCUAAAGA-5' (SEQ ID NO: 5960)

C5-407 Target:
5'-GCCAATAACCTATGACAATGGATTTCT-3' (SEQ ID NO: 8270)

5'-CAAUAACCUAUGACAAUGGAUUUCUCU-3' (SEQ ID NO: 12891)

3'-GUUAUUGGAUACUGUUACCUAAAGAGA-5' (SEQ ID NO: 5961)

C5-409 Target:
5'-CAATAACCTATGACAATGGATTTCTCT-3' (SEQ ID NO: 8271)

5'-AAUAACCUAUGACAAUGGAUUUCUCUU-3' (SEQ ID NO: 12892)

3'-UUAUUGGAUACUGUUACCUAAAGAGAA-5' (SEQ ID NO: 5962)

TABLE 9-continued

"Blunt/Blunt" DsiRNAs Corresponding to Human Anti-C5 DsiRNAs Predicted to have >50% Knockdown Efficacy C5-410 Target:
5'-AATAACCTATGACAATGGATTTCTCTT-3' (SEQ ID NO: 8272)

5'-AUAACCUAUGACAAUGGAUUUCUCUUC-3' (SEQ ID NO: 12893)

3'-UAUUGGAUACUGUUACCUAAAGAGAAG-5' (SEQ ID NO: 5963)

C5-411 Target:
5'-ATAACCTATGACAATGGATTTCTCTTC-3' (SEQ ID NO: 8273)

5'-UAACCUAUGACAAUGGAUUUCUCUUCA-3' (SEQ ID NO: 12894)

3'-AUUGGAUACUGUUACCUAAAGAGAAGU-5' (SEQ ID NO: 5964)

C5-412 Target:
5'-TAACCTATGACAATGGATTTCTCTTCA-3' (SEQ ID NO: 8274)

5'-AACCUAUGACAAUGGAUUUCUCUUCAU-3' (SEQ ID NO: 12895)

3'-UUGGAUACUGUUACCUAAAGAGAAGUA-5' (SEQ ID NO: 5965)

C5-413 Target:
5'-AACCTATGACAATGGATTTCTCTTCAT-3' (SEQ ID NO: 8275)

5'-CCUAUGACAAUGGAUUUCUCUUCAUUC-3' (SEQ ID NO: 12896)

3'-GGAUACUGUUACCUAAAGAGAAGUAAG-5' (SEQ ID NO: 5966)

C5-415 Target:
5'-CCTATGACAATGGATTTCTCTTCATTC-3' (SEQ ID NO: 8276)

5'-CUAUGACAAUGGAUUUCUCUUCAUUCA-3' (SEQ ID NO: 12897)

3'-GAUACUGUUACCUAAAGAGAAGUAAGU-5' (SEQ ID NO: 5967)

C5-416 Target:
5'-CTATGACAATGGATTTCTCTTCATTCA-3' (SEQ ID NO: 8277)

5'-UAUGACAAUGGAUUUCUCUUCAUUCAU-3' (SEQ ID NO: 12898)

3'-AUACUGUUACCUAAAGAGAAGUAAGUA-5' (SEQ ID NO: 5968)

C5-417 Target:
5'-TATGACAATGGATTTCTCTTCATTCAT-3' (SEQ ID NO: 8278)

5'-ACAAUGGAUUUCUCUUCAUUCAUACAG-3' (SEQ ID NO: 12899)

3'-UGUUACCUAAAGAGAAGUAAGUAUGUC-5' (SEQ ID NO: 5969)

C5-421 Target:
5'-ACAATGGATTTCTCTTCATTCATACAG-3' (SEQ ID NO: 8279)

5'-AUGGAUUUCUCUUCAUUCAUACAGACA-3' (SEQ ID NO: 12900)

3'-UACCUAAAGAGAAGUAAGUAUGUCUGU-5' (SEQ ID NO: 5970)

C5-424 Target:
5'-ATGGATTTCTCTTCATTCATACAGACA-3' (SEQ ID NO: 8280)

5'-GGAUUUCUCUUCAUUCAUACAGACAAA-3' (SEQ ID NO: 12901)

3'-CCUAAAGAGAAGUAAGUAUGUCUGUUU-5' (SEQ ID NO: 5971)

C5-426 Target:
5'-GGATTTCTCTTCATTCATACAGACAAA-3' (SEQ ID NO: 8281)

5'-GAUUUCUCUUCAUUCAUACAGACAAAC-3' (SEQ ID NO: 12902)

3'-CUAAAGAGAAGUAAGUAUGUCUGUUUG-5' (SEQ ID NO: 5972)

C5-427 Target:
5'-GATTTCTCTTCATTCATACAGACAAAC-3' (SEQ ID NO: 8282)

5'-AUUUCUCUUCAUUCAUACAGACAAACC-3' (SEQ ID NO: 12903)

3'-UAAAGAGAAGUAAGUAUGUCUGUUUGG-5' (SEQ ID NO: 5973)

C5-428 Target:
5'-ATTTCTCTTCATTCATACAGACAAACC-3' (SEQ ID NO: 8283)

5'-UUUCUCUUCAUUCAUACAGACAAACCU-3' (SEQ ID NO: 12904)

3'-AAAGAGAAGUAAGUAUGUCUGUUUGGA-5' (SEQ ID NO: 5974)

C5-429 Target:
5'-TTTCTCTTCATTCATACAGACAAACCT-3' (SEQ ID NO: 8284)

5'-UUCUCUUCAUUCAUACAGACAAACCUG-3' (SEQ ID NO: 12905)

3'-AAGAGAAGUAAGUAUGUCUGUUUGGAC-5' (SEQ ID NO: 5975)

C5-430 Target:
5'-TTCTCTTCATTCATACAGACAAACCTG-3' (SEQ ID NO: 8285)

5'-UCUCUUCAUUCAUACAGACAAACCUGU-3' (SEQ ID NO: 12906)

3'-AGAGAAGUAAGUAUGUCUGUUUGGACA-5' (SEQ ID NO: 5976)

C5-431 Target:
5'-TCTCTTCATTCATACAGACAAACCTGT-3' (SEQ ID NO: 8286)

5'-CUCUUCAUUCAUACAGACAAACCUGUU-3' (SEQ ID NO: 12907)

3'-GAGAAGUAAGUAUGUCUGUUUGGACAA-5' (SEQ ID NO: 5977)

C5-432 Target:
5'-CTCTTCATTCATACAGACAAACCTGTT-3' (SEQ ID NO: 8287)

5'-UCUUCAUUCAUACAGACAAACCUGUUU-3' (SEQ ID NO: 12908)

3'-AGAAGUAAGUAUGUCUGUUUGGACAAA-5' (SEQ ID NO: 5978)

C5-433 Target:
5'-TCTTCATTCATACAGACAAACCTGTTT-3' (SEQ ID NO: 8288)

5'-CUUCAUUCAUACAGACAAACCUGUUUA-3' (SEQ ID NO: 12909)

3'-GAAGUAAGUAUGUCUGUUUGGACAAAU-5' (SEQ ID NO: 5979)

C5-434 Target:
5'-CTTCATTCATACAGACAAACCTGTTTA-3' (SEQ ID NO: 8289)

5'-UUCAUUCAUACAGACAAACCUGUUUAU-3' (SEQ ID NO: 12910)

3'-AAGUAAGUAUGUCUGUUUGGACAAAUA-5' (SEQ ID NO: 5980)

C5-435 Target:
5'-TTCATTCATACAGACAAACCTGTTTAT-3' (SEQ ID NO: 8290)

5'-CAUUCAUACAGACAAACCUGUUUAUAC-3' (SEQ ID NO: 12911)

3'-GUAAGUAUGUCUGUUUGGACAAAUAUG-5' (SEQ ID NO: 5981)

C5-437 Target:
5'-CATTCATACAGACAAACCTGTTTATAC-3' (SEQ ID NO: 8291)

5'-CAUACAGACAAACCUGUUUAUACUCCA-3' (SEQ ID NO: 12912)

3'-GUAUGUCUGUUUGGACAAAUAUGAGGU-5' (SEQ ID NO: 5982)

TABLE 9-continued

"Blunt/Blunt" DsiRNAs Corresponding to Human Anti-C5 DsiRNAs Predicted to have >50% Knockdown Efficacy C5-441 Target:
5'-CATACAGACAAACCTGTTTATACTCCA-3' (SEQ ID NO: 8292)

5'-AUACAGACAAACCUGUUUAUACUCCAG-3' (SEQ ID NO: 12913)

3'-UAUGUCUGUUUGGACAAAUAUGAGGUC-5' (SEQ ID NO: 5983)

C5-442 Target:
5'-ATACAGACAAACCTGTTTATACTCCAG-3' (SEQ ID NO: 8293)

5'-UACAGACAAACCUGUUUAUACUCCAGA-3' (SEQ ID NO: 12914)

3'-AUGUCUGUUUGGACAAAUAUGAGGUCU-5' (SEQ ID NO: 5984)

C5-443 Target:
5'-TACAGACAAACCTGTTTATACTCCAGA-3' (SEQ ID NO: 8294)

5'-ACAGACAAACCUGUUUAUACUCCAGAC-3' (SEQ ID NO: 12915)

3'-UGUCUGUUUGGACAAAUAUGAGGUCUG-5' (SEQ ID NO: 5985)

C5-444 Target:
5'-ACAGACAAACCTGTTTATACTCCAGAC-3' (SEQ ID NO: 8295)

5'-CAGACAAACCUGUUUAUACUCCAGACC-3' (SEQ ID NO: 12916)

3'-GUCUGUUUGGACAAAUAUGAGGUCUGG-5' (SEQ ID NO: 5986)

C5-445 Target:
5'-CAGACAAACCTGTTTATACTCCAGACC-3' (SEQ ID NO: 8296)

5'-AGACAAACCUGUUUAUACUCCAGACCA-3' (SEQ ID NO: 12917)

3'-UCUGUUUGGACAAAUAUGAGGUCUGGU-5' (SEQ ID NO: 5987)

C5-446 Target:
5'-AGACAAACCTGTTTATACTCCAGACCA-3' (SEQ ID NO: 8297)

5'-GACAAACCUGUUUAUACUCCAGACCAG-3' (SEQ ID NO: 12918)

3'-CUGUUUGGACAAAUAUGAGGUCUGGUC-5' (SEQ ID NO: 5988)

C5-447 Target:
5'-GACAAACCTGTTTATACTCCAGACCAG-3' (SEQ ID NO: 8298)

5'-ACAAACCUGUUUAUACUCCAGACCAGU-3' (SEQ ID NO: 12919)

3'-UGUUUGGACAAAUAUGAGGUCUGGUCA-5' (SEQ ID NO: 5989)

C5-448 Target:
5'-ACAAACCTGTTTATACTCCAGACCAGT-3' (SEQ ID NO: 8299)

5'-CAAACCUGUUUAUACUCCAGACCAGUC-3' (SEQ ID NO: 12920)

3'-GUUUGGACAAAUAUGAGGUCUGGUCAG-5' (SEQ ID NO: 5990)

C5-449 Target:
5'-CAAACCTGTTTATACTCCAGACCAGTC-3' (SEQ ID NO: 8300)

5'-AAACCUGUUUAUACUCCAGACCAGUCA-3' (SEQ ID NO: 12921)

3'-UUUGGACAAAUAUGAGGUCUGGUCAGU-5' (SEQ ID NO: 5991)

C5-450 Target:
5'-AAACCTGTTTATACTCCAGACCAGTCA-3' (SEQ ID NO: 8301)

5'-AACCUGUUUAUACUCCAGACCAGUCAG-3' (SEQ ID NO: 12922)

3'-UUGGACAAAUAUGAGGUCUGGUCAGUC-5' (SEQ ID NO: 5992)

C5-451 Target:
5'-AACCTGTTTATACTCCAGACCAGTCAG-3' (SEQ ID NO: 8302)

5'-ACCUGUUUAUACUCCAGACCAGUCAGU-3' (SEQ ID NO: 12923)

3'-UGGACAAAUAUGAGGUCUGGUCAGUCA-5' (SEQ ID NO: 5993)

C5-452 Target:
5'-ACCTGTTTATACTCCAGACCAGTCAGT-3' (SEQ ID NO: 8303)

5'-AGUUAGAGUUUAUUCGUUGAAUGACGA-3' (SEQ ID NO: 12924)

3'-UCAAUCUCAAAUAAGCAACUUACUGCU-5' (SEQ ID NO: 5994)

C5-482 Target:
5'-AGTTAGAGTTTATTCGTTGAATGACGA-3' (SEQ ID NO: 8304)

5'-GUUAGAGUUUAUUCGUUGAAUGACGAC-3' (SEQ ID NO: 12925)

3'-CAAUCUCAAAUAAGCAACUUACUGCUG-5' (SEQ ID NO: 5995)

C5-483 Target:
5'-GTTAGAGTTTATTCGTTGAATGACGAC-3' (SEQ ID NO: 8305)

5'-UUAGAGUUUAUUCGUUGAAUGACGACU-3' (SEQ ID NO: 12926)

3'-AAUCUCAAAUAAGCAACUUACUGCUGA-5' (SEQ ID NO: 5996)

C5-484 Target:
5'-TTAGAGTTTATTCGTTGAATGACGACT-3' (SEQ ID NO: 8306)

5'-UAGAGUUUAUUCGUUGAAUGACGACUU-3' (SEQ ID NO: 12927)

3'-AUCUCAAAUAAGCAACUUACUGCUGAA-5' (SEQ ID NO: 5997)

C5-485 Target:
5'-TAGAGTTTATTCGTTGAATGACGACTT-3' (SEQ ID NO: 8307)

5'-ACGACUUGAAGCCAGCCAAAAGAGAAA-3' (SEQ ID NO: 12928)

3'-UGCUGAACUUCGGUCGGUUUUCUCUUU-5' (SEQ ID NO: 5998)

C5-505 Target:
5'-ACGACTTGAAGCCAGCCAAAAGAGAAA-3' (SEQ ID NO: 8308)

5'-CGACUUGAAGCCAGCCAAAAGAGAAAC-3' (SEQ ID NO: 12929)

3'-GCUGAACUUCGGUCGGUUUUCUCUUUG-5' (SEQ ID NO: 5999)

C5-506 Target:
5'-CGACTTGAAGCCAGCCAAAAGAGAAAC-3' (SEQ ID NO: 8309)

5'-GACUUGAAGCCAGCCAAAAGAGAAACU-3' (SEQ ID NO: 12930)

3'-CUGAACUUCGGUCGGUUUUCUCUUUGA-5' (SEQ ID NO: 6000)

C5-507 Target:
5'-GACTTGAAGCCAGCCAAAAGAGAAACT-3' (SEQ ID NO: 8310)

5'-ACUUGAAGCCAGCCAAAAGAGAAACUG-3' (SEQ ID NO: 12931)

3'-UGAACUUCGGUCGGUUUUCUCUUUGAC-5' (SEQ ID NO: 6001)

C5-508 Target:
5'-ACTTGAAGCCAGCCAAAAGAGAAACTG-3' (SEQ ID NO: 8311)

5'-CUUGAAGCCAGCCAAAAGAGAAACUGU-3' (SEQ ID NO: 12932)

3'-GAACUUCGGUCGGUUUUCUCUUUGACA-5' (SEQ ID NO: 6002)

TABLE 9-continued

"Blunt/Blunt" DsiRNAs Corresponding to Human Anti-C5 DsiRNAs Predicted to have >50% Knockdown Efficacy C5-509 Target:
5'-CTTGAAGCCAGCCAAAAGAGAAACTGT-3' (SEQ ID NO: 8312)

5'-UUGAAGCCAGCCAAAAGAGAAACUGUC-3' (SEQ ID NO: 12933)

3'-AACUUCGGUCGGUUUUCUCUUUGACAG-5' (SEQ ID NO: 6003)

C5-510 Target:
5'-TTGAAGCCAGCCAAAAGAGAAACTGTC-3' (SEQ ID NO: 8313)

5'-UGAAGCCAGCCAAAAGAGAAACUGUCU-3' (SEQ ID NO: 12934)

3'-ACUUCGGUCGGUUUUCUCUUUGACAGA-5' (SEQ ID NO: 6004)

C5-511 Target:
5'-TGAAGCCAGCCAAAAGAGAAACTGTCT-3' (SEQ ID NO: 8314)

5'-GAAGCCAGCCAAAAGAGAAACUGUCUU-3' (SEQ ID NO: 12935)

3'-CUUCGGUCGGUUUUCUCUUUGACAGAA-5' (SEQ ID NO: 6005)

C5-512 Target:
5'-GAAGCCAGCCAAAAGAGAAACTGTCTT-3' (SEQ ID NO: 8315)

5'-AAGCCAGCCAAAAGAGAAACUGUCUUA-3' (SEQ ID NO: 12936)

3'-UUCGGUCGGUUUUCUCUUUGACAGAAU-5' (SEQ ID NO: 6006)

C5-513 Target:
5'-AAGCCAGCCAAAAGAGAAACTGTCTTA-3' (SEQ ID NO: 8316)

5'-AGCCAGCCAAAAGAGAAACUGUCUUAA-3' (SEQ ID NO: 12937)

3'-UCGGUCGGUUUUCUCUUUGACAGAAUU-5' (SEQ ID NO: 6007)

C5-514 Target:
5'-AGCCAGCCAAAAGAGAAACTGTCTTAA-3' (SEQ ID NO: 8317)

5'-GCCAGCCAAAAGAGAAACUGUCUUAAC-3' (SEQ ID NO: 12938)

3'-CGGUCGGUUUUCUCUUUGACAGAAUUG-5' (SEQ ID NO: 6008)

C5-515 Target:
5'-GCCAGCCAAAAGAGAAACTGTCTTAAC-3' (SEQ ID NO: 8318)

5'-CCAGCCAAAAGAGAAACUGUCUUAACU-3' (SEQ ID NO: 12939)

3'-GGUCGGUUUUCUCUUUGACAGAAUUGA-5' (SEQ ID NO: 6009)

C5-516 Target:
5'-CCAGCCAAAAGAGAAACTGTCTTAACT-3' (SEQ ID NO: 8319)

5'-CAGCCAAAAGAGAAACUGUCUUAACUU-3' (SEQ ID NO: 12940)

3'-GUCGGUUUUCUCUUUGACAGAAUUGAA-5' (SEQ ID NO: 6010)

C5-517 Target:
5'-CAGCCAAAAGAGAAACTGTCTTAACTT-3' (SEQ ID NO: 8320)

5'-AGCCAAAAGAGAAACUGUCUUAACUUU-3' (SEQ ID NO: 12941)

3'-UCGGUUUUCUCUUUGACAGAAUUGAAA-5' (SEQ ID NO: 6011)

C5-518 Target:
5'-AGCCAAAAGAGAAACTGTCTTAACTTT-3' (SEQ ID NO: 8321)

5'-GCCAAAAGAGAAACUGUCUUAACUUUC-3' (SEQ ID NO: 12942)

3'-CGGUUUUCUCUUUGACAGAAUUGAAAG-5' (SEQ ID NO: 6012)

C5-519 Target:
5'-GCCAAAAGAGAAACTGTCTTAACTTTC-3' (SEQ ID NO: 8322)

5'-CCAAAAGAGAAACUGUCUUAACUUUCA-3' (SEQ ID NO: 12943)

3'-GGUUUUCUCUUUGACAGAAUUGAAAGU-5' (SEQ ID NO: 6013)

C5-520 Target:
5'-CCAAAAGAGAAACTGTCTTAACTTTCA-3' (SEQ ID NO: 8323)

5'-CAAAAGAGAAACUGUCUUAACUUUCAU-3' (SEQ ID NO: 12944)

3'-GUUUUCUCUUUGACAGAAUUGAAAGUA-5' (SEQ ID NO: 6014)

C5-521 Target:
5'-CAAAAGAGAAACTGTCTTAACTTTCAT-3' (SEQ ID NO: 8324)

5'-AAAAGAGAAACUGUCUUAACUUUCAUA-3' (SEQ ID NO: 12945)

3'-UUUUCUCUUUGACAGAAUUGAAAGUAU-5' (SEQ ID NO: 6015)

C5-522 Target:
5'-AAAAGAGAAACTGTCTTAACTTTCATA-3' (SEQ ID NO: 8325)

5'-AAAGAGAAACUGUCUUAACUUUCAUAG-3' (SEQ ID NO: 12946)

3'-UUUCUCUUUGACAGAAUUGAAAGUAUC-5' (SEQ ID NO: 6016)

C5-523 Target:
5'-AAAGAGAAACTGTCTTAACTTTCATAG-3' (SEQ ID NO: 8326)

5'-AAGAGAAACUGUCUUAACUUUCAUAGA-3' (SEQ ID NO: 12947)

3'-UUCUCUUUGACAGAAUUGAAAGUAUCU-5' (SEQ ID NO: 6017)

C5-524 Target:
5'-AAGAGAAACTGTCTTAACTTTCATAGA-3' (SEQ ID NO: 8327)

5'-GAGAAACUGUCUUAACUUUCAUAGAUC-3' (SEQ ID NO: 12948)

3'-CUCUUUGACAGAAUUGAAAGUAUCUAG-5' (SEQ ID NO: 6018)

C5-526 Target:
5'-GAGAAACTGTCTTAACTTTCATAGATC-3' (SEQ ID NO: 8328)

5'-AGAAACUGUCUUAACUUUCAUAGAUCC-3' (SEQ ID NO: 12949)

3'-UCUUUGACAGAAUUGAAAGUAUCUAGG-5' (SEQ ID NO: 6019)

C5-527 Target:
5'-AGAAACTGTCTTAACTTTCATAGATCC-3' (SEQ ID NO: 8329)

5'-GAAACUGUCUUAACUUUCAUAGAUCCU-3' (SEQ ID NO: 12950)

3'-CUUUGACAGAAUUGAAAGUAUCUAGGA-5' (SEQ ID NO: 6020)

C5-528 Target:
5'-GAAACTGTCTTAACTTTCATAGATCCT-3' (SEQ ID NO: 8330)

5'-ACUGUCUUAACUUUCAUAGAUCCUGAA-3' (SEQ ID NO: 12951)

3'-UGACAGAAUUGAAAGUAUCUAGGACUU-5' (SEQ ID NO: 6021)

C5-531 Target:
5'-ACTGTCTTAACTTTCATAGATCCTGAA-3' (SEQ ID NO: 8331)

5'-CUGUCUUAACUUUCAUAGAUCCUGAAG-3' (SEQ ID NO: 12952)

3'-GACAGAAUUGAAAGUAUCUAGGACUUC-5' (SEQ ID NO: 6022)

TABLE 9-continued

"Blunt/Blunt" DsiRNAs Corresponding to Human Anti-C5 DsiRNAs Predicted to have >50% Knockdown Efficacy C5-532 Target:
5'-CTGTCTTAACTTTCATAGATCCTGAAG-3' (SEQ ID NO: 8332)

5'-UGUCUUAACUUUCAUAGAUCCUGAAGG-3' (SEQ ID NO: 12953)

3'-ACAGAAUUGAAAGUAUCUAGGACUUCC-5' (SEQ ID NO: 6023)

C5-533 Target:
5'-TGTCTTAACTTTCATAGATCCTGAAGG-3' (SEQ ID NO: 8333)

5'-GUCUUAACUUUCAUAGAUCCUGAAGGA-3' (SEQ ID NO: 12954)

3'-CAGAAUUGAAAGUAUCUAGGACUUCCU-5' (SEQ ID NO: 6024)

C5-534 Target:
5'-GTCTTAACTTTCATAGATCCTGAAGGA-3' (SEQ ID NO: 8334)

5'-UCUUAACUUUCAUAGAUCCUGAAGGAU-3' (SEQ ID NO: 12955)

3'-AGAAUUGAAAGUAUCUAGGACUUCCUA-5' (SEQ ID NO: 6025)

C5-535 Target:
5'-TCTTAACTTTCATAGATCCTGAAGGAT-3' (SEQ ID NO: 8335)

5'-CUUAACUUUCAUAGAUCCUGAAGGAUC-3' (SEQ ID NO: 12956)

3'-GAAUUGAAAGUAUCUAGGACUUCCUAG-5' (SEQ ID NO: 6026)

C5-536 Target:
5'-CTTAACTTTCATAGATCCTGAAGGATC-3' (SEQ ID NO: 8336)

5'-UUAACUUUCAUAGAUCCUGAAGGAUCA-3' (SEQ ID NO: 12957)

3'-AAUUGAAAGUAUCUAGGACUUCCUAGU-5' (SEQ ID NO: 6027)

C5-537 Target:
5'-TTAACTTTCATAGATCCTGAAGGATCA-3' (SEQ ID NO: 8337)

5'-UAACUUUCAUAGAUCCUGAAGGAUCAG-3' (SEQ ID NO: 12958)

3'-AUUGAAAGUAUCUAGGACUUCCUAGUC-5' (SEQ ID NO: 6028)

C5-538 Target:
5'-TAACTTTCATAGATCCTGAAGGATCAG-3' (SEQ ID NO: 8338)

5'-AACUUUCAUAGAUCCUGAAGGAUCAGA-3' (SEQ ID NO: 12959)

3'-UUGAAAGUAUCUAGGACUUCCUAGUCU-5' (SEQ ID NO: 6029)

C5-539 Target:
5'-AACTTTCATAGATCCTGAAGGATCAGA-3' (SEQ ID NO: 8339)

5'-ACUUUCAUAGAUCCUGAAGGAUCAGAA-3' (SEQ ID NO: 12960)

3'-UGAAAGUAUCUAGGACUUCCUAGUCUU-5' (SEQ ID NO: 6030)

C5-540 Target:
5'-ACTTTCATAGATCCTGAAGGATCAGAA-3' (SEQ ID NO: 8340)

5'-CUUUCAUAGAUCCUGAAGGAUCAGAAG-3' (SEQ ID NO: 12961)

3'-GAAAGUAUCUAGGACUUCCUAGUCUUC-5' (SEQ ID NO: 6031)

C5-541 Target:
5'-CTTTCATAGATCCTGAAGGATCAGAAG-3' (SEQ ID NO: 8341)

5'-UUUCAUAGAUCCUGAAGGAUCAGAAGU-3' (SEQ ID NO: 12962)

3'-AAAGUAUCUAGGACUUCCUAGUCUUCA-5' (SEQ ID NO: 6032)

TABLE 9-continued

"Blunt/Blunt" DsiRNAs Corresponding to Human Anti-C5 DsiRNAs Predicted to have >50% Knockdown Efficacy C5-542 Target:
5'-TTTCATAGATCCTGAAGGATCAGAAGT-3' (SEQ ID NO: 8342)

5'-UUCAUAGAUCCUGAAGGAUCAGAAGUU-3' (SEQ ID NO: 12963)

3'-AAGUAUCUAGGACUUCCUAGUCUUCAA-5' (SEQ ID NO: 6033)

C5-543 Target:
5'-TTCATAGATCCTGAAGGATCAGAAGTT-3' (SEQ ID NO: 8343)

5'-UCAUAGAUCCUGAAGGAUCAGAAGUUG-3' (SEQ ID NO: 12964)

3'-AGUAUCUAGGACUUCCUAGUCUUCAAC-5' (SEQ ID NO: 6034)

C5-544 Target:
5'-TCATAGATCCTGAAGGATCAGAAGTTG-3' (SEQ ID NO: 8344)

5'-CAUAGAUCCUGAAGGAUCAGAAGUUGA-3' (SEQ ID NO: 12965)

3'-GUAUCUAGGACUUCCUAGUCUUCAACU-5' (SEQ ID NO: 6035)

C5-545 Target:
5'-CATAGATCCTGAAGGATCAGAAGTTGA-3' (SEQ ID NO: 8345)

5'-AUAGAUCCUGAAGGAUCAGAAGUUGAC-3' (SEQ ID NO: 12966)

3'-UAUCUAGGACUUCCUAGUCUUCAACUG-5' (SEQ ID NO: 6036)

C5-546 Target:
5'-ATAGATCCTGAAGGATCAGAAGTTGAC-3' (SEQ ID NO: 8346)

5'-AGUUGACAUGGUAGAAGAAAUUGAUCA-3' (SEQ ID NO: 12967)

3'-UCAACUGUACCAUCUUCUUUAACUAGU-5' (SEQ ID NO: 6037)

C5-566 Target:
5'-AGTTGACATGGTAGAAGAAATTGATCA-3' (SEQ ID NO: 8347)

5'-GUUGACAUGGUAGAAGAAAUUGAUCAU-3' (SEQ ID NO: 12968)

3'-CAACUGUACCAUCUUCUUUAACUAGUA-5' (SEQ ID NO: 6038)

C5-567 Target:
5'-GTTGACATGGTAGAAGAAATTGATCAT-3' (SEQ ID NO: 8348)

5'-GACAUGGUAGAAGAAAUUGAUCAUAUU-3' (SEQ ID NO: 12969)

3'-CUGUACCAUCUUCUUUAACUAGUAUAA-5' (SEQ ID NO: 6039)

C5-570 Target:
5'-GACATGGTAGAAGAAATTGATCATATT-3' (SEQ ID NO: 8349)

5'-ACAUGGUAGAAGAAAUUGAUCAUAUUG-3' (SEQ ID NO: 12970)

3'-UGUACCAUCUUCUUUAACUAGUAUAAC-5' (SEQ ID NO: 6040)

C5-571 Target:
5'-ACATGGTAGAAGAAATTGATCATATTG-3' (SEQ ID NO: 8350)

5'-CAUGGUAGAAGAAAUUGAUCAUAUUGG-3' (SEQ ID NO: 12971)

3'-GUACCAUCUUCUUUAACUAGUAUAACC-5' (SEQ ID NO: 6041)

C5-572 Target:
5'-CATGGTAGAAGAAATTGATCATATTGG-3' (SEQ ID NO: 8351)

5'-GGUAGAAGAAAUUGAUCAUAUUGGAAU-3' (SEQ ID NO: 12972)

3'-CCAUCUUCUUUAACUAGUAUAACCUUA-5' (SEQ ID NO: 6042)

TABLE 9-continued

"Blunt/Blunt" DsiRNAs Corresponding to Human Anti-C5 DsiRNAs Predicted to have >50% Knockdown Efficacy C5-575 Target:
5'-GGTAGAAGAAATTGATCATATTGGAAT-3' (SEQ ID NO: 8352)

5'-GUAGAAGAAAUUGAUCAUAUUGGAAUU-3' (SEQ ID NO: 12973)

3'-CAUCUUCUUUAACUAGUAUAACCUUAA-5' (SEQ ID NO: 6043)

C5-576 Target:
5'-GTAGAAGAAATTGATCATATTGGAATT-3' (SEQ ID NO: 8353)

5'-UAGAAGAAAUUGAUCAUAUUGGAAUUA-3' (SEQ ID NO: 12974)

3'-AUCUUCUUUAACUAGUAUAACCUUAAU-5' (SEQ ID NO: 6044)

C5-577 Target:
5'-TAGAAGAAATTGATCATATTGGAATTA-3' (SEQ ID NO: 8354)

5'-AAGAAAUUGAUCAUAUUGGAAUUAUCU-3' (SEQ ID NO: 12975)

3'-UUCUUUAACUAGUAUAACCUUAAUAGA-5' (SEQ ID NO: 6045)

C5-580 Target:
5'-AAGAAATTGATCATATTGGAATTATCT-3' (SEQ ID NO: 8355)

5'-AGAAAUUGAUCAUAUUGGAAUUAUCUC-3' (SEQ ID NO: 12976)

3'-UCUUUAACUAGUAUAACCUUAAUAGAG-5' (SEQ ID NO: 6046)

C5-581 Target:
5'-AGAAATTGATCATATTGGAATTATCTC-3' (SEQ ID NO: 8356)

5'-GAAAUUGAUCAUAUUGGAAUUAUCUCU-3' (SEQ ID NO: 12977)

3'-CUUUAACUAGUAUAACCUUAAUAGAGA-5' (SEQ ID NO: 6047)

C5-582 Target:
5'-GAAATTGATCATATTGGAATTATCTCT-3' (SEQ ID NO: 8357)

5'-AAAUUGAUCAUAUUGGAAUUAUCUCUU-3' (SEQ ID NO: 12978)

3'-UUUAACUAGUAUAACCUUAAUAGAGAA-5' (SEQ ID NO: 6048)

C5-583 Target:
5'-AAATTGATCATATTGGAATTATCTCTT-3' (SEQ ID NO: 8358)

5'-AAUUGAUCAUAUUGGAAUUAUCUCUUU-3' (SEQ ID NO: 12979)

3'-UUAACUAGUAUAACCUUAAUAGAGAAA-5' (SEQ ID NO: 6049)

C5-584 Target:
5'-AATTGATCATATTGGAATTATCTCTTT-3' (SEQ ID NO: 8359)

5'-AUUGAUCAUAUUGGAAUUAUCUCUUUU-3' (SEQ ID NO: 12980)

3'-UAACUAGUAUAACCUUAAUAGAGAAAA-5' (SEQ ID NO: 6050)

C5-585 Target:
5'-ATTGATCATATTGGAATTATCTCTTTT-3' (SEQ ID NO: 8360)

5'-UUGAUCAUAUUGGAAUUAUCUCUUUUC-3' (SEQ ID NO: 12981)

3'-AACUAGUAUAACCUUAAUAGAGAAAAG-5' (SEQ ID NO: 6051)

C5-586 Target:
5'-TTGATCATATTGGAATTATCTCTTTTC-3' (SEQ ID NO: 8361)

5'-UGAUCAUAUUGGAAUUAUCUCUUUUCC-3' (SEQ ID NO: 12982)

3'-ACUAGUAUAACCUUAAUAGAGAAAAGG-5' (SEQ ID NO: 6052)

C5-587 Target:
5'-TGATCATATTGGAATTATCTCTTTTCC-3' (SEQ ID NO: 8362)

5'-GAUCAUAUUGGAAUUAUCUCUUUUCCU-3' (SEQ ID NO: 12983)

3'-CUAGUAUAACCUUAAUAGAGAAAAGGA-5' (SEQ ID NO: 6053)

C5-588 Target:
5'-GATCATATTGGAATTATCTCTTTTCCT-3' (SEQ ID NO: 8363)

5'-AUCAUAUUGGAAUUAUCUCUUUUCCUG-3' (SEQ ID NO: 12984)

3'-UAGUAUAACCUUAAUAGAGAAAAGGAC-5' (SEQ ID NO: 6054)

C5-589 Target:
5'-ATCATATTGGAATTATCTCTTTTCCTG-3' (SEQ ID NO: 8364)

5'-UCAUAUUGGAAUUAUCUCUUUUCCUGA-3' (SEQ ID NO: 12985)

3'-AGUAUAACCUUAAUAGAGAAAAGGACU-5' (SEQ ID NO: 6055)

C5-590 Target:
5'-TCATATTGGAATTATCTCTTTTCCTGA-3' (SEQ ID NO: 8365)

5'-CAUAUUGGAAUUAUCUCUUUUCCUGAC-3' (SEQ ID NO: 12986)

3'-GUAUAACCUUAAUAGAGAAAAGGACUG-5' (SEQ ID NO: 6056)

C5-591 Target:
5'-CATATTGGAATTATCTCTTTTCCTGAC-3' (SEQ ID NO: 8366)

5'-AUAUUGGAAUUAUCUCUUUUCCUGACU-3' (SEQ ID NO: 12987)

3'-UAUAACCUUAAUAGAGAAAAGGACUGA-5' (SEQ ID NO: 6057)

C5-592 Target:
5'-ATATTGGAATTATCTCTTTTCCTGACT-3' (SEQ ID NO: 8367)

5'-UAUUGGAAUUAUCUCUUUUCCUGACUU-3' (SEQ ID NO: 12988)

3'-AUAACCUUAAUAGAGAAAAGGACUGAA-5' (SEQ ID NO: 6058)

C5-593 Target:
5'-TATTGGAATTATCTCTTTTCCTGACTT-3' (SEQ ID NO: 8368)

5'-AUUGGAAUUAUCUCUUUUCCUGACUUC-3' (SEQ ID NO: 12989)

3'-UAACCUUAAUAGAGAAAAGGACUGAAG-5' (SEQ ID NO: 6059)

C5-594 Target:
5'-ATTGGAATTATCTCTTTTCCTGACTTC-3' (SEQ ID NO: 8369)

5'-UUUCCUGACUUCAAGAUUCCGUCUAAU-3' (SEQ ID NO: 12990)

3'-AAAGGACUGAAGUUCUAAGGCAGAUUA-5' (SEQ ID NO: 6060)

C5-609 Target:
5'-TTTCCTGACTTCAAGATTCCGTCTAAT-3' (SEQ ID NO: 8370)

5'-UUCCUGACUUCAAGAUUCCGUCUAAUC-3' (SEQ ID NO: 12991)

3'-AAGGACUGAAGUUCUAAGGCAGAUUAG-5' (SEQ ID NO: 6061)

C5-610 Target:
5'-TTCCTGACTTCAAGATTCCGTCTAATC-3' (SEQ ID NO: 8371)

5'-UCCUGACUUCAAGAUUCCGUCUAAUCC-3' (SEQ ID NO: 12992)

3'-AGGACUGAAGUUCUAAGGCAGAUUAGG-5' (SEQ ID NO: 6062)

TABLE 9-continued

"Blunt/Blunt" DsiRNAs Corresponding to Human Anti-C5 DsiRNAs Predicted to have >50% Knockdown Efficacy C5-611 Target:
5'-TCCTGACTTCAAGATTCCGTCTAATCC-3' (SEQ ID NO: 8372)

5'-CCUGACUUCAAGAUUCCGUCUAAUCCU-3' (SEQ ID NO: 12993)

3'-GGACUGAAGUUCUAAGGCAGAUUAGGA-5' (SEQ ID NO: 6063)

C5-612 Target:
5'-CCTGACTTCAAGATTCCGTCTAATCCT-3' (SEQ ID NO: 8373)

5'-CUGACUUCAAGAUUCCGUCUAAUCCUA-3' (SEQ ID NO: 12994)

3'-GACUGAAGUUCUAAGGCAGAUUAGGAU-5' (SEQ ID NO: 6064)

C5-613 Target:
5'-CTGACTTCAAGATTCCGTCTAATCCTA-3' (SEQ ID NO: 8374)

5'-UGACUUCAAGAUUCCGUCUAAUCCUAG-3' (SEQ ID NO: 12995)

3'-ACUGAAGUUCUAAGGCAGAUUAGGAUC-5' (SEQ ID NO: 6065)

C5-614 Target:
5'-TGACTTCAAGATTCCGTCTAATCCTAG-3' (SEQ ID NO: 8375)

5'-GACUUCAAGAUUCCGUCUAAUCCUAGA-3' (SEQ ID NO: 12996)

3'-CUGAAGUUCUAAGGCAGAUUAGGAUCU-5' (SEQ ID NO: 6066)

C5-615 Target:
5'-GACTTCAAGATTCCGTCTAATCCTAGA-3' (SEQ ID NO: 8376)

5'-ACUUCAAGAUUCCGUCUAAUCCUAGAU-3' (SEQ ID NO: 12997)

3'-UGAAGUUCUAAGGCAGAUUAGGAUCUA-5' (SEQ ID NO: 6067)

C5-616 Target:
5'-ACTTCAAGATTCCGTCTAATCCTAGAT-3' (SEQ ID NO: 8377)

5'-CUUCAAGAUUCCGUCUAAUCCUAGAUA-3' (SEQ ID NO: 12998)

3'-GAAGUUCUAAGGCAGAUUAGGAUCUAU-5' (SEQ ID NO: 6068)

C5-617 Target:
5'-CTTCAAGATTCCGTCTAATCCTAGATA-3' (SEQ ID NO: 8378)

5'-UUCAAGAUUCCGUCUAAUCCUAGAUAU-3' (SEQ ID NO: 12999)

3'-AAGUUCUAAGGCAGAUUAGGAUCUAUA-5' (SEQ ID NO: 6069)

C5-618 Target:
5'-TTCAAGATTCCGTCTAATCCTAGATAT-3' (SEQ ID NO: 8379)

5'-UCAAGAUUCCGUCUAAUCCUAGAUAUG-3' (SEQ ID NO: 13000)

3'-AGUUCUAAGGCAGAUUAGGAUCUAUAC-5' (SEQ ID NO: 6070)

C5-619 Target:
5'-TCAAGATTCCGTCTAATCCTAGATATG-3' (SEQ ID NO: 8380)

5'-CAAGAUUCCGUCUAAUCCUAGAUAUGG-3' (SEQ ID NO: 13001)

3'-GUUCUAAGGCAGAUUAGGAUCUAUACC-5' (SEQ ID NO: 6071)

C5-620 Target:
5'-CAAGATTCCGTCTAATCCTAGATATGG-3' (SEQ ID NO: 8381)

5'-AAGAUUCCGUCUAAUCCUAGAUAUGGU-3' (SEQ ID NO: 13002)

3'-UUCUAAGGCAGAUUAGGAUCUAUACCA-5' (SEQ ID NO: 6072)

C5-621 Target:
5'-AAGATTCCGTCTAATCCTAGATATGGT-3' (SEQ ID NO: 8382)

5'-AGAUUCCGUCUAAUCCUAGAUAUGGUA-3' (SEQ ID NO: 13003)

3'-UCUAAGGCAGAUUAGGAUCUAUACCAU-5' (SEQ ID NO: 6073)

C5-622 Target:
5'-AGATTCCGTCTAATCCTAGATATGGTA-3' (SEQ ID NO: 8383)

5'-GAUUCCGUCUAAUCCUAGAUAUGGUAU-3' (SEQ ID NO: 13004)

3'-CUAAGGCAGAUUAGGAUCUAUACCAUA-5' (SEQ ID NO: 6074)

C5-623 Target:
5'-GATTCCGTCTAATCCTAGATATGGTAT-3' (SEQ ID NO: 8384)

5'-AUUCCGUCUAAUCCUAGAUAUGGUAUG-3' (SEQ ID NO: 13005)

3'-UAAGGCAGAUUAGGAUCUAUACCAUAC-5' (SEQ ID NO: 6075)

C5-624 Target:
5'-ATTCCGTCTAATCCTAGATATGGTATG-3' (SEQ ID NO: 8385)

5'-UUCCGUCUAAUCCUAGAUAUGGUAUGU-3' (SEQ ID NO: 13006)

3'-AAGGCAGAUUAGGAUCUAUACCAUACA-5' (SEQ ID NO: 6076)

C5-625 Target:
5'-TTCCGTCTAATCCTAGATATGGTATGT-3' (SEQ ID NO: 8386)

5'-UCCGUCUAAUCCUAGAUAUGGUAUGUG-3' (SEQ ID NO: 13007)

3'-AGGCAGAUUAGGAUCUAUACCAUACAC-5' (SEQ ID NO: 6077)

C5-626 Target:
5'-TCCGTCTAATCCTAGATATGGTATGTG-3' (SEQ ID NO: 8387)

5'-CCGUCUAAUCCUAGAUAUGGUAUGUGG-3' (SEQ ID NO: 13008)

3'-GGCAGAUUAGGAUCUAUACCAUACACC-5' (SEQ ID NO: 6078)

C5-627 Target:
5'-CCGTCTAATCCTAGATATGGTATGTGG-3' (SEQ ID NO: 8388)

5'-CGUCUAAUCCUAGAUAUGGUAUGUGGA-3' (SEQ ID NO: 13009)

3'-GCAGAUUAGGAUCUAUACCAUACACCU-5' (SEQ ID NO: 6079)

C5-628 Target:
5'-CGTCTAATCCTAGATATGGTATGTGGA-3' (SEQ ID NO: 8389)

5'-GUCUAAUCCUAGAUAUGGUAUGUGGAC-3' (SEQ ID NO: 13010)

3'-CAGAUUAGGAUCUAUACCAUACACCUG-5' (SEQ ID NO: 6080)

C5-629 Target:
5'-GTCTAATCCTAGATATGGTATGTGGAC-3' (SEQ ID NO: 8390)

5'-UCUAAUCCUAGAUAUGGUAUGUGGACG-3' (SEQ ID NO: 13011)

3'-AGAUUAGGAUCUAUACCAUACACCUGC-5' (SEQ ID NO: 6081)

C5-630 Target:
5'-TCTAATCCTAGATATGGTATGTGGACG-3' (SEQ ID NO: 8391)

5'-CUAAUCCUAGAUAUGGUAUGUGGACGA-3' (SEQ ID NO: 13012)

3'-GAUUAGGAUCUAUACCAUACACCUGCU-5' (SEQ ID NO: 6082)

TABLE 9-continued

"Blunt/Blunt" DsiRNAs Corresponding to Human Anti-C5 DsiRNAs Predicted to have >50% Knockdown Efficacy C5-631 Target:
5'-CTAATCCTAGATATGGTATGTGGACGA-3' (SEQ ID NO: 8392)

5'-UAAUCCUAGAUAUGGUAUGUGGACGAU-3' (SEQ ID NO: 13013)

3'-AUUAGGAUCUAUACCAUACACCUGCUA-5' (SEQ ID NO: 6083)

C5-632 Target:
5'-TAATCCTAGATATGGTATGTGGACGAT-3' (SEQ ID NO: 8393)

5'-AAUCCUAGAUAUGGUAUGUGGACGAUC-3' (SEQ ID NO: 13014)

3'-UUAGGAUCUAUACCAUACACCUGCUAG-5' (SEQ ID NO: 6084)

C5-633 Target:
5'-AATCCTAGATATGGTATGTGGACGATC-3' (SEQ ID NO: 8394)

5'-AUCCUAGAUAUGGUAUGUGGACGAUCA-3' (SEQ ID NO: 13015)

3'-UAGGAUCUAUACCAUACACCUGCUAGU-5' (SEQ ID NO: 6085)

C5-634 Target:
5'-ATCCTAGATATGGTATGTGGACGATCA-3' (SEQ ID NO: 8395)

5'-CAAGGCUAAAUAUAAAGAGGACUUUUC-3' (SEQ ID NO: 13016)

3'-GUUCCGAUUUAUAUUUCUCCUGAAAAG-5' (SEQ ID NO: 6086)

C5-659 Target:
5'-CAAGGCTAAATATAAAGAGGACTTTTC-3' (SEQ ID NO: 8396)

5'-AAGGCUAAAUAUAAAGAGGACUUUUCA-3' (SEQ ID NO: 13017)

3'-UUCCGAUUUAUAUUUCUCCUGAAAAGU-5' (SEQ ID NO: 6087)

C5-660 Target:
5'-AAGGCTAAATATAAAGAGGACTTTTCA-3' (SEQ ID NO: 8397)

5'-AGGCUAAAUAUAAAGAGGACUUUUCAA-3' (SEQ ID NO: 13018)

3'-UCCGAUUUAUAUUUCUCCUGAAAAGUU-5' (SEQ ID NO: 6088)

C5-661 Target:
5'-AGGCTAAATATAAAGAGGACTTTTCAA-3' (SEQ ID NO: 8398)

5'-GGCUAAAUAUAAAGAGGACUUUUCAAC-3' (SEQ ID NO: 13019)

3'-CCGAUUUAUAUUUCUCCUGAAAAGUUG-5' (SEQ ID NO: 6089)

C5-662 Target:
5'-GGCTAAATATAAAGAGGACTTTTCAAC-3' (SEQ ID NO: 8399)

5'-GCUAAAUAUAAAGAGGACUUUUCAACA-3' (SEQ ID NO: 13020)

3'-CGAUUUAUAUUUCUCCUGAAAAGUUGU-5' (SEQ ID NO: 6090)

C5-663 Target:
5'-GCTAAATATAAAGAGGACTTTTCAACA-3' (SEQ ID NO: 8400)

5'-CUAAAUAUAAAGAGGACUUUUCAACAA-3' (SEQ ID NO: 13021)

3'-GAUUUAUAUUUCUCCUGAAAAGUUGUU-5' (SEQ ID NO: 6091)

C5-664 Target:
5'-CTAAATATAAAGAGGACTTTTCAACAA-3' (SEQ ID NO: 8401)

5'-UAAAUAUAAAGAGGACUUUUCAACAAC-3' (SEQ ID NO: 13022)

3'-AUUUAUAUUUCUCCUGAAAAGUUGUUG-5' (SEQ ID NO: 6092)

C5-665 Target:
5'-TAAATATAAAGAGGACTTTTCAACAAC-3' (SEQ ID NO: 8402)

5'-AAAUAUAAAGAGGACUUUUCAACAACU-3' (SEQ ID NO: 13023)

3'-UUUAUAUUUCUCCUGAAAAGUUGUUGA-5' (SEQ ID NO: 6093)

C5-666 Target:
5'-AAATATAAAGAGGACTTTTCAACAACT-3' (SEQ ID NO: 8403)

5'-AAUAUAAAGAGGACUUUUCAACAACUG-3' (SEQ ID NO: 13024)

3'-UUUAUAUUUCUCCUGAAAAGUUGUUGAC-5' (SEQ ID NO: 6094)

C5-667 Target:
5'-AATATAAAGAGGACTTTTCAACAACTG-3' (SEQ ID NO: 8404)

5'-AUAUAAAGAGGACUUUUCAACAACUGG-3' (SEQ ID NO: 13025)

3'-UAUAUUUCUCCUGAAAAGUUGUUGACC-5' (SEQ ID NO: 6095)

C5-668 Target:
5'-ATATAAAGAGGACTTTTCAACAACTGG-3' (SEQ ID NO: 8405)

5'-UAUAAAGAGGACUUUUCAACAACUGGA-3' (SEQ ID NO: 13026)

3'-AUAUUUCUCCUGAAAAGUUGUUGACCU-5' (SEQ ID NO: 6096)

C5-669 Target:
5'-TATAAAGAGGACTTTTCAACAACTGGA-3' (SEQ ID NO: 8406)

5'-AUAAAGAGGACUUUUCAACAACUGGAA-3' (SEQ ID NO: 13027)

3'-UAUUUCUCCUGAAAAGUUGUUGACCUU-5' (SEQ ID NO: 6097)

C5-670 Target:
5'-ATAAAGAGGACTTTTCAACAACTGGAA-3' (SEQ ID NO: 8407)

5'-UAAAGAGGACUUUUCAACAACUGGAAC-3' (SEQ ID NO: 13028)

3'-AUUUCUCCUGAAAAGUUGUUGACCUUG-5' (SEQ ID NO: 6098)

C5-671 Target:
5'-TAAAGAGGACTTTTCAACAACTGGAAC-3' (SEQ ID NO: 8408)

5'-AAAGAGGACUUUUCAACAACUGGAACC-3' (SEQ ID NO: 13029)

3'-UUUCUCCUGAAAAGUUGUUGACCUUGG-5' (SEQ ID NO: 6099)

C5-672 Target:
5'-AAAGAGGACTTTTCAACAACTGGAACC-3' (SEQ ID NO: 8409)

5'-AAGAGGACUUUUCAACAACUGGAACCG-3' (SEQ ID NO: 13030)

3'-UUCUCCUGAAAAGUUGUUGACCUUGGC-5' (SEQ ID NO: 6100)

C5-673 Target:
5'-AAGAGGACTTTTCAACAACTGGAACCG-3' (SEQ ID NO: 8410)

5'-AGAGGACUUUUCAACAACUGGAACCGC-3' (SEQ ID NO: 13031)

3'-UCUCCUGAAAAGUUGUUGACCUUGGCG-5' (SEQ ID NO: 6101)

C5-674 Target:
5'-AGAGGACTTTTCAACAACTGGAACCGC-3' (SEQ ID NO: 8411)

5'-GAGGACUUUUCAACAACUGGAACCGCA-3' (SEQ ID NO: 13032)

3'-CUCCUGAAAAGUUGUUGACCUUGGCGU-5' (SEQ ID NO: 6102)

TABLE 9-continued

"Blunt/Blunt" DsiRNAs Corresponding to Human Anti-C5 DsiRNAs Predicted to have >50% Knockdown Efficacy C5-675 Target:
5'-GAGGACTTTTCAACAACTGGAACCGCA-3' (SEQ ID NO: 8412)

5'-AGGACUUUUCAACAACUGGAACCGCAU-3' (SEQ ID NO: 13033)

3'-UCCUGAAAAGUUGUUGACCUUGGCGUA-5' (SEQ ID NO: 6103)

C5-676 Target:
5'-AGGACTTTTCAACAACTGGAACCGCAT-3' (SEQ ID NO: 8413)

5'-GGACUUUUCAACAACUGGAACCGCAUA-3' (SEQ ID NO: 13034)

3'-CCUGAAAAGUUGUUGACCUUGGCGUAU-5' (SEQ ID NO: 6104)

C5-677 Target:
5'-GGACTTTTCAACAACTGGAACCGCATA-3' (SEQ ID NO: 8414)

5'-UAUUUUGAAGUUAAAGAAUAUGUCUUG-3' (SEQ ID NO: 13035)

3'-AUAAAACUUCAAUUUCUUAUACAGAAC-5' (SEQ ID NO: 6105)

C5-702 Target:
5'-TATTTTGAAGTTAAAGAATATGTCTTG-3' (SEQ ID NO: 8415)

5'-AUUUUGAAGUUAAAGAAUAUGUCUUGC-3' (SEQ ID NO: 13036)

3'-UAAAACUUCAAUUUCUUAUACAGAACG-5' (SEQ ID NO: 6106)

C5-703 Target:
5'-ATTTTGAAGTTAAAGAATATGTCTTGC-3' (SEQ ID NO: 8416)

5'-UUUUGAAGUUAAAGAAUAUGUCUUGCC-3' (SEQ ID NO: 13037)

3'-AAAACUUCAAUUUCUUAUACAGAACGG-5' (SEQ ID NO: 6107)

C5-704 Target:
5'-TTTTGAAGTTAAAGAATATGTCTTGCC-3' (SEQ ID NO: 8417)

5'-UUUGAAGUUAAAGAAUAUGUCUUGCCA-3' (SEQ ID NO: 13038)

3'-AAACUUCAAUUUCUUAUACAGAACGGU-5' (SEQ ID NO: 6108)

C5-705 Target:
5'-TTTGAAGTTAAAGAATATGTCTTGCCA-3' (SEQ ID NO: 8418)

5'-UUGAAGUUAAAGAAUAUGUCUUGCCAC-3' (SEQ ID NO: 13039)

3'-AACUUCAAUUUCUUAUACAGAACGGUG-5' (SEQ ID NO: 6109)

C5-706 Target:
5'-TTGAAGTTAAAGAATATGTCTTGCCAC-3' (SEQ ID NO: 8419)

5'-UGAAGUUAAAGAAUAUGUCUUGCCACA-3' (SEQ ID NO: 13040)

3'-ACUUCAAUUUCUUAUACAGAACGGUGU-5' (SEQ ID NO: 6110)

C5-707 Target:
5'-TGAAGTTAAAGAATATGTCTTGCCACA-3' (SEQ ID NO: 8420)

5'-GAAGUUAAAGAAUAUGUCUUGCCACAU-3' (SEQ ID NO: 13041)

3'-CUUCAAUUUCUUAUACAGAACGGUGUA-5' (SEQ ID NO: 6111)

C5-708 Target:
5'-GAAGTTAAAGAATATGTCTTGCCACAT-3' (SEQ ID NO: 8421)

5'-AAGUUAAAGAAUAUGUCUUGCCACAUU-3' (SEQ ID NO: 13042)

3'-UUCAAUUUCUUAUACAGAACGGUGUAA-5' (SEQ ID NO: 6112)

C5-709 Target:
5'-AAGTTAAAGAATATGTCTTGCCACATT-3' (SEQ ID NO: 8422)

5'-UAAAGAAUAUGUCUUGCCACAUUUUUC-3' (SEQ ID NO: 13043)

3'-AUUUCUUAUACAGAACGGUGUAAAAAG-5' (SEQ ID NO: 6113)

C5-713 Target:
5'-TAAAGAATATGTCTTGCCACATTTTTC-3' (SEQ ID NO: 8423)

5'-AAAGAAUAUGUCUUGCCACAUUUUUCU-3' (SEQ ID NO: 13044)

3'-UUUCUUAUACAGAACGGUGUAAAAAGA-5' (SEQ ID NO: 6114)

C5-714 Target:
5'-AAAGAATATGTCTTGCCACATTTTTCT-3' (SEQ ID NO: 8424)

5'-AAGAAUAUGUCUUGCCACAUUUUUCUG-3' (SEQ ID NO: 13045)

3'-UUCUUAUACAGAACGGUGUAAAAAGAC-5' (SEQ ID NO: 6115)

C5-715 Target:
5'-AAGAATATGTCTTGCCACATTTTTCTG-3' (SEQ ID NO: 8425)

5'-AGAAUAUGUCUUGCCACAUUUUUCUGU-3' (SEQ ID NO: 13046)

3'-UCUUAUACAGAACGGUGUAAAAAGACA-5' (SEQ ID NO: 6116)

C5-716 Target:
5'-AGAATATGTCTTGCCACATTTTTCTGT-3' (SEQ ID NO: 8426)

5'-GAAUAUGUCUUGCCACAUUUUUCUGUC-3' (SEQ ID NO: 13047)

3'-CUUAUACAGAACGGUGUAAAAAGACAG-5' (SEQ ID NO: 6117)

C5-717 Target:
5'-GAATATGTCTTGCCACATTTTTCTGTC-3' (SEQ ID NO: 8427)

5'-AAUAUGUCUUGCCACAUUUUUCUGUCU-3' (SEQ ID NO: 13048)

3'-UUAUACAGAACGGUGUAAAAAGACAGA-5' (SEQ ID NO: 6118)

C5-718 Target:
5'-AATATGTCTTGCCACATTTTTCTGTCT-3' (SEQ ID NO: 8428)

5'-AUAUGUCUUGCCACAUUUUUCUGUCUC-3' (SEQ ID NO: 13049)

3'-UAUACAGAACGGUGUAAAAAGACAGAG-5' (SEQ ID NO: 6119)

C5-719 Target:
5'-ATATGTCTTGCCACATTTTTCTGTCTC-3' (SEQ ID NO: 8429)

5'-UAUGUCUUGCCACAUUUUUCUGUCUCA-3' (SEQ ID NO: 13050)

3'-AUACAGAACGGUGUAAAAAGACAGAGU-5' (SEQ ID NO: 6120)

C5-720 Target:
5'-TATGTCTTGCCACATTTTTCTGTCTCA-3' (SEQ ID NO: 8430)

5'-AUGUCUUGCCACAUUUUUCUGUCUCAA-3' (SEQ ID NO: 13051)

3'-UACAGAACGGUGUAAAAAGACAGAGUU-5' (SEQ ID NO: 6121)

C5-721 Target:
5'-ATGTCTTGCCACATTTTTCTGTCTCAA-3' (SEQ ID NO: 8431)

5'-UGUCUUGCCACAUUUUUCUGUCUCAAU-3' (SEQ ID NO: 13052)

3'-ACAGAACGGUGUAAAAAGACAGAGUUA-5' (SEQ ID NO: 6122)

TABLE 9-continued

"Blunt/Blunt" DsiRNAs Corresponding to Human Anti-C5 DsiRNAs Predicted to have >50% Knockdown Efficacy C5-722 Target:
5'-TGTCTTGCCACATTTTTCTGTCTCAAT-3' (SEQ ID NO: 8432)

5'-GUCUUGCCACAUUUUUCUGUCUCAAUC-3' (SEQ ID NO: 13053)

3'-CAGAACGGUGUAAAAAGACAGAGUUAG-5' (SEQ ID NO: 6123)

C5-723 Target:
5'-GTCTTGCCACATTTTTCTGTCTCAATC-3' (SEQ ID NO: 8433)

5'-UCUUGCCACAUUUUUCUGUCUCAAUCG-3' (SEQ ID NO: 13054)

3'-AGAACGGUGUAAAAAGACAGAGUUAGC-5' (SEQ ID NO: 6124)

C5-724 Target:
5'-TCTTGCCACATTTTTCTGTCTCAATCG-3' (SEQ ID NO: 8434)

5'-CUUGCCACAUUUUUCUGUCUCAAUCGA-3' (SEQ ID NO: 13055)

3'-GAACGGUGUAAAAAGACAGAGUUAGCU-5' (SEQ ID NO: 6125)

C5-725 Target:
5'-CTTGCCACATTTTTCTGTCTCAATCGA-3' (SEQ ID NO: 8435)

5'-UUGCCACAUUUUUCUGUCUCAAUCGAG-3' (SEQ ID NO: 13056)

3'-AACGGUGUAAAAAGACAGAGUUAGCUC-5' (SEQ ID NO: 6126)

C5-726 Target:
5'-TTGCCACATTTTTCTGTCTCAATCGAG-3' (SEQ ID NO: 8436)

5'-AAGAACUUUAAGAAUUUUGAAAUUACU-3' (SEQ ID NO: 13057)

3'-UUCUUGAAAUUCUUAAAACUUUAAUGA-5' (SEQ ID NO: 6127)

C5-777 Target:
5'-AAGAACTTTAAGAATTTTGAAATTACT-3' (SEQ ID NO: 8437)

5'-AGAACUUUAAGAAUUUUGAAAUUACUA-3' (SEQ ID NO: 13058)

3'-UCUUGAAAUUCUUAAAACUUUAAUGAU-5' (SEQ ID NO: 6128)

C5-778 Target:
5'-AGAACTTTAAGAATTTTGAAATTACTA-3' (SEQ ID NO: 8438)

5'-GAACUUUAAGAAUUUUGAAAUUACUAU-3' (SEQ ID NO: 13059)

3'-CUUGAAAUUCUUAAAACUUUAAUGAUA-5' (SEQ ID NO: 6129)

C5-779 Target:
5'-GAACTTTAAGAATTTTGAAATTACTAT-3' (SEQ ID NO: 8439)

5'-ACUUUAAGAAUUUUGAAAUUACUAUAA-3' (SEQ ID NO: 13060)

3'-UGAAAUUCUUAAAACUUUAAUGAUAUU-5' (SEQ ID NO: 6130)

C5-781 Target:
5'-ACTTTAAGAATTTTGAAATTACTATAA-3' (SEQ ID NO: 8440)

5'-CUUUAAGAAUUUUGAAAUUACUAUAAA-3' (SEQ ID NO: 13061)

3'-GAAAUUCUUAAAACUUUAAUGAUAUUU-5' (SEQ ID NO: 6131)

C5-782 Target:
5'-CTTTAAGAATTTTGAAATTACTATAAA-3' (SEQ ID NO: 8441)

5'-UUUAAGAAUUUUGAAAUUACUAUAAAA-3' (SEQ ID NO: 13062)

3'-AAAUUCUUAAAACUUUAAUGAUAUUUU-5' (SEQ ID NO: 6132)

TABLE 9-continued

"Blunt/Blunt" DsiRNAs Corresponding to Human Anti-C5 DsiRNAs Predicted to have >50% Knockdown Efficacy C5-783 Target:
5'-TTTAAGAATTTTGAAATTACTATAAAA-3' (SEQ ID NO: 8442)

5'-UUAAGAAUUUUGAAAUUACUAUAAAAG-3' (SEQ ID NO: 13063)

3'-AAUUCUUAAAACUUUAAUGAUAUUUUC-5' (SEQ ID NO: 6133)

C5-784 Target:
5'-TTAAGAATTTTGAAATTACTATAAAAG-3' (SEQ ID NO: 8443)

5'-UAAGAAUUUUGAAAUUACUAUAAAAGC-3' (SEQ ID NO: 13064)

3'-AUUCUUAAAACUUUAAUGAUAUUUUCG-5' (SEQ ID NO: 6134)

C5-785 Target:
5'-TAAGAATTTTGAAATTACTATAAAAGC-3' (SEQ ID NO: 8444)

5'-AAUUUUGAAAUUACUAUAAAAGCAAGA-3' (SEQ ID NO: 13065)

3'-UUAAAACUUUAAUGAUAUUUUCGUUCU-5' (SEQ ID NO: 6135)

C5-789 Target:
5'-AATTTGAAATTACTATAAAAGCAAGA-3' (SEQ ID NO: 8445)

5'-AUUUUGAAAUUACUAUAAAAGCAAGAU-3' (SEQ ID NO: 13066)

3'-UAAAACUUUAAUGAUAUUUUCGUUCUA-5' (SEQ ID NO: 6136)

C5-790 Target:
5'-ATTTTGAAATTACTATAAAAGCAAGAT-3' (SEQ ID NO: 8446)

5'-UGAAAUUACUAUAAAAGCAAGAUAUUU-3' (SEQ ID NO: 13067)

3'-ACUUUAAUGAUAUUUUCGUUCUAUAAA-5' (SEQ ID NO: 6137)

C5-794 Target:
5'-TGAAATTACTATAAAAGCAAGATATTT-3' (SEQ ID NO: 8447)

5'-GAAAUUACUAUAAAAGCAAGAUAUUUU-3' (SEQ ID NO: 13068)

3'-CUUUAAUGAUAUUUUCGUUCUAUAAAA-5' (SEQ ID NO: 6138)

C5-795 Target:
5'-GAAATTACTATAAAAGCAAGATATTTT-3' (SEQ ID NO: 8448)

5'-AAAUUACUAUAAAAGCAAGAUAUUUUU-3' (SEQ ID NO: 13069)

3'-UUUAAUGAUAUUUUCGUUCUAUAAAAA-5' (SEQ ID NO: 6139)

C5-796 Target:
5'-AAATTACTATAAAAGCAAGATATTTTT-3' (SEQ ID NO: 8449)

5'-AAUUACUAUAAAAGCAAGAUAUUUUUA-3' (SEQ ID NO: 13070)

3'-UUAAUGAUAUUUUCGUUCUAUAAAAAU-5' (SEQ ID NO: 6140)

C5-797 Target:
5'-AATTACTATAAAAGCAAGATATTTTTA-3' (SEQ ID NO: 8450)

5'-AUUACUAUAAAAGCAAGAUAUUUUUAU-3' (SEQ ID NO: 13071)

3'-UAAUGAUAUUUUCGUUCUAUAAAAAUA-5' (SEQ ID NO: 6141)

C5-798 Target:
5'-ATTACTATAAAAGCAAGATATTTTTAT-3' (SEQ ID NO: 8451)

5'-UUACUAUAAAAGCAAGAUAUUUUUAUA-3' (SEQ ID NO: 13072)

3'-AAUGAUAUUUUCGUUCUAUAAAAAUAU-5' (SEQ ID NO: 6142)

TABLE 9-continued

"Blunt/Blunt" DsiRNAs Corresponding to Human Anti-C5 DsiRNAs Predicted to have >50% Knockdown Efficacy C5-799 Target:
5'-TTACTATAAAAGCAAGATATTTTTATA-3' (SEQ ID NO: 8452)

5'-UACUAUAAAAGCAAGAUAUUUUUAUAA-3' (SEQ ID NO: 13073)

3'-AUGAUAUUUUCGUUCUAUAAAAAUAUU-5' (SEQ ID NO: 6143)

C5-800 Target:
5'-TACTATAAAAGCAAGATATTTTTATAA-3' (SEQ ID NO: 8453)

5'-ACUAUAAAAGCAAGAUAUUUUUAUAAU-3' (SEQ ID NO: 13074)

3'-UGAUAUUUUCGUUCUAUAAAAAUAUUA-5' (SEQ ID NO: 6144)

C5-801 Target:
5'-ACTATAAAAGCAAGATATTTTTATAAT-3' (SEQ ID NO: 8454)

5'-CUAUAAAAGCAAGAUAUUUUUAUAAUA-3' (SEQ ID NO: 13075)

3'-GAUAUUUUCGUUCUAUAAAAAUAUUAU-5' (SEQ ID NO: 6145)

C5-802 Target:
5'-CTATAAAAGCAAGATATTTTTATAATA-3' (SEQ ID NO: 8455)

5'-UAUAAAAGCAAGAUAUUUUUAUAAUAA-3' (SEQ ID NO: 13076)

3'-AUAUUUUCGUUCUAUAAAAAUAUUAUU-5' (SEQ ID NO: 6146)

C5-803 Target:
5'-TATAAAAGCAAGATATTTTTATAATAA-3' (SEQ ID NO: 8456)

5'-AUAAAAGCAAGAUAUUUUUAUAAUAAA-3' (SEQ ID NO: 13077)

3'-UAUUUUCGUUCUAUAAAAAUAUUAUUU-5' (SEQ ID NO: 6147)

C5-804 Target:
5'-ATAAAAGCAAGATATTTTTATAATAAA-3' (SEQ ID NO: 8457)

5'-AGAUAUUUUUAUAAUAAAGUAGUCACU-3' (SEQ ID NO: 13078)

3'-UCUAUAAAAAUAUUAUUUCAUCAGUGA-5' (SEQ ID NO: 6148)

C5-813 Target:
5'-AGATATTTTTATAATAAAGTAGTCACT-3' (SEQ ID NO: 8458)

5'-GAUAUUUUUAUAAUAAAGUAGUCACUG-3' (SEQ ID NO: 13079)

3'-CUAUAAAAAUAUUAUUUCAUCAGUGAC-5' (SEQ ID NO: 6149)

C5-814 Target:
5'-GATATTTTTATAATAAAGTAGTCACTG-3' (SEQ ID NO: 8459)

5'-AUAUUUUUAUAAUAAAGUAGUCACUGA-3' (SEQ ID NO: 13080)

3'-UAUAAAAAUAUUAUUUCAUCAGUGACU-5' (SEQ ID NO: 6150)

C5-815 Target:
5'-ATATTTTTATAATAAAGTAGTCACTGA-3' (SEQ ID NO: 8460)

5'-UAUUUUUAUAAUAAAGUAGUCACUGAG-3' (SEQ ID NO: 13081)

3'-AUAAAAAUAUUAUUUCAUCAGUGACUC-5' (SEQ ID NO: 6151)

C5-816 Target:
5'-TATTTTTATAATAAAGTAGTCACTGAG-3' (SEQ ID NO: 8461)

5'-AUUUUUAUAAUAAAGUAGUCACUGAGG-3' (SEQ ID NO: 13082)

3'-UAAAAAUAUUAUUUCAUCAGUGACUCC-5' (SEQ ID NO: 6152)

TABLE 9-continued

"Blunt/Blunt" DsiRNAs Corresponding to Human Anti-C5 DsiRNAs Predicted to have >50% Knockdown Efficacy C5-817 Target:
5'-ATTTTTATAATAAAGTAGTCACTGAGG-3' (SEQ ID NO: 8462)

5'-UUUUUAUAAUAAAGUAGUCACUGAGGC-3' (SEQ ID NO: 13083)

3'-AAAAAUAUUAUUUCAUCAGUGACUCCG-5' (SEQ ID NO: 6153)

C5-818 Target:
5'-TTTTTATAATAAAGTAGTCACTGAGGC-3' (SEQ ID NO: 8463)

5'-UUUUAUAAUAAAGUAGUCACUGAGGCU-3' (SEQ ID NO: 13084)

3'-AAAAUAUUAUUUCAUCAGUGACUCCGA-5' (SEQ ID NO: 6154)

C5-819 Target:
5'-TTTTATAATAAAGTAGTCACTGAGGCT-3' (SEQ ID NO: 8464)

5'-UUUAUAAUAAAGUAGUCACUGAGGCUG-3' (SEQ ID NO: 13085)

3'-AAAUAUUAUUUCAUCAGUGACUCCGAC-5' (SEQ ID NO: 6155)

C5-820 Target:
5'-TTTATAATAAAGTAGTCACTGAGGCTG-3' (SEQ ID NO: 8465)

5'-UUAUAAUAAAGUAGUCACUGAGGCUGA-3' (SEQ ID NO: 13086)

3'-AAUAUUAUUUCAUCAGUGACUCCGACU-5' (SEQ ID NO: 6156)

C5-821 Target:
5'-TTATAATAAAGTAGTCACTGAGGCTGA-3' (SEQ ID NO: 8466)

5'-UAUAAUAAAGUAGUCACUGAGGCUGAC-3' (SEQ ID NO: 13087)

3'-AUAUUAUUUCAUCAGUGACUCCGACUG-5' (SEQ ID NO: 6157)

C5-822 Target:
5'-TATAATAAAGTAGTCACTGAGGCTGAC-3' (SEQ ID NO: 8467)

5'-AUAAUAAAGUAGUCACUGAGGCUGACG-3' (SEQ ID NO: 13088)

3'-UAUUAUUUCAUCAGUGACUCCGACUGC-5' (SEQ ID NO: 6158)

C5-823 Target:
5'-ATAATAAAGTAGTCACTGAGGCTGACG-3' (SEQ ID NO: 8468)

5'-UAAUAAAGUAGUCACUGAGGCUGACGU-3' (SEQ ID NO: 13089)

3'-AUUAUUUCAUCAGUGACUCCGACUGCA-5' (SEQ ID NO: 6159)

C5-824 Target:
5'-TAATAAAGTAGTCACTGAGGCTGACGT-3' (SEQ ID NO: 8469)

5'-AAUAAAGUAGUCACUGAGGCUGACGUU-3' (SEQ ID NO: 13090)

3'-UUAUUUCAUCAGUGACUCCGACUGCAA-5' (SEQ ID NO: 6160)

C5-825 Target:
5'-AATAAAGTAGTCACTGAGGCTGACGTT-3' (SEQ ID NO: 8470)

5'-AUAAAGUAGUCACUGAGGCUGACGUUU-3' (SEQ ID NO: 13091)

3'-UAUUUCAUCAGUGACUCCGACUGCAAA-5' (SEQ ID NO: 6161)

C5-826 Target:
5'-ATAAAGTAGTCACTGAGGCTGACGTTT-3' (SEQ ID NO: 8471)

5'-UAAAGUAGUCACUGAGGCUGACGUUUA-3' (SEQ ID NO: 13092)

3'-AUUUCAUCAGUGACUCCGACUGCAAAU-5' (SEQ ID NO: 6162)

TABLE 9-continued

"Blunt/Blunt" DsiRNAs Corresponding to Human Anti-C5 DsiRNAs Predicted to have >50% Knockdown Efficacy C5-827 Target:
5'-TAAAGTAGTCACTGAGGCTGACGTTTA-3' (SEQ ID NO: 8472)

5'-ACGUUUAUAUCACAUUUGGAAUAAGAG-3' (SEQ ID NO: 13093)

3'-UGCAAAUAUAGUGUAAACCUUAUUCUC-5' (SEQ ID NO: 6163)

C5-847 Target:
5'-ACGTTTATATCACATTTGGAATAAGAG-3' (SEQ ID NO: 8473)

5'-CGUUUAUAUCACAUUUGGAAUAAGAGA-3' (SEQ ID NO: 13094)

3'-GCAAAUAUAGUGUAAACCUUAUUCUCU-5' (SEQ ID NO: 6164)

C5-848 Target:
5'-CGTTTATATCACATTTGGAATAAGAGA-3' (SEQ ID NO: 8474)

5'-GUUUAUAUCACAUUUGGAAUAAGAGAA-3' (SEQ ID NO: 13095)

3'-CAAAUAUAGUGUAAACCUUAUUCUCUU-5' (SEQ ID NO: 6165)

C5-849 Target:
5'-GTTTATATCACATTTGGAATAAGAGAA-3' (SEQ ID NO: 8475)

5'-UUUAUAUCACAUUUGGAAUAAGAGAAG-3' (SEQ ID NO: 13096)

3'-AAAUAUAGUGUAAACCUUAUUCUCUUC-5' (SEQ ID NO: 6166)

C5-850 Target:
5'-TTTATATCACATTTGGAATAAGAGAAG-3' (SEQ ID NO: 8476)

5'-UUAUAUCACAUUUGGAAUAAGAGAAGA-3' (SEQ ID NO: 13097)

3'-AAUAUAGUGUAAACCUUAUUCUCUUCU-5' (SEQ ID NO: 6167)

C5-851 Target:
5'-TTATATCACATTTGGAATAAGAGAAGA-3' (SEQ ID NO: 8477)

5'-UAUAUCACAUUUGGAAUAAGAGAAGAC-3' (SEQ ID NO: 13098)

3'-AUAUAGUGUAAACCUUAUUCUCUUCUG-5' (SEQ ID NO: 6168)

C5-852 Target:
5'-TATATCACATTTGGAATAAGAGAAGAC-3' (SEQ ID NO: 8478)

5'-AUAUCACAUUUGGAAUAAGAGAAGACU-3' (SEQ ID NO: 13099)

3'-UAUAGUGUAAACCUUAUUCUCUUCUGA-5' (SEQ ID NO: 6169)

C5-853 Target:
5'-ATATCACATTTGGAATAAGAGAAGACT-3' (SEQ ID NO: 8479)

5'-UAUCACAUUUGGAAUAAGAGAAGACUU-3' (SEQ ID NO: 13100)

3'-AUAGUGUAAACCUUAUUCUCUUCUGAA-5' (SEQ ID NO: 6170)

C5-854 Target:
5'-TATCACATTTGGAATAAGAGAAGACTT-3' (SEQ ID NO: 8480)

5'-AUCACAUUUGGAAUAAGAGAAGACUUA-3' (SEQ ID NO: 13101)

3'-UAGUGUAAACCUUAUUCUCUUCUGAAU-5' (SEQ ID NO: 6171)

C5-855 Target:
5'-ATCACATTTGGAATAAGAAGACTTA-3' (SEQ ID NO: 8481)

5'-UCACAUUUGGAAUAAGAGAAGACUUAA-3' (SEQ ID NO: 13102)

3'-AGUGUAAACCUUAUUCUCUUCUGAAUU-5' (SEQ ID NO: 6172)

C5-856 Target:
5'-TCACATTTGGAATAAGAGAAGACTTAA-3' (SEQ ID NO: 8482)

5'-CACAUUUGGAAUAAGAGAAGACUUAAA-3' (SEQ ID NO: 13103)

3'-GUGUAAACCUUAUUCUCUUCUGAAUUU-5' (SEQ ID NO: 6173)

C5-857 Target:
5'-CACATTTGGAATAAGAGAAGACTTAAA-3' (SEQ ID NO: 8483)

5'-ACAUUUGGAAUAAGAGAAGACUUAAAA-3' (SEQ ID NO: 13104)

3'-UGUAAACCUUAUUCUCUUCUGAAUUUU-5' (SEQ ID NO: 6174)

C5-858 Target:
5'-ACATTTGGAATAAGAGAAGACTTAAAA-3' (SEQ ID NO: 8484)

5'-CAUUUGGAAUAAGAGAAGACUUAAAAG-3' (SEQ ID NO: 13105)

3'-GUAAACCUUAUUCUCUUCUGAAUUUUC-5' (SEQ ID NO: 6175)

C5-859 Target:
5'-CATTTGGAATAAGAGAAGACTTAAAAG-3' (SEQ ID NO: 8485)

5'-AUUUGGAAUAAGAGAAGACUUAAAAGA-3' (SEQ ID NO: 13106)

3'-UAAACCUUAUUCUCUUCUGAAUUUUCU-5' (SEQ ID NO: 6176)

C5-860 Target:
5'-ATTTGGAATAAGAGAAGACTTAAAAGA-3' (SEQ ID NO: 8486)

5'-UUUGGAAUAAGAGAAGACUUAAAAGAU-3' (SEQ ID NO: 13107)

3'-AAACCUUAUUCUCUUCUGAAUUUUCUA-5' (SEQ ID NO: 6177)

C5-861 Target:
5'-TTTGGAATAAGAGAAGACTTAAAAGAT-3' (SEQ ID NO: 8487)

5'-UUGGAAUAAGAGAAGACUUAAAAGAUG-3' (SEQ ID NO: 13108)

3'-AACCUUAUUCUCUUCUGAAUUUUCUAC-5' (SEQ ID NO: 6178)

C5-862 Target:
5'-TTGGAATAAGAGAAGACTTAAAAGATG-3' (SEQ ID NO: 8488)

5'-UGGAAUAAGAGAAGACUUAAAAGAUGA-3' (SEQ ID NO: 13109)

3'-ACCUUAUUCUCUUCUGAAUUUUCUACU-5' (SEQ ID NO: 6179)

C5-863 Target:
5'-TGGAATAAGAGAAGACTTAAAAGATGA-3' (SEQ ID NO: 8489)

5'-GGAAUAAGAGAAGACUUAAAAGAUGAU-3' (SEQ ID NO: 13110)

3'-CCUUAUUCUCUUCUGAAUUUUCUACUA-5' (SEQ ID NO: 6180)

C5-864 Target:
5'-GGAATAAGAGAAGACTTAAAAGATGAT-3' (SEQ ID NO: 8490)

5'-GAAUAAGAGAAGACUUAAAAGAUGAUC-3' (SEQ ID NO: 13111)

3'-CUUAUUCUCUUCUGAAUUUUCUACUAG-5' (SEQ ID NO: 6181)

C5-865 Target:
5'-GAATAAGAGAAGACTTAAAAGATGATC-3' (SEQ ID NO: 8491)

5'-AAUAAGAGAAGACUUAAAAGAUGAUCA-3' (SEQ ID NO: 13112)

3'-UUAUUCUCUUCUGAAUUUUCUACUAGU-5' (SEQ ID NO: 6182)

TABLE 9-continued

"Blunt/Blunt" DsiRNAs Corresponding to Human Anti-C5 DsiRNAs Predicted to have >50% Knockdown Efficacy C5-866 Target:
5'-AATAAGAGAAGACTTAAAAGATGATCA-3' (SEQ ID NO: 8492)

5'-AUAAGAGAAGACUUAAAAGAUGAUCAA-3' (SEQ ID NO: 13113)

3'-UAUUCUCUUCUGAAUUUUCUACUAGUU-5' (SEQ ID NO: 6183)

C5-867 Target:
5'-ATAAGAGAAGACTTAAAAGATGATCAA-3' (SEQ ID NO: 8493)

5'-UAAGAGAAGACUUAAAAGAUGAUCAAA-3' (SEQ ID NO: 13114)

3'-AUUCUCUUCUGAAUUUUCUACUAGUUU-5' (SEQ ID NO: 6184)

C5-868 Target:
5'-TAAGAGAAGACTTAAAAGATGATCAAA-3' (SEQ ID NO: 8494)

5'-AAGAGAAGACUUAAAAGAUGAUCAAAA-3' (SEQ ID NO: 13115)

3'-UUCUCUUCUGAAUUUUCUACUAGUUUU-5' (SEQ ID NO: 6185)

C5-869 Target:
5'-AAGAGAAGACTTAAAAGATGATCAAAA-3' (SEQ ID NO: 8495)

5'-AGAGAAGACUUAAAAGAUGAUCAAAAA-3' (SEQ ID NO: 13116)

3'-UCUCUUCUGAAUUUUCUACUAGUUUUU-5' (SEQ ID NO: 6186)

C5-870 Target:
5'-AGAGAAGACTTAAAAGATGATCAAAAA-3' (SEQ ID NO: 8496)

5'-GAGAAGACUUAAAAGAUGAUCAAAAAG-3' (SEQ ID NO: 13117)

3'-CUCUUCUGAAUUUUCUACUAGUUUUUC-5' (SEQ ID NO: 6187)

C5-871 Target:
5'-GAGAAGACTTAAAAGATGATCAAAAAG-3' (SEQ ID NO: 8497)

5'-AGAAGACUUAAAAGAUGAUCAAAAAGA-3' (SEQ ID NO: 13118)

3'-UCUUCUGAAUUUUCUACUAGUUUUUCU-5' (SEQ ID NO: 6188)

C5-872 Target:
5'-AGAAGACTTAAAAGATGATCAAAAAGA-3' (SEQ ID NO: 8498)

5'-GAAGACUUAAAAGAUGAUCAAAAAGAA-3' (SEQ ID NO: 13119)

3'-CUUCUGAAUUUUCUACUAGUUUUUCUU-5' (SEQ ID NO: 6189)

C5-873 Target:
5'-GAAGACTTAAAAGATGATCAAAAAGAA-3' (SEQ ID NO: 8499)

5'-AAGACUUAAAAGAUGAUCAAAAAGAAA-3' (SEQ ID NO: 13120)

3'-UUCUGAAUUUUCUACUAGUUUUUCUUU-5' (SEQ ID NO: 6190)

C5-874 Target:
5'-AAGACTTAAAAGATGATCAAAAAGAAA-3' (SEQ ID NO: 8500)

5'-AGACUUAAAAGAUGAUCAAAAAGAAAU-3' (SEQ ID NO: 13121)

3'-UCUGAAUUUUCUACUAGUUUUUCUUUA-5' (SEQ ID NO: 6191)

C5-875 Target:
5'-AGACTTAAAAGATGATCAAAAAGAAAT-3' (SEQ ID NO: 8501)

5'-GACUUAAAAGAUGAUCAAAAAGAAAUG-3' (SEQ ID NO: 13122)

3'-CUGAAUUUUCUACUAGUUUUUCUUUAC-5' (SEQ ID NO: 6192)

C5-876 Target:
5'-GACTTAAAAGATGATCAAAAAGAAATG-3' (SEQ ID NO: 8502)

5'-ACUUAAAAGAUGAUCAAAAAGAAAUGA-3' (SEQ ID NO: 13123)

3'-UGAAUUUUCUACUAGUUUUUCUUUACU-5' (SEQ ID NO: 6193)

C5-877 Target:
5'-ACTTAAAAGATGATCAAAAAGAAATGA-3' (SEQ ID NO: 8503)

5'-CUUAAAAGAUGAUCAAAAAGAAAUGAU-3' (SEQ ID NO: 13124)

3'-GAAUUUUCUACUAGUUUUUCUUUACUA-5' (SEQ ID NO: 6194)

C5-878 Target:
5'-CTTAAAAGATGATCAAAAAGAAATGAT-3' (SEQ ID NO: 8504)

5'-UUAAAAGAUGAUCAAAAAGAAAUGAUG-3' (SEQ ID NO: 13125)

3'-AAUUUUCUACUAGUUUUUCUUUACUAC-5' (SEQ ID NO: 6195)

C5-879 Target:
5'-TTAAAAGATGATCAAAAAGAAATGATG-3' (SEQ ID NO: 8505)

5'-UAAAAGAUGAUCAAAAAGAAAUGAUGC-3' (SEQ ID NO: 13126)

3'-AUUUUCUACUAGUUUUUCUUUACUACG-5' (SEQ ID NO: 6196)

C5-880 Target:
5'-TAAAAGATGATCAAAAAGAAATGATGC-3' (SEQ ID NO: 8506)

5'-AAAAGAUGAUCAAAAAGAAAUGAUGCA-3' (SEQ ID NO: 13127)

3'-UUUUCUACUAGUUUUUCUUUACUACGU-5' (SEQ ID NO: 6197)

C5-881 Target:
5'-AAAAGATGATCAAAAAGAAATGATGCA-3' (SEQ ID NO: 8507)

5'-AAAGAUGAUCAAAAAGAAAUGAUGCAA-3' (SEQ ID NO: 13128)

3'-UUUCUACUAGUUUUUCUUUACUACGUU-5' (SEQ ID NO: 6198)

C5-882 Target:
5'-AAAGATGATCAAAAAGAAATGATGCAA-3' (SEQ ID NO: 8508)

5'-AAGAUGAUCAAAAAGAAAUGAUGCAAA-3' (SEQ ID NO: 13129)

3'-UUCUACUAGUUUUUCUUUACUACGUUU-5' (SEQ ID NO: 6199)

C5-883 Target:
5'-AAGATGATCAAAAAGAAATGATGCAAA-3' (SEQ ID NO: 8509)

5'-AGAUGAUCAAAAAGAAAUGAUGCAAAC-3' (SEQ ID NO: 13130)

3'-UCUACUAGUUUUUCUUUACUACGUUUG-5' (SEQ ID NO: 6200)

C5-884 Target:
5'-AGATGATCAAAAAGAAATGATGCAAAC-3' (SEQ ID NO: 8510)

5'-GAUGAUCAAAAAGAAAUGAUGCAAACA-3' (SEQ ID NO: 13131)

3'-CUACUAGUUUUUCUUUACUACGUUUGU-5' (SEQ ID NO: 6201)

C5-885 Target:
5'-GATGATCAAAAAGAAATGATGCAAACA-3' (SEQ ID NO: 8511)

5'-AUGAUCAAAAAGAAAUGAUGCAAACAG-3' (SEQ ID NO: 13132)

3'-UACUAGUUUUUCUUUACUACGUUUGUC-5' (SEQ ID NO: 6202)

TABLE 9-continued

"Blunt/Blunt" DsiRNAs Corresponding to Human Anti-C5 DsiRNAs Predicted to have >50% Knockdown Efficacy C5-886 Target:
5'-ATGATCAAAAAGAAATGATGCAAACAG-3' (SEQ ID NO: 8512)

5'-UGAUCAAAAAGAAAUGAUGCAAACAGC-3' (SEQ ID NO: 13133)

3'-ACUAGUUUUUCUUUACUACGUUUGUCG-5' (SEQ ID NO: 6203)

C5-887 Target:
5'-TGATCAAAAAGAAATGATGCAAACAGC-3' (SEQ ID NO: 8513)

5'-GAUCAAAAAGAAAUGAUGCAAACAGCA-3' (SEQ ID NO: 13134)

3'-CUAGUUUUUCUUUACUACGUUUGUCGU-5' (SEQ ID NO: 6204)

C5-888 Target:
5'-GATCAAAAAGAAATGATGCAAACAGCA-3' (SEQ ID NO: 8514)

5'-AUCAAAAAGAAAUGAUGCAAACAGCAA-3' (SEQ ID NO: 13135)

3'-UAGUUUUUCUUUACUACGUUUGUCGUU-5' (SEQ ID NO: 6205)

C5-889 Target:
5'-ATCAAAAAGAAATGATGCAAACAGCAA-3' (SEQ ID NO: 8515)

5'-UCAAAAAGAAAUGAUGCAAACAGCAAU-3' (SEQ ID NO: 13136)

3'-AGUUUUUCUUUACUACGUUUGUCGUUA-5' (SEQ ID NO: 6206)

C5-890 Target:
5'-TCAAAAAGAAATGATGCAAACAGCAAT-3' (SEQ ID NO: 8516)

5'-CAAAAAGAAAUGAUGCAAACAGCAAUG-3' (SEQ ID NO: 13137)

3'-GUUUUUCUUUACUACGUUUGUCGUUAC-5' (SEQ ID NO: 6207)

C5-891 Target:
5'-CAAAAAGAAATGATGCAAACAGCAATG-3' (SEQ ID NO: 8517)

5'-AAAAAGAAAUGAUGCAAACAGCAAUGC-3' (SEQ ID NO: 13138)

3'-UUUUUCUUUACUACGUUUGUCGUUACG-5' (SEQ ID NO: 6208)

C5-892 Target:
5'-AAAAAGAAATGATGCAAACAGCAATGC-3' (SEQ ID NO: 8518)

5'-AAAAGAAAUGAUGCAAACAGCAAUGCA-3' (SEQ ID NO: 13139)

3'-UUUUCUUUACUACGUUUGUCGUUACGU-5' (SEQ ID NO: 6209)

C5-893 Target:
5'-AAAAGAAATGATGCAAACAGCAATGCA-3' (SEQ ID NO: 8519)

5'-AAAGAAAUGAUGCAAACAGCAAUGCAA-3' (SEQ ID NO: 13140)

3'-UUUCUUUACUACGUUUGUCGUUACGUU-5' (SEQ ID NO: 6210)

C5-894 Target:
5'-AAAGAAATGATGCAAACAGCAATGCAA-3' (SEQ ID NO: 8520)

5'-AAGAAAUGAUGCAAACAGCAAUGCAAA-3' (SEQ ID NO: 13141)

3'-UUCUUUACUACGUUUGUCGUUACGUUU-5' (SEQ ID NO: 6211)

C5-895 Target:
5'-AAGAAATGATGCAAACAGCAATGCAAA-3' (SEQ ID NO: 8521)

5'-AGAAAUGAUGCAAACAGCAAUGCAAAA-3' (SEQ ID NO: 13142)

3'-UCUUUACUACGUUUGUCGUUACGUUUU-5' (SEQ ID NO: 6212)

C5-896 Target:
5'-AGAAATGATGCAAACAGCAATGCAAAA-3' (SEQ ID NO: 8522)

5'-GAAAUGAUGCAAACAGCAAUGCAAAAC-3' (SEQ ID NO: 13143)

3'-CUUUACUACGUUUGUCGUUACGUUUUG-5' (SEQ ID NO: 6213)

C5-897 Target:
5'-GAAATGATGCAAACAGCAATGCAAAAC-3' (SEQ ID NO: 8523)

5'-AAAUGAUGCAAACAGCAAUGCAAAACA-3' (SEQ ID NO: 13144)

3'-UUUACUACGUUUGUCGUUACGUUUUGU-5' (SEQ ID NO: 6214)

C5-898 Target:
5'-AAATGATGCAAACAGCAATGCAAAACA-3' (SEQ ID NO: 8524)

5'-AAUGAUGCAAACAGCAAUGCAAAACAC-3' (SEQ ID NO: 13145)

3'-UUACUACGUUUGUCGUUACGUUUUGUG-5' (SEQ ID NO: 6215)

C5-899 Target:
5'-AATGATGCAAACAGCAATGCAAAACAC-3' (SEQ ID NO: 8525)

5'-CAAUGUUGAUAAAUGGAAUUGCUCAAG-3' (SEQ ID NO: 13146)

3'-GUUACAACUAUUUACCUUAACGAGUUC-5' (SEQ ID NO: 6216)

C5-925 Target:
5'-CAATGTTGATAAATGGAATTGCTCAAG-3' (SEQ ID NO: 8526)

5'-GUUGAUAAAUGGAAUUGCUCAAGUCAC-3' (SEQ ID NO: 13147)

3'-CAACUAUUUACCUUAACGAGUUCAGUG-5' (SEQ ID NO: 6217)

C5-929 Target:
5'-GTTGATAAATGGAATTGCTCAAGTCAC-3' (SEQ ID NO: 8527)

5'-UUGAUAAAUGGAAUUGCUCAAGUCACA-3' (SEQ ID NO: 13148)

3'-AACUAUUUACCUUAACGAGUUCAGUGU-5' (SEQ ID NO: 6218)

C5-930 Target:
5'-TTGATAAATGGAATTGCTCAAGTCACA-3' (SEQ ID NO: 8528)

5'-GAUAAAUGGAAUUGCUCAAGUCACAUU-3' (SEQ ID NO: 13149)

3'-CUAUUUACCUUAACGAGUUCAGUGUAA-5' (SEQ ID NO: 6219)

C5-932 Target:
5'-GATAAATGGAATTGCTCAAGTCACATT-3' (SEQ ID NO: 8529)

5'-AUAAAUGGAAUUGCUCAAGUCACAUUU-3' (SEQ ID NO: 13150)

3'-UAUUUACCUUAACGAGUUCAGUGUAAA-5' (SEQ ID NO: 6220)

C5-933 Target:
5'-ATAAATGGAATTGCTCAAGTCACATTT-3' (SEQ ID NO: 8530)

5'-UAAAUGGAAUUGCUCAAGUCACAUUUG-3' (SEQ ID NO: 13151)

3'-AUUUACCUUAACGAGUUCAGUGUAAAC-5' (SEQ ID NO: 6221)

C5-934 Target:
5'-TAAATGGAATTGCTCAAGTCACATTTG-3' (SEQ ID NO: 8531)

5'-AAUGGAAUUGCUCAAGUCACAUUUGAU-3' (SEQ ID NO: 13152)

3'-UUACCUUAACGAGUUCAGUGUAAACUA-5' (SEQ ID NO: 6222)

TABLE 9-continued

"Blunt/Blunt" DsiRNAs Corresponding to Human Anti-C5 DsiRNAs Predicted to have >50% Knockdown Efficacy C5-936 Target:
5'-AATGGAATTGCTCAAGTCACATTTGAT-3' (SEQ ID NO: 8532)

5'-AUGGAAUUGCUCAAGUCACAUUUGAUU-3' (SEQ ID NO: 13153)

3'-UACCUUAACGAGUUCAGUGUAAACUAA-5' (SEQ ID NO: 6223)

C5-937 Target:
5'-ATGGAATTGCTCAAGTCACATTTGATT-3' (SEQ ID NO: 8533)

5'-UGGAAUUGCUCAAGUCACAUUUGAUUC-3' (SEQ ID NO: 13154)

3'-ACCUUAACGAGUUCAGUGUAAACUAAG-5' (SEQ ID NO: 6224)

C5-938 Target:
5'-TGGAATTGCTCAAGTCACATTTGATTC-3' (SEQ ID NO: 8534)

5'-GGAAUUGCUCAAGUCACAUUUGAUUCU-3' (SEQ ID NO: 13155)

3'-CCUUAACGAGUUCAGUGUAAACUAAGA-5' (SEQ ID NO: 6225)

C5-939 Target:
5'-GGAATTGCTCAAGTCACATTTGATTCT-3' (SEQ ID NO: 8535)

5'-GAAUUGCUCAAGUCACAUUUGAUUCUG-3' (SEQ ID NO: 13156)

3'-CUUAACGAGUUCAGUGUAAACUAAGAC-5' (SEQ ID NO: 6226)

C5-940 Target:
5'-GAATTGCTCAAGTCACATTTGATTCTG-3' (SEQ ID NO: 8536)

5'-AAUUGCUCAAGUCACAUUUGAUUCUGA-3' (SEQ ID NO: 13157)

3'-UUAACGAGUUCAGUGUAAACUAAGACU-5' (SEQ ID NO: 6227)

C5-941 Target:
5'-AATTGCTCAAGTCACATTTGATTCTGA-3' (SEQ ID NO: 8537)

5'-AUUGCUCAAGUCACAUUUGAUUCUGAA-3' (SEQ ID NO: 13158)

3'-UAACGAGUUCAGUGUAAACUAAGACUU-5' (SEQ ID NO: 6228)

C5-942 Target:
5'-ATTGCTCAAGTCACATTTGATTCTGAA-3' (SEQ ID NO: 8538)

5'-UUGCUCAAGUCACAUUUGAUUCUGAAA-3' (SEQ ID NO: 13159)

3'-AACGAGUUCAGUGUAAACUAAGACUUU-5' (SEQ ID NO: 6229)

C5-943 Target:
5'-TTGCTCAAGTCACATTTGATTCTGAAA-3' (SEQ ID NO: 8539)

5'-GCUCAAGUCACAUUUGAUUCUGAAACA-3' (SEQ ID NO: 13160)

3'-CGAGUUCAGUGUAAACUAAGACUUUGU-5' (SEQ ID NO: 6230)

C5-945 Target:
5'-GCTCAAGTCACATTTGATTCTGAAACA-3' (SEQ ID NO: 8540)

5'-AAGUCACAUUUGAUUCUGAAACAGCAG-3' (SEQ ID NO: 13161)

3'-UUCAGUGUAAACUAAGACUUUGUCGUC-5' (SEQ ID NO: 6231)

C5-949 Target:
5'-AAGTCACATTTGATTCTGAAACAGCAG-3' (SEQ ID NO: 8541)

5'-AGUCACAUUUGAUUCUGAAACAGCAGU-3' (SEQ ID NO: 13162)

3'-UCAGUGUAAACUAAGACUUUGUCGUCA-5' (SEQ ID NO: 6232)

C5-950 Target:
5'-AGTCACATTTGATTCTGAAACAGCAGT-3' (SEQ ID NO: 8542)

5'-GUCACAUUUGAUUCUGAAACAGCAGUC-3' (SEQ ID NO: 13163)

3'-CAGUGUAAACUAAGACUUUGUCGUCAG-5' (SEQ ID NO: 6233)

C5-951 Target:
5'-GTCACATTTGATTCTGAAACAGCAGTC-3' (SEQ ID NO: 8543)

5'-UCACAUUUGAUUCUGAAACAGCAGUCA-3' (SEQ ID NO: 13164)

3'-AGUGUAAACUAAGACUUUGUCGUCAGU-5' (SEQ ID NO: 6234)

C5-952 Target:
5'-TCACATTTGATTCTGAAACAGCAGTCA-3' (SEQ ID NO: 8544)

5'-ACAUUUGAUUCUGAAACAGCAGUCAAA-3' (SEQ ID NO: 13165)

3'-UGUAAACUAAGACUUUGUCGUCAGUUU-5' (SEQ ID NO: 6235)

C5-954 Target:
5'-ACATTTGATTCTGAAACAGCAGTCAAA-3' (SEQ ID NO: 8545)

5'-UUUGAUUCUGAAACAGCAGUCAAAGAA-3' (SEQ ID NO: 13166)

3'-AAACUAAGACUUUGUCGUCAGUUUCUU-5' (SEQ ID NO: 6236)

C5-957 Target:
5'-TTTGATTCTGAAACAGCAGTCAAAGAA-3' (SEQ ID NO: 8546)

5'-UUGAUUCUGAAACAGCAGUCAAAGAAC-3' (SEQ ID NO: 13167)

3'-AACUAAGACUUUGUCGUCAGUUUCUUG-5' (SEQ ID NO: 6237)

C5-958 Target:
5'-TTGATTCTGAAACAGCAGTCAAAGAAC-3' (SEQ ID NO: 8547)

5'-UGAUUCUGAAACAGCAGUCAAAGAACU-3' (SEQ ID NO: 13168)

3'-ACUAAGACUUUGUCGUCAGUUUCUUGA-5' (SEQ ID NO: 6238)

C5-959 Target:
5'-TGATTCTGAAACAGCAGTCAAAGAACT-3' (SEQ ID NO: 8548)

5'-GAUUCUGAAACAGCAGUCAAAGAACUG-3' (SEQ ID NO: 13169)

3'-CUAAGACUUUGUCGUCAGUUUCUUGAC-5' (SEQ ID NO: 6239)

C5-960 Target:
5'-GATTCTGAAACAGCAGTCAAAGAACTG-3' (SEQ ID NO: 8549)

5'-AUUCUGAAACAGCAGUCAAAGAACUGU-3' (SEQ ID NO: 13170)

3'-UAAGACUUUGUCGUCAGUUUCUUGACA-5' (SEQ ID NO: 6240)

C5-961 Target:
5'-ATTCTGAAACAGCAGTCAAAGAACTGT-3' (SEQ ID NO: 8550)

5'-UUCUGAAACAGCAGUCAAAGAACUGUC-3' (SEQ ID NO: 13171)

3'-AAGACUUUGUCGUCAGUUUCUUGACAG-5' (SEQ ID NO: 6241)

C5-962 Target:
5'-TTCTGAAACAGCAGTCAAAGAACTGTC-3' (SEQ ID NO: 8551)

5'-UCUGAAACAGCAGUCAAAGAACUGUCA-3' (SEQ ID NO: 13172)

3'-AGACUUUGUCGUCAGUUUCUUGACAGU-5' (SEQ ID NO: 6242)

TABLE 9-continued

"Blunt/Blunt" DsiRNAs Corresponding to Human Anti-C5 DsiRNAs Predicted to have >50% Knockdown Efficacy C5-963 Target:
5'-TCTGAAACAGCAGTCAAAGAACTGTCA-3' (SEQ ID NO: 8552)

5'-CUGAAACAGCAGUCAAAGAACUGUCAU-3' (SEQ ID NO: 13173)

3'-GACUUUGUCGUCAGUUUCUUGACAGUA-5' (SEQ ID NO: 6243)

C5-964 Target:
5'-CTGAAACAGCAGTCAAAGAACTGTCAT-3' (SEQ ID NO: 8553)

5'-UGAAACAGCAGUCAAAGAACUGUCAUA-3' (SEQ ID NO: 13174)

3'-ACUUUGUCGUCAGUUUCUUGACAGUAU-5' (SEQ ID NO: 6244)

C5-965 Target:
5'-TGAAACAGCAGTCAAAGAACTGTCATA-3' (SEQ ID NO: 8554)

5'-GAAACAGCAGUCAAAGAACUGUCAUAC-3' (SEQ ID NO: 13175)

3'-CUUUGUCGUCAGUUUCUUGACAGUAUG-5' (SEQ ID NO: 6245)

C5-966 Target:
5'-GAAACAGCAGTCAAAGAACTGTCATAC-3' (SEQ ID NO: 8555)

5'-AAACAGCAGUCAAAGAACUGUCAUACU-3' (SEQ ID NO: 13176)

3'-UUUGUCGUCAGUUUCUUGACAGUAUGA-5' (SEQ ID NO: 6246)

C5-967 Target:
5'-AAACAGCAGTCAAAGAACTGTCATACT-3' (SEQ ID NO: 8556)

5'-ACAGCAGUCAAAGAACUGUCAUACUAC-3' (SEQ ID NO: 13177)

3'-UGUCGUCAGUUUCUUGACAGUAUGAUG-5' (SEQ ID NO: 6247)

C5-969 Target:
5'-ACAGCAGTCAAAGAACTGTCATACTAC-3' (SEQ ID NO: 8557)

5'-AGCAGUCAAAGAACUGUCAUACUACAG-3' (SEQ ID NO: 13178)

3'-UCGUCAGUUUCUUGACAGUAUGAUGUC-5' (SEQ ID NO: 6248)

C5-971 Target:
5'-AGCAGTCAAAGAACTGTCATACTACAG-3' (SEQ ID NO: 8558)

5'-GCAGUCAAAGAACUGUCAUACUACAGU-3' (SEQ ID NO: 13179)

3'-CGUCAGUUUCUUGACAGUAUGAUGUCA-5' (SEQ ID NO: 6249)

C5-972 Target:
5'-GCAGTCAAAGAACTGTCATACTACAGT-3' (SEQ ID NO: 8559)

5'-AGUCAAAGAACUGUCAUACUACAGUUU-3' (SEQ ID NO: 13180)

3'-UCAGUUUCUUGACAGUAUGAUGUCAAA-5' (SEQ ID NO: 6250)

C5-974 Target:
5'-AGTCAAAGAACTGTCATACTACAGTTT-3' (SEQ ID NO: 8560)

5'-GUCAAAGAACUGUCAUACUACAGUUUA-3' (SEQ ID NO: 13181)

3'-CAGUUUCUUGACAGUAUGAUGUCAAAU-5' (SEQ ID NO: 6251)

C5-975 Target:
5'-GTCAAAGAACTGTCATACTACAGTTTA-3' (SEQ ID NO: 8561)

5'-UCAAAGAACUGUCAUACUACAGUUUAG-3' (SEQ ID NO: 13182)

3'-AGUUUCUUGACAGUAUGAUGUCAAAUC-5' (SEQ ID NO: 6252)

C5-976 Target:
5'-TCAAAGAACTGTCATACTACAGTTTAG-3' (SEQ ID NO: 8562)

5'-AAGAACUGUCAUACUACAGUUUAGAAG-3' (SEQ ID NO: 13183)

3'-UUCUUGACAGUAUGAUGUCAAAUCUUC-5' (SEQ ID NO: 6253)

C5-979 Target:
5'-AAGAACTGTCATACTACAGTTTAGAAG-3' (SEQ ID NO: 8563)

5'-GAACUGUCAUACUACAGUUUAGAAGAU-3' (SEQ ID NO: 13184)

3'-CUUGACAGUAUGAUGUCAAAUCUUCUA-5' (SEQ ID NO: 6254)

C5-981 Target:
5'-GAACTGTCATACTACAGTTTAGAAGAT-3' (SEQ ID NO: 8564)

5'-AACUGUCAUACUACAGUUUAGAAGAUU-3' (SEQ ID NO: 13185)

3'-UUGACAGUAUGAUGUCAAAUCUUCUAA-5' (SEQ ID NO: 6255)

C5-982 Target:
5'-AACTGTCATACTACAGTTTAGAAGATT-3' (SEQ ID NO: 8565)

5'-ACUGUCAUACUACAGUUUAGAAGAUUU-3' (SEQ ID NO: 13186)

3'-UGACAGUAUGAUGUCAAAUCUUCUAAA-5' (SEQ ID NO: 6256)

C5-983 Target:
5'-ACTGTCATACTACAGTTTAGAAGATTT-3' (SEQ ID NO: 8566)

5'-CUGUCAUACUACAGUUUAGAAGAUUUA-3' (SEQ ID NO: 13187)

3'-GACAGUAUGAUGUCAAAUCUUCUAAAU-5' (SEQ ID NO: 6257)

C5-984 Target:
5'-CTGTCATACTACAGTTTAGAAGATTTA-3' (SEQ ID NO: 8567)

5'-UGUCAUACUACAGUUUAGAAGAUUUAA-3' (SEQ ID NO: 13188)

3'-ACAGUAUGAUGUCAAAUCUUCUAAAUU-5' (SEQ ID NO: 6258)

C5-985 Target:
5'-TGTCATACTACAGTTTAGAAGATTTAA-3' (SEQ ID NO: 8568)

5'-GUCAUACUACAGUUUAGAAGAUUUAAA-3' (SEQ ID NO: 13189)

3'-CAGUAUGAUGUCAAAUCUUCUAAAUUU-5' (SEQ ID NO: 6259)

C5-986 Target:
5'-GTCATACTACAGTTTAGAAGATTTAAA-3' (SEQ ID NO: 8569)

5'-UCAUACUACAGUUUAGAAGAUUUAAAC-3' (SEQ ID NO: 13190)

3'-AGUAUGAUGUCAAAUCUUCUAAAUUUG-5' (SEQ ID NO: 6260)

C5-987 Target:
5'-TCATACTACAGTTTAGAAGATTTAAAC-3' (SEQ ID NO: 8570)

5'-CAUACUACAGUUUAGAAGAUUUAAACA-3' (SEQ ID NO: 13191)

3'-GUAUGAUGUCAAAUCUUCUAAAUUUGU-5' (SEQ ID NO: 6261)

C5-988 Target:
5'-CATACTACAGTTTAGAAGATTTAAACA-3' (SEQ ID NO: 8571)

5'-AUACUACAGUUUAGAAGAUUUAAACAA-3' (SEQ ID NO: 13192)

3'-UAUGAUGUCAAAUCUUCUAAAUUUGUU-5' (SEQ ID NO: 6262)

TABLE 9-continued

"Blunt/Blunt" DsiRNAs Corresponding to Human Anti-C5 DsiRNAs Predicted to have >50% Knockdown Efficacy C5-989 Target:
5'-ATACTACAGTTTAGAAGATTTAAACAA-3' (SEQ ID NO: 8572)

5'-UACUACAGUUUAGAAGAUUUAAACAAC-3' (SEQ ID NO: 13193)

3'-AUGAUGUCAAAUCUUCUAAAUUUGUUG-5' (SEQ ID NO: 6263)

C5-990 Target:
5'-TACTACAGTTTAGAAGATTTAAACAAC-3' (SEQ ID NO: 8573)

5'-ACUACAGUUUAGAAGAUUUAAACAACA-3' (SEQ ID NO: 13194)

3'-UGAUGUCAAAUCUUCUAAAUUUGUUGU-5' (SEQ ID NO: 6264)

C5-991 Target:
5'-ACTACAGTTTAGAAGATTTAAACAACA-3' (SEQ ID NO: 8574)

5'-CUACAGUUUAGAAGAUUUAAACAACAA-3' (SEQ ID NO: 13195)

3'-GAUGUCAAAUCUUCUAAAUUUGUUGUU-5' (SEQ ID NO: 6265)

C5-992 Target:
5'-CTACAGTTTAGAAGATTTAAACAACAA-3' (SEQ ID NO: 8575)

5'-UACAGUUUAGAAGAUUUAAACAACAAG-3' (SEQ ID NO: 13196)

3'-AUGUCAAAUCUUCUAAAUUUGUUGUUC-5' (SEQ ID NO: 6266)

C5-993 Target:
5'-TACAGTTTAGAAGATTTAAACAACAAG-3' (SEQ ID NO: 8576)

5'-ACAGUUUAGAAGAUUUAAACAACAAGU-3' (SEQ ID NO: 13197)

3'-UGUCAAAUCUUCUAAAUUUGUUGUUCA-5' (SEQ ID NO: 6267)

C5-994 Target:
5'-ACAGTTTAGAAGATTTAAACAACAAGT-3' (SEQ ID NO: 8577)

5'-CAGUUUAGAAGAUUUAAACAACAAGUA-3' (SEQ ID NO: 13198)

3'-GUCAAAUCUUCUAAAUUUGUUGUUCAU-5' (SEQ ID NO: 6268)

C5-995 Target:
5'-CAGTTTAGAAGATTTAAACAACAAGTA-3' (SEQ ID NO: 8578)

5'-AGUUUAGAAGAUUUAAACAACAAGUAC-3' (SEQ ID NO: 13199)

3'-UCAAAUCUUCUAAAUUUGUUGUUCAUG-5' (SEQ ID NO: 6269)

C5-996 Target:
5'-AGTTTAGAAGATTTAAACAACAAGTAC-3' (SEQ ID NO: 8579)

5'-GUUUAGAAGAUUUAAACAACAAGUACC-3' (SEQ ID NO: 13200)

3'-CAAAUCUUCUAAAUUUGUUGUUCAUGG-5' (SEQ ID NO: 6270)

C5-997 Target:
5'-GTTTAGAAGATTTAAACAACAAGTACC-3' (SEQ ID NO: 8580)

5'-UUUAGAAGAUUUAAACAACAAGUACCU-3' (SEQ ID NO: 13201)

3'-AAAUCUUCUAAAUUUGUUGUUCAUGGA-5' (SEQ ID NO: 6271)

C5-998 Target:
5'-TTTAGAAGATTTAAACAACAAGTACCT-3' (SEQ ID NO: 8581)

5'-UUAGAAGAUUUAAACAACAAGUACCUU-3' (SEQ ID NO: 13202)

3'-AAUCUUCUAAAUUUGUUGUUCAUGGAA-5' (SEQ ID NO: 6272)

C5-999 Target:
5'-TTAGAAGATTTAAACAACAAGTACCTT-3' (SEQ ID NO: 8582)

5'-UAGAAGAUUUAAACAACAAGUACCUUU-3' (SEQ ID NO: 13203)

3'-AUCUUCUAAAUUUGUUGUUCAUGGAAA-5' (SEQ ID NO: 6273)

C5-1000 Target:
5'-TAGAAGATTTAAACAACAAGTACCTTT-3' (SEQ ID NO: 8583)

5'-AGAAGAUUUAAACAACAAGUACCUUUA-3' (SEQ ID NO: 13204)

3'-UCUUCUAAAUUUGUUGUUCAUGGAAAU-5' (SEQ ID NO: 6274)

C5-1001 Target:
5'-AGAAGATTTAAACAACAAGTACCTTTA-3' (SEQ ID NO: 8584)

5'-GAAGAUUUAAACAACAAGUACCUUUAU-3' (SEQ ID NO: 13205)

3'-CUUCUAAAUUUGUUGUUCAUGGAAAUA-5' (SEQ ID NO: 6275)

C5-1002 Target:
5'-GAAGATTTAAACAACAAGTACCTTTAT-3' (SEQ ID NO: 8585)

5'-AAGAUUUAAACAACAAGUACCUUUAUA-3' (SEQ ID NO: 13206)

3'-UUCUAAAUUUGUUGUUCAUGGAAAUAU-5' (SEQ ID NO: 6276)

C5-1003 Target:
5'-AAGATTTAAACAACAAGTACCTTTATA-3' (SEQ ID NO: 8586)

5'-AGAUUUAAACAACAAGUACCUUUAUAU-3' (SEQ ID NO: 13207)

3'-UCUAAAUUUGUUGUUCAUGGAAAUAUA-5' (SEQ ID NO: 6277)

C5-1004 Target:
5'-AGATTTAAACAACAAGTACCTTTATAT-3' (SEQ ID NO: 8587)

5'-GAUUUAAACAACAAGUACCUUUAUAUU-3' (SEQ ID NO: 13208)

3'-CUAAAUUUGUUGUUCAUGGAAAUAUAA-5' (SEQ ID NO: 6278)

C5-1005 Target:
5'-GATTTAAACAACAAGTACCTTTATATT-3' (SEQ ID NO: 8588)

5'-AGUACCUUUAUAUUGCUGUAACAGUCA-3' (SEQ ID NO: 13209)

3'-UCAUGGAAAUAUAACGACAUUGUCAGU-5' (SEQ ID NO: 6279)

C5-1018 Target:
5'-AGTACCTTTATATTGCTGTAACAGTCA-3' (SEQ ID NO: 8589)

5'-UACCUUUAUAUUGCUGUAACAGUCAUA-3' (SEQ ID NO: 13210)

3'-AUGGAAAUAUAACGACAUUGUCAGUAU-5' (SEQ ID NO: 6280)

C5-1020 Target:
5'-TACCTTTATATTGCTGTAACAGTCATA-3' (SEQ ID NO: 8590)

5'-ACCUUUAUAUUGCUGUAACAGUCAUAG-3' (SEQ ID NO: 13211)

3'-UGGAAAUAUAACGACAUUGUCAGUAUC-5' (SEQ ID NO: 6281)

C5-1021 Target:
5'-ACCTTTATATTGCTGTAACAGTCATAG-3' (SEQ ID NO: 8591)

5'-CCUUUAUAUUGCUGUAACAGUCAUAGA-3' (SEQ ID NO: 13212)

3'-GGAAAUAUAACGACAUUGUCAGUAUCU-5' (SEQ ID NO: 6282)

TABLE 9-continued

"Blunt/Blunt" DsiRNAs Corresponding to Human Anti-C5 DsiRNAs Predicted to have >50% Knockdown Efficacy C5-1022 Target:
5'-CCTTTATATTGCTGTAACAGTCATAGA-3' (SEQ ID NO: 8592)

5'-CUUUAUAUUGCUGUAACAGUCAUAGAG-3' (SEQ ID NO: 13213)

3'-GAAAUAUAACGACAUUGUCAGUAUCUC-5' (SEQ ID NO: 6283)

C5-1023 Target:
5'-CTTTATATTGCTGTAACAGTCATAGAG-3' (SEQ ID NO: 8593)

5'-UUUAUAUUGCUGUAACAGUCAUAGAGU-3' (SEQ ID NO: 13214)

3'-AAAUAUAACGACAUUGUCAGUAUCUCA-5' (SEQ ID NO: 6284)

C5-1024 Target:
5'-TTTATATTGCTGTAACAGTCATAGAGT-3' (SEQ ID NO: 8594)

5'-UUAUAUUGCUGUAACAGUCAUAGAGUC-3' (SEQ ID NO: 13215)

3'-AAUAUAACGACAUUGUCAGUAUCUCAG-5' (SEQ ID NO: 6285)

C5-1025 Target:
5'-TTATATTGCTGTAACAGTCATAGAGTC-3' (SEQ ID NO: 8595)

5'-UAUAUUGCUGUAACAGUCAUAGAGUCU-3' (SEQ ID NO: 13216)

3'-AUAUAACGACAUUGUCAGUAUCUCAGA-5' (SEQ ID NO: 6286)

C5-1026 Target:
5'-TATATTGCTGTAACAGTCATAGAGTCT-3' (SEQ ID NO: 8596)

5'-AUAUUGCUGUAACAGUCAUAGAGUCUA-3' (SEQ ID NO: 13217)

3'-UAUAACGACAUUGUCAGUAUCUCAGAU-5' (SEQ ID NO: 6287)

C5-1027 Target:
5'-ATATTGCTGTAACAGTCATAGAGTCTA-3' (SEQ ID NO: 8597)

5'-UAUUGCUGUAACAGUCAUAGAGUCUAC-3' (SEQ ID NO: 13218)

3'-AUAACGACAUUGUCAGUAUCUCAGAUG-5' (SEQ ID NO: 6288)

C5-1028 Target:
5'-TATTGCTGTAACAGTCATAGAGTCTAC-3' (SEQ ID NO: 8598)

5'-AUUGCUGUAACAGUCAUAGAGUCUACA-3' (SEQ ID NO: 13219)

3'-UAACGACAUUGUCAGUAUCUCAGAUGU-5' (SEQ ID NO: 6289)

C5-1029 Target:
5'-ATTGCTGTAACAGTCATAGAGTCTACA-3' (SEQ ID NO: 8599)

5'-UUGCUGUAACAGUCAUAGAGUCUACAG-3' (SEQ ID NO: 13220)

3'-AACGACAUUGUCAGUAUCUCAGAUGUC-5' (SEQ ID NO: 6290)

C5-1030 Target:
5'-TTGCTGTAACAGTCATAGAGTCTACAG-3' (SEQ ID NO: 8600)

5'-UGCUGUAACAGUCAUAGAGUCUACAGG-3' (SEQ ID NO: 13221)

3'-ACGACAUUGUCAGUAUCUCAGAUGUCC-5' (SEQ ID NO: 6291)

C5-1031 Target:
5'-TGCTGTAACAGTCATAGAGTCTACAGG-3' (SEQ ID NO: 8601)

5'-GCUGUAACAGUCAUAGAGUCUACAGGU-3' (SEQ ID NO: 13222)

3'-CGACAUUGUCAGUAUCUCAGAUGUCCA-5' (SEQ ID NO: 6292)

C5-1032 Target:
5'-GCTGTAACAGTCATAGAGTCTACAGGT-3' (SEQ ID NO: 8602)

5'-CUGUAACAGUCAUAGAGUCUACAGGUG-3' (SEQ ID NO: 13223)

3'-GACAUUGUCAGUAUCUCAGAUGUCCAC-5' (SEQ ID NO: 6293)

C5-1033 Target:
5'-CTGTAACAGTCATAGAGTCTACAGGTG-3' (SEQ ID NO: 8603)

5'-UGUAACAGUCAUAGAGUCUACAGGUGG-3' (SEQ ID NO: 13224)

3'-ACAUUGUCAGUAUCUCAGAUGUCCACC-5' (SEQ ID NO: 6294)

C5-1034 Target:
5'-TGTAACAGTCATAGAGTCTACAGGTGG-3' (SEQ ID NO: 8604)

5'-GUAACAGUCAUAGAGUCUACAGGUGGA-3' (SEQ ID NO: 13225)

3'-CAUUGUCAGUAUCUCAGAUGUCCACCU-5' (SEQ ID NO: 6295)

C5-1035 Target:
5'-GTAACAGTCATAGAGTCTACAGGTGGA-3' (SEQ ID NO: 8605)

5'-UAACAGUCAUAGAGUCUACAGGUGGAU-3' (SEQ ID NO: 13226)

3'-AUUGUCAGUAUCUCAGAUGUCCACCUA-5' (SEQ ID NO: 6296)

C5-1036 Target:
5'-TAACAGTCATAGAGTCTACAGGTGGAT-3' (SEQ ID NO: 8606)

5'-AACAGUCAUAGAGUCUACAGGUGGAUU-3' (SEQ ID NO: 13227)

3'-UUGUCAGUAUCUCAGAUGUCCACCUAA-5' (SEQ ID NO: 6297)

C5-1037 Target:
5'-AACAGTCATAGAGTCTACAGGTGGATT-3' (SEQ ID NO: 8607)

5'-ACAGUCAUAGAGUCUACAGGUGGAUUU-3' (SEQ ID NO: 13228)

3'-UGUCAGUAUCUCAGAUGUCCACCUAAA-5' (SEQ ID NO: 6298)

C5-1038 Target:
5'-ACAGTCATAGAGTCTACAGGTGGATTT-3' (SEQ ID NO: 8608)

5'-CAGUCAUAGAGUCUACAGGUGGAUUUU-3' (SEQ ID NO: 13229)

3'-GUCAGUAUCUCAGAUGUCCACCUAAAA-5' (SEQ ID NO: 6299)

C5-1039 Target:
5'-CAGTCATAGAGTCTACAGGTGGATTTT-3' (SEQ ID NO: 8609)

5'-AGUCAUAGAGUCUACAGGUGGAUUUUC-3' (SEQ ID NO: 13230)

3'-UCAGUAUCUCAGAUGUCCACCUAAAAG-5' (SEQ ID NO: 6300)

C5-1040 Target:
5'-AGTCATAGAGTCTACAGGTGGATTTTC-3' (SEQ ID NO: 8610)

5'-GUCAUAGAGUCUACAGGUGGAUUUUCU-3' (SEQ ID NO: 13231)

3'-CAGUAUCUCAGAUGUCCACCUAAAAGA-5' (SEQ ID NO: 6301)

C5-1041 Target:
5'-GTCATAGAGTCTACAGGTGGATTTTCT-3' (SEQ ID NO: 8611)

5'-UCAUAGAGUCUACAGGUGGAUUUUCUG-3' (SEQ ID NO: 13232)

3'-AGUAUCUCAGAUGUCCACCUAAAAGAC-5' (SEQ ID NO: 6302)

TABLE 9-continued

"Blunt/Blunt" DsiRNAs Corresponding to Human Anti-C5 DsiRNAs Predicted to have >50% Knockdown Efficacy C5-1042 Target:
5'-TCATAGAGTCTACAGGTGGATTTTCTG-3' (SEQ ID NO: 8612)

5'-CAUAGAGUCUACAGGUGGAUUUUCUGA-3' (SEQ ID NO: 13233)

3'-GUAUCUCAGAUGUCCACCUAAAAGACU-5' (SEQ ID NO: 6303)

C5-1043 Target:
5'-CATAGAGTCTACAGGTGGATTTTCTGA-3' (SEQ ID NO: 8613)

5'-AUAGAGUCUACAGGUGGAUUUUCUGAA-3' (SEQ ID NO: 13234)

3'-UAUCUCAGAUGUCCACCUAAAAGACUU-5' (SEQ ID NO: 6304)

C5-1044 Target:
5'-ATAGAGTCTACAGGTGGATTTTCTGAA-3' (SEQ ID NO: 8614)

5'-UAGAGUCUACAGGUGGAUUUUCUGAAG-3' (SEQ ID NO: 13235)

3'-AUCUCAGAUGUCCACCUAAAAGACUUC-5' (SEQ ID NO: 6305)

C5-1045 Target:
5'-TAGAGTCTACAGGTGGATTTTCTGAAG-3' (SEQ ID NO: 8615)

5'-AGAGUCUACAGGUGGAUUUUCUGAAGA-3' (SEQ ID NO: 13236)

3'-UCUCAGAUGUCCACCUAAAAGACUUCU-5' (SEQ ID NO: 6306)

C5-1046 Target:
5'-AGAGTCTACAGGTGGATTTTCTGAAGA-3' (SEQ ID NO: 8616)

5'-GAGUCUACAGGUGGAUUUUCUGAAGAG-3' (SEQ ID NO: 13237)

3'-CUCAGAUGUCCACCUAAAAGACUUCUC-5' (SEQ ID NO: 6307)

C5-1047 Target:
5'-GAGTCTACAGGTGGATTTTCTGAAGAG-3' (SEQ ID NO: 8617)

5'-AGUCUACAGGUGGAUUUUCUGAAGAGG-3' (SEQ ID NO: 13238)

3'-UCAGAUGUCCACCUAAAAGACUUCUCC-5' (SEQ ID NO: 6308)

C5-1048 Target:
5'-AGTCTACAGGTGGATTTTCTGAAGAGG-3' (SEQ ID NO: 8618)

5'-GUCUACAGGUGGAUUUUCUGAAGAGGC-3' (SEQ ID NO: 13239)

3'-CAGAUGUCCACCUAAAAGACUUCUCCG-5' (SEQ ID NO: 6309)

C5-1049 Target:
5'-GTCTACAGGTGGATTTTCTGAAGAGGC-3' (SEQ ID NO: 8619)

5'-UCUACAGGUGGAUUUUCUGAAGAGGCA-3' (SEQ ID NO: 13240)

3'-AGAUGUCCACCUAAAAGACUUCUCCGU-5' (SEQ ID NO: 6310)

C5-1050 Target:
5'-TCTACAGGTGGATTTTCTGAAGAGGCA-3' (SEQ ID NO: 8620)

5'-CUACAGGUGGAUUUUCUGAAGAGGCAG-3' (SEQ ID NO: 13241)

3'-GAUGUCCACCUAAAAGACUUCUCCGUC-5' (SEQ ID NO: 6311)

C5-1051 Target:
5'-CTACAGGTGGATTTTCTGAAGAGGCAG-3' (SEQ ID NO: 8621)

5'-UACAGGUGGAUUUUCUGAAGAGGCAGA-3' (SEQ ID NO: 13242)

3'-AUGUCCACCUAAAAGACUUCUCCGUCU-5' (SEQ ID NO: 6312)

TABLE 9-continued

"Blunt/Blunt" DsiRNAs Corresponding to Human Anti-C5 DsiRNAs Predicted to have >50% Knockdown Efficacy C5-1052 Target:
5'-TACAGGTGGATTTTCTGAAGAGGCAGA-3' (SEQ ID NO: 8622)

5'-ACAGGUGGAUUUUCUGAAGAGGCAGAA-3' (SEQ ID NO: 13243)

3'-UGUCCACCUAAAAGACUUCUCCGUCUU-5' (SEQ ID NO: 6313)

C5-1053 Target:
5'-ACAGGTGGATTTTCTGAAGAGGCAGAA-3' (SEQ ID NO: 8623)

5'-CAGGUGGAUUUUCUGAAGAGGCAGAAA-3' (SEQ ID NO: 13244)

3'-GUCCACCUAAAAGACUUCUCCGUCUUU-5' (SEQ ID NO: 6314)

C5-1054 Target:
5'-CAGGTGGATTTTCTGAAGAGGCAGAAA-3' (SEQ ID NO: 8624)

5'-AGGUGGAUUUUCUGAAGAGGCAGAAAU-3' (SEQ ID NO: 13245)

3'-UCCACCUAAAAGACUUCUCCGUCUUUA-5' (SEQ ID NO: 6315)

C5-1055 Target:
5'-AGGTGGATTTTCTGAAGAGGCAGAAAT-3' (SEQ ID NO: 8625)

5'-GGUGGAUUUUCUGAAGAGGCAGAAAUA-3' (SEQ ID NO: 13246)

3'-CCACCUAAAAGACUUCUCCGUCUUUAU-5' (SEQ ID NO: 6316)

C5-1056 Target:
5'-GGTGGATTTTCTGAAGAGGCAGAAATA-3' (SEQ ID NO: 8626)

5'-GUGGAUUUUCUGAAGAGGCAGAAAUAC-3' (SEQ ID NO: 13247)

3'-CACCUAAAAGACUUCUCCGUCUUUAUG-5' (SEQ ID NO: 6317)

C5-1057 Target:
5'-GTGGATTTTCTGAAGAGGCAGAAATAC-3' (SEQ ID NO: 8627)

5'-UGGAUUUUCUGAAGAGGCAGAAAUACC-3' (SEQ ID NO: 13248)

3'-ACCUAAAAGACUUCUCCGUCUUUAUGG-5' (SEQ ID NO: 6318)

C5-1058 Target:
5'-TGGATTTTCTGAAGAGGCAGAAATACC-3' (SEQ ID NO: 8628)

5'-GGAUUUUCUGAAGAGGCAGAAAUACCU-3' (SEQ ID NO: 13249)

3'-CCUAAAAGACUUCUCCGUCUUUAUGGA-5' (SEQ ID NO: 6319)

C5-1059 Target:
5'-GGATTTTCTGAAGAGGCAGAAATACCT-3' (SEQ ID NO: 8629)

5'-GAUUUUCUGAAGAGGCAGAAAUACCUG-3' (SEQ ID NO: 13250)

3'-CUAAAAGACUUCUCCGUCUUUAUGGAC-5' (SEQ ID NO: 6320)

C5-1060 Target:
5'-GATTTTCTGAAGAGGCAGAAATACCTG-3' (SEQ ID NO: 8630)

5'-AUUUUCUGAAGAGGCAGAAAUACCUGG-3' (SEQ ID NO: 13251)

3'-UAAAAGACUUCUCCGUCUUUAUGGACC-5' (SEQ ID NO: 6321)

C5-1061 Target:
5'-ATTTTCTGAAGAGGCAGAAATACCTGG-3' (SEQ ID NO: 8631)

5'-UUUUCUGAAGAGGCAGAAAUACCUGGC-3' (SEQ ID NO: 13252)

3'-AAAAGACUUCUCCGUCUUUAUGGACCG-5' (SEQ ID NO: 6322)

TABLE 9-continued

"Blunt/Blunt" DsiRNAs Corresponding to Human Anti-C5 DsiRNAs Predicted to have >50% Knockdown Efficacy C5-1062 Target:
5'-TTTTCTGAAGAGGCAGAAATACCTGGC-3' (SEQ ID NO: 8632)

5'-UUUCUGAAGAGGCAGAAAUACCUGGCA-3' (SEQ ID NO: 13253)

3'-AAAGACUUCUCCGUCUUUAUGGACCGU-5' (SEQ ID NO: 6323)

C5-1063 Target:
5'-TTTCTGAAGAGGCAGAAATACCTGGCA-3' (SEQ ID NO: 8633)

5'-UUCUGAAGAGGCAGAAAUACCUGGCAU-3' (SEQ ID NO: 13254)

3'-AAGACUUCUCCGUCUUUAUGGACCGUA-5' (SEQ ID NO: 6324)

C5-1064 Target:
5'-TTCTGAAGAGGCAGAAATACCTGGCAT-3' (SEQ ID NO: 8634)

5'-UCUGAAGAGGCAGAAAUACCUGGCAUC-3' (SEQ ID NO: 13255)

3'-AGACUUCUCCGUCUUUAUGGACCGUAG-5' (SEQ ID NO: 6325)

C5-1065 Target:
5'-TCTGAAGAGGCAGAAATACCTGGCATC-3' (SEQ ID NO: 8635)

5'-CUGAAGAGGCAGAAAUACCUGGCAUCA-3' (SEQ ID NO: 13256)

3'-GACUUCUCCGUCUUUAUGGACCGUAGU-5' (SEQ ID NO: 6326)

C5-1066 Target:
5'-CTGAAGAGGCAGAAATACCTGGCATCA-3' (SEQ ID NO: 8636)

5'-UGAAGAGGCAGAAAUACCUGGCAUCAA-3' (SEQ ID NO: 13257)

3'-ACUUCUCCGUCUUUAUGGACCGUAGUU-5' (SEQ ID NO: 6327)

C5-1067 Target:
5'-TGAAGAGGCAGAAATACCTGGCATCAA-3' (SEQ ID NO: 8637)

5'-GAAGAGGCAGAAAUACCUGGCAUCAAA-3' (SEQ ID NO: 13258)

3'-CUUCUCCGUCUUUAUGGACCGUAGUUU-5' (SEQ ID NO: 6328)

C5-1068 Target:
5'-GAAGAGGCAGAAATACCTGGCATCAAA-3' (SEQ ID NO: 8638)

5'-AAGAGGCAGAAAUACCUGGCAUCAAAU-3' (SEQ ID NO: 13259)

3'-UUCUCCGUCUUUAUGGACCGUAGUUUA-5' (SEQ ID NO: 6329)

C5-1069 Target:
5'-AAGAGGCAGAAATACCTGGCATCAAAT-3' (SEQ ID NO: 8639)

5'-AGAGGCAGAAAUACCUGGCAUCAAAUA-3' (SEQ ID NO: 13260)

3'-UCUCCGUCUUUAUGGACCGUAGUUUAU-5' (SEQ ID NO: 6330)

C5-1070 Target:
5'-AGAGGCAGAAATACCTGGCATCAAATA-3' (SEQ ID NO: 8640)

5'-GAGGCAGAAAUACCUGGCAUCAAAUAU-3' (SEQ ID NO: 13261)

3'-CUCCGUCUUUAUGGACCGUAGUUUAUA-5' (SEQ ID NO: 6331)

C5-1071 Target:
5'-GAGGCAGAAATACCTGGCATCAAATAT-3' (SEQ ID NO: 8641)

5'-AGGCAGAAAUACCUGGCAUCAAAUAUG-3' (SEQ ID NO: 13262)

3'-UCCGUCUUUAUGGACCGUAGUUUAUAC-5' (SEQ ID NO: 6332)

C5-1072 Target:
5'-AGGCAGAAATACCTGGCATCAAATATG-3' (SEQ ID NO: 8642)

5'-GGCAGAAAUACCUGGCAUCAAAUAUGU-3' (SEQ ID NO: 13263)

3'-CCGUCUUUAUGGACCGUAGUUUAUACA-5' (SEQ ID NO: 6333)

C5-1073 Target:
5'-GGCAGAAATACCTGGCATCAAATATGT-3' (SEQ ID NO: 8643)

5'-GCAGAAAUACCUGGCAUCAAAUAUGUC-3' (SEQ ID NO: 13264)

3'-CGUCUUUAUGGACCGUAGUUUAUACAG-5' (SEQ ID NO: 6334)

C5-1074 Target:
5'-GCAGAAATACCTGGCATCAAATATGTC-3' (SEQ ID NO: 8644)

5'-CAGAAAUACCUGGCAUCAAAUAUGUCC-3' (SEQ ID NO: 13265)

3'-GUCUUUAUGGACCGUAGUUUAUACAGG-5' (SEQ ID NO: 6335)

C5-1075 Target:
5'-CAGAAATACCTGGCATCAAATATGTCC-3' (SEQ ID NO: 8645)

5'-AGAAAUACCUGGCAUCAAAUAUGUCCU-3' (SEQ ID NO: 13266)

3'-UCUUUAUGGACCGUAGUUUAUACAGGA-5' (SEQ ID NO: 6336)

C5-1076 Target:
5'-AGAAATACCTGGCATCAAATATGTCCT-3' (SEQ ID NO: 8646)

5'-GAAAUACCUGGCAUCAAAUAUGUCCUC-3' (SEQ ID NO: 13267)

3'-CUUUAUGGACCGUAGUUUAUACAGGAG-5' (SEQ ID NO: 6337)

C5-1077 Target:
5'-GAAATACCTGGCATCAAATATGTCCTC-3' (SEQ ID NO: 8647)

5'-AAAUACCUGGCAUCAAAUAUGUCCUCU-3' (SEQ ID NO: 13268)

3'-UUUAUGGACCGUAGUUUAUACAGGAGA-5' (SEQ ID NO: 6338)

C5-1078 Target:
5'-AAATACCTGGCATCAAATATGTCCTCT-3' (SEQ ID NO: 8648)

5'-AAUACCUGGCAUCAAAUAUGUCCUCUC-3' (SEQ ID NO: 13269)

3'-UUAUGGACCGUAGUUUAUACAGGAGAG-5' (SEQ ID NO: 6339)

C5-1079 Target:
5'-AATACCTGGCATCAAATATGTCCTCTC-3' (SEQ ID NO: 8649)

5'-AUACCUGGCAUCAAAUAUGUCCUCUCU-3' (SEQ ID NO: 13270)

3'-UAUGGACCGUAGUUUAUACAGGAGAGA-5' (SEQ ID NO: 6340)

C5-1080 Target:
5'-ATACCTGGCATCAAATATGTCCTCTCT-3' (SEQ ID NO: 8650)

5'-UACCUGGCAUCAAAUAUGUCCUCUCUC-3' (SEQ ID NO: 13271)

3'-AUGGACCGUAGUUUAUACAGGAGAGAG-5' (SEQ ID NO: 6341)

C5-1081 Target:
5'-TACCTGGCATCAAATATGTCCTCTCTC-3' (SEQ ID NO: 8651)

5'-ACCUGGCAUCAAAUAUGUCCUCUCUCC-3' (SEQ ID NO: 13272)

3'-UGGACCGUAGUUUAUACAGGAGAGAGG-5' (SEQ ID NO: 6342)

TABLE 9-continued

"Blunt/Blunt" DsiRNAs Corresponding to Human Anti-C5 DsiRNAs Predicted to have >50% Knockdown Efficacy C5-1082 Target:
5'-ACCTGGCATCAAATATGTCCTCTCTCC-3' (SEQ ID NO: 8652)

5'-CCUGGCAUCAAAUAUGUCCUCUCUCCC-3' (SEQ ID NO: 13273)

3'-GGACCGUAGUUUAUACAGGAGAGAGGG-5' (SEQ ID NO: 6343)

C5-1083 Target:
5'-CCTGGCATCAAATATGTCCTCTCTCCC-3' (SEQ ID NO: 8653)

5'-CUGGCAUCAAAUAUGUCCUCUCUCCCU-3' (SEQ ID NO: 13274)

3'-GACCGUAGUUUAUACAGGAGAGAGGGA-5' (SEQ ID NO: 6344)

C5-1084 Target:
5'-CTGGCATCAAATATGTCCTCTCTCCCT-3' (SEQ ID NO: 8654)

5'-UGGCAUCAAAUAUGUCCUCUCUCCCUA-3' (SEQ ID NO: 13275)

3'-ACCGUAGUUUAUACAGGAGAGAGGGAU-5' (SEQ ID NO: 6345)

C5-1085 Target:
5'-TGGCATCAAATATGTCCTCTCTCCCTA-3' (SEQ ID NO: 8655)

5'-GGCAUCAAAUAUGUCCUCUCUCCCUAC-3' (SEQ ID NO: 13276)

3'-CCGUAGUUUAUACAGGAGAGAGGGAUG-5' (SEQ ID NO: 6346)

C5-1086 Target:
5'-GGCATCAAATATGTCCTCTCTCCCTAC-3' (SEQ ID NO: 8656)

5'-GCAUCAAAUAUGUCCUCUCUCCCUACA-3' (SEQ ID NO: 13277)

3'-CGUAGUUUAUACAGGAGAGAGGGAUGU-5' (SEQ ID NO: 6347)

C5-1087 Target:
5'-GCATCAAATATGTCCTCTCTCCCTACA-3' (SEQ ID NO: 8657)

5'-AUCAAAUAUGUCCUCUCUCCCUACAAA-3' (SEQ ID NO: 13278)

3'-UAGUUUAUACAGGAGAGAGGGAUGUUU-5' (SEQ ID NO: 6348)

C5-1089 Target:
5'-ATCAAATATGTCCTCTCTCCCTACAAA-3' (SEQ ID NO: 8658)

5'-UCAAAUAUGUCCUCUCUCCCUACAAAC-3' (SEQ ID NO: 13279)

3'-AGUUUAUACAGGAGAGAGGGAUGUUUG-5' (SEQ ID NO: 6349)

C5-1090 Target:
5'-TCAAATATGTCCTCTCTCCCTACAAAC-3' (SEQ ID NO: 8659)

5'-CAAAUAUGUCCUCUCUCCCUACAAACU-3' (SEQ ID NO: 13280)

3'-GUUUAUACAGGAGAGAGGGAUGUUUGA-5' (SEQ ID NO: 6350)

C5-1091 Target:
5'-CAAATATGTCCTCTCTCCCTACAAACT-3' (SEQ ID NO: 8660)

5'-AAAUAUGUCCUCUCUCCCUACAAACUG-3' (SEQ ID NO: 13281)

3'-UUUAUACAGGAGAGAGGGAUGUUUGAC-5' (SEQ ID NO: 6351)

C5-1092 Target:
5'-AAATATGTCCTCTCTCCCTACAAACTG-3' (SEQ ID NO: 8661)

5'-AAUAUGUCCUCUCUCCCUACAAACUGA-3' (SEQ ID NO: 13282)

3'-UUAUACAGGAGAGAGGGAUGUUUGACU-5' (SEQ ID NO: 6352)

C5-1093 Target:
5'-AATATGTCCTCTCTCCCTACAAACTGA-3' (SEQ ID NO: 8662)

5'-AUAUGUCCUCUCUCCCUACAAACUGAA-3' (SEQ ID NO: 13283)

3'-UAUACAGGAGAGAGGGAUGUUUGACUU-5' (SEQ ID NO: 6353)

C5-1094 Target:
5'-ATATGTCCTCTCTCCCTACAAACTGAA-3' (SEQ ID NO: 8663)

5'-UAUGUCCUCUCUCCCUACAAACUGAAU-3' (SEQ ID NO: 13284)

3'-AUACAGGAGAGAGGGAUGUUUGACUUA-5' (SEQ ID NO: 6354)

C5-1095 Target:
5'-TATGTCCTCTCTCCCTACAAACTGAAT-3' (SEQ ID NO: 8664)

5'-AUGUCCUCUCUCCCUACAAACUGAAUU-3' (SEQ ID NO: 13285)

3'-UACAGGAGAGAGGGAUGUUUGACUUAA-5' (SEQ ID NO: 6355)

C5-1096 Target:
5'-ATGTCCTCTCTCCCTACAAACTGAATT-3' (SEQ ID NO: 8665)

5'-UGUCCUCUCUCCCUACAAACUGAAUUU-3' (SEQ ID NO: 13286)

3'-ACAGGAGAGAGGGAUGUUUGACUUAAA-5' (SEQ ID NO: 6356)

C5-1097 Target:
5'-TGTCCTCTCTCCCTACAAACTGAATTT-3' (SEQ ID NO: 8666)

5'-GUCCUCUCUCCCUACAAACUGAAUUUG-3' (SEQ ID NO: 13287)

3'-CAGGAGAGAGGGAUGUUUGACUUAAAC-5' (SEQ ID NO: 6357)

C5-1098 Target:
5'-GTCCTCTCTCCCTACAAACTGAATTTG-3' (SEQ ID NO: 8667)

5'-UCCUCUCUCCCUACAAACUGAAUUUGG-3' (SEQ ID NO: 13288)

3'-AGGAGAGAGGGAUGUUUGACUUAAACC-5' (SEQ ID NO: 6358)

C5-1099 Target:
5'-TCCTCTCTCCCTACAAACTGAATTTGG-3' (SEQ ID NO: 8668)

5'-CCUCUCUCCCUACAAACUGAAUUUGGU-3' (SEQ ID NO: 13289)

3'-GGAGAGAGGGAUGUUUGACUUAAACCA-5' (SEQ ID NO: 6359)

C5-1100 Target:
5'-CCTCTCTCCCTACAAACTGAATTTGGT-3' (SEQ ID NO: 8669)

5'-CUCUCUCCCUACAAACUGAAUUUGGUU-3' (SEQ ID NO: 13290)

3'-GAGAGAGGGAUGUUUGACUUAAACCAA-5' (SEQ ID NO: 6360)

C5-1101 Target:
5'-CTCTCTCCCTACAAACTGAATTTGGTT-3' (SEQ ID NO: 8670)

5'-UCUCUCCCUACAAACUGAAUUUGGUUG-3' (SEQ ID NO: 13291)

3'-AGAGAGGGAUGUUUGACUUAAACCAAC-5' (SEQ ID NO: 6361)

C5-1102 Target:
5'-TCTCTCCCTACAAACTGAATTTGGTTG-3' (SEQ ID NO: 8671)

5'-CUCUCCCUACAAACUGAAUUUGGUUGC-3' (SEQ ID NO: 13292)

3'-GAGAGGGAUGUUUGACUUAAACCAACG-5' (SEQ ID NO: 6362)

TABLE 9-continued

"Blunt/Blunt" DsiRNAs Corresponding to Human Anti-C5 DsiRNAs Predicted to have >50% Knockdown Efficacy C5-1103 Target:
5'-CTCTCCCTACAAACTGAATTTGGTTGC-3' (SEQ ID NO: 8672)

5'-UCUCCCUACAAACUGAAUUUGGUUGCU-3' (SEQ ID NO: 13293)

3'-AGAGGGAUGUUUGACUUAAACCAACGA-5' (SEQ ID NO: 6363)

C5-1104 Target:
5'-TCTCCCTACAAACTGAATTTGGTTGCT-3' (SEQ ID NO: 8673)

5'-UCCCUACAAACUGAAUUUGGUUGCUAC-3' (SEQ ID NO: 13294)

3'-AGGGAUGUUUGACUUAAACCAACGAUG-5' (SEQ ID NO: 6364)

C5-1106 Target:
5'-TCCCTACAAACTGAATTTGGTTGCTAC-3' (SEQ ID NO: 8674)

5'-CCCUACAAACUGAAUUUGGUUGCUACU-3' (SEQ ID NO: 13295)

3'-GGGAUGUUUGACUUAAACCAACGAUGA-5' (SEQ ID NO: 6365)

C5-1107 Target:
5'-CCCTACAAACTGAATTTGGTTGCTACT-3' (SEQ ID NO: 8675)

5'-CCUACAAACUGAAUUUGGUUGCUACUC-3' (SEQ ID NO: 13296)

3'-GGAUGUUUGACUUAAACCAACGAUGAG-5' (SEQ ID NO: 6366)

C5-1108 Target:
5'-CCTACAAACTGAATTTGGTTGCTACTC-3' (SEQ ID NO: 8676)

5'-ACAAACUGAAUUUGGUUGCUACUCCUC-3' (SEQ ID NO: 13297)

3'-UGUUUGACUUAAACCAACGAUGAGGAG-5' (SEQ ID NO: 6367)

C5-1111 Target:
5'-ACAAACTGAATTTGGTTGCTACTCCTC-3' (SEQ ID NO: 8677)

5'-CAAACUGAAUUUGGUUGCUACUCCUCU-3' (SEQ ID NO: 13298)

3'-GUUUGACUUAAACCAACGAUGAGGAGA-5' (SEQ ID NO: 6368)

C5-1112 Target:
5'-CAAACTGAATTTGGTTGCTACTCCTCT-3' (SEQ ID NO: 8678)

5'-AAACUGAAUUUGGUUGCUACUCCUCUU-3' (SEQ ID NO: 13299)

3'-UUUGACUUAAACCAACGAUGAGGAGAA-5' (SEQ ID NO: 6369)

C5-1113 Target:
5'-AAACTGAATTTGGTTGCTACTCCTCTT-3' (SEQ ID NO: 8679)

5'-AACUGAAUUUGGUUGCUACUCCUCUUU-3' (SEQ ID NO: 13300)

3'-UUGACUUAAACCAACGAUGAGGAGAAA-5' (SEQ ID NO: 6370)

C5-1114 Target:
5'-AACTGAATTTGGTTGCTACTCCTCTTT-3' (SEQ ID NO: 8680)

5'-ACUGAAUUUGGUUGCUACUCCUCUUUU-3' (SEQ ID NO: 13301)

3'-UGACUUAAACCAACGAUGAGGAGAAAA-5' (SEQ ID NO: 6371)

C5-1115 Target:
5'-ACTGAATTTGGTTGCTACTCCTCTTTT-3' (SEQ ID NO: 8681)

5'-CUGAAUUUGGUUGCUACUCCUCUUUUC-3' (SEQ ID NO: 13302)

3'-GACUUAAACCAACGAUGAGGAGAAAAG-5' (SEQ ID NO: 6372)

C5-1116 Target:
5'-CTGAATTTGGTTGCTACTCCTCTTTTC-3' (SEQ ID NO: 8682)

5'-UGAAUUUGGUUGCUACUCCUCUUUUCC-3' (SEQ ID NO: 13303)

3'-ACUUAAACCAACGAUGAGGAGAAAAGG-5' (SEQ ID NO: 6373)

C5-1117 Target:
5'-TGAATTTGGTTGCTACTCCTCTTTTCC-3' (SEQ ID NO: 8683)

5'-GAAUUUGGUUGCUACUCCUCUUUUCCU-3' (SEQ ID NO: 13304)

3'-CUUAAACCAACGAUGAGGAGAAAAGGA-5' (SEQ ID NO: 6374)

C5-1118 Target:
5'-GAATTTGGTTGCTACTCCTCTTTTCCT-3' (SEQ ID NO: 8684)

5'-AAUUUGGUUGCUACUCCUCUUUUCCUG-3' (SEQ ID NO: 13305)

3'-UUAAACCAACGAUGAGGAGAAAAGGAC-5' (SEQ ID NO: 6375)

C5-1119 Target:
5'-AATTTGGTTGCTACTCCTCTTTTCCTG-3' (SEQ ID NO: 8685)

5'-AUUUGGUUGCUACUCCUCUUUUCCUGA-3' (SEQ ID NO: 13306)

3'-UAAACCAACGAUGAGGAGAAAAGGACU-5' (SEQ ID NO: 6376)

C5-1120 Target:
5'-ATTTGGTTGCTACTCCTCTTTTCCTGA-3' (SEQ ID NO: 8686)

5'-UUUGGUUGCUACUCCUCUUUUCCUGAA-3' (SEQ ID NO: 13307)

3'-AAACCAACGAUGAGGAGAAAAGGACUU-5' (SEQ ID NO: 6377)

C5-1121 Target:
5'-TTTGGTTGCTACTCCTCTTTTCCTGAA-3' (SEQ ID NO: 8687)

5'-UUGGUUGCUACUCCUCUUUUCCUGAAG-3' (SEQ ID NO: 13308)

3'-AACCAACGAUGAGGAGAAAAGGACUUC-5' (SEQ ID NO: 6378)

C5-1122 Target:
5'-TTGGTTGCTACTCCTCTTTTCCTGAAG-3' (SEQ ID NO: 8688)

5'-UGGUUGCUACUCCUCUUUUCCUGAAGC-3' (SEQ ID NO: 13309)

3'-ACCAACGAUGAGGAGAAAAGGACUUCG-5' (SEQ ID NO: 6379)

C5-1123 Target:
5'-TGGTTGCTACTCCTCTTTTCCTGAAGC-3' (SEQ ID NO: 8689)

5'-GGUUGCUACUCCUCUUUUCCUGAAGCC-3' (SEQ ID NO: 13310)

3'-CCAACGAUGAGGAGAAAAGGACUUCGG-5' (SEQ ID NO: 6380)

C5-1124 Target:
5'-GGTTGCTACTCCTCTTTTCCTGAAGCC-3' (SEQ ID NO: 8690)

5'-GUUGCUACUCCUCUUUUCCUGAAGCCU-3' (SEQ ID NO: 13311)

3'-CAACGAUGAGGAGAAAAGGACUUCGGA-5' (SEQ ID NO: 6381)

C5-1125 Target:
5'-GTTGCTACTCCTCTTTTCCTGAAGCCT-3' (SEQ ID NO: 8691)

5'-UUGCUACUCCUCUUUUCCUGAAGCCUG-3' (SEQ ID NO: 13312)

3'-AACGAUGAGGAGAAAAGGACUUCGGAC-5' (SEQ ID NO: 6382)

TABLE 9-continued

"Blunt/Blunt" DsiRNAs Corresponding to Human Anti-C5 DsiRNAs Predicted to have >50% Knockdown Efficacy C5-1126 Target:
5'-TTGCTACTCCTCTTTTCCTGAAGCCTG-3' (SEQ ID NO: 8692)

5'-UGCUACUCCUCUUUUCCUGAAGCCUGG-3' (SEQ ID NO: 13313)

3'-ACGAUGAGGAGAAAAGGACUUCGGACC-5' (SEQ ID NO: 6383)

C5-1127 Target:
5'-TGCTACTCCTCTTTTCCTGAAGCCTGG-3' (SEQ ID NO: 8693)

5'-GCUACUCCUCUUUUCCUGAAGCCUGGG-3' (SEQ ID NO: 13314)

3'-CGAUGAGGAGAAAAGGACUUCGGACCC-5' (SEQ ID NO: 6384)

C5-1128 Target:
5'-GCTACTCCTCTTTTCCTGAAGCCTGGG-3' (SEQ ID NO: 8694)

5'-CUACUCCUCUUUUCCUGAAGCCUGGGA-3' (SEQ ID NO: 13315)

3'-GAUGAGGAGAAAAGGACUUCGGACCCU-5' (SEQ ID NO: 6385)

C5-1129 Target:
5'-CTACTCCTCTTTTCCTGAAGCCTGGGA-3' (SEQ ID NO: 8695)

5'-UACUCCUCUUUUCCUGAAGCCUGGGAU-3' (SEQ ID NO: 13316)

3'-AUGAGGAGAAAAGGACUUCGGACCCUA-5' (SEQ ID NO: 6386)

C5-1130 Target:
5'-TACTCCTCTTTTCCTGAAGCCTGGGAT-3' (SEQ ID NO: 8696)

5'-ACUCCUCUUUUCCUGAAGCCUGGGAUU-3' (SEQ ID NO: 13317)

3'-UGAGGAGAAAAGGACUUCGGACCCUAA-5' (SEQ ID NO: 6387)

C5-1131 Target:
5'-ACTCCTCTTTTCCTGAAGCCTGGGATT-3' (SEQ ID NO: 8697)

5'-CUCCUCUUUUCCUGAAGCCUGGGAUUC-3' (SEQ ID NO: 13318)

3'-GAGGAGAAAAGGACUUCGGACCCUAAG-5' (SEQ ID NO: 6388)

C5-1132 Target:
5'-CTCCTCTTTTCCTGAAGCCTGGGATTC-3' (SEQ ID NO: 8698)

5'-UCCUCUUUUCCUGAAGCCUGGGAUUCC-3' (SEQ ID NO: 13319)

3'-AGGAGAAAAGGACUUCGGACCCUAAGG-5' (SEQ ID NO: 6389)

C5-1133 Target:
5'-TCCTCTTTTCCTGAAGCCTGGGATTCC-3' (SEQ ID NO: 8699)

5'-CCUCUUUUCCUGAAGCCUGGGAUUCCA-3' (SEQ ID NO: 13320)

3'-GGAGAAAAGGACUUCGGACCCUAAGGU-5' (SEQ ID NO: 6390)

C5-1134 Target:
5'-CCTCTTTTCCTGAAGCCTGGGATTCCA-3' (SEQ ID NO: 8700)

5'-CUCUUUUCCUGAAGCCUGGGAUUCCAU-3' (SEQ ID NO: 13321)

3'-GAGAAAAGGACUUCGGACCCUAAGGUA-5' (SEQ ID NO: 6391)

C5-1135 Target:
5'-CTCTTTTCCTGAAGCCTGGGATTCCAT-3' (SEQ ID NO: 8701)

5'-UCUUUUCCUGAAGCCUGGGAUUCCAUA-3' (SEQ ID NO: 13322)

3'-AGAAAAGGACUUCGGACCCUAAGGUAU-5' (SEQ ID NO: 6392)

C5-1136 Target:
5'-TCTTTTCCTGAAGCCTGGGATTCCATA-3' (SEQ ID NO: 8702)

5'-CUUUUCCUGAAGCCUGGGAUUCCAUAU-3' (SEQ ID NO: 13323)

3'-GAAAAGGACUUCGGACCCUAAGGUAUA-5' (SEQ ID NO: 6393)

C5-1137 Target:
5'-CTTTTCCTGAAGCCTGGGATTCCATAT-3' (SEQ ID NO: 8703)

5'-UUUUCCUGAAGCCUGGGAUUCCAUAUC-3' (SEQ ID NO: 13324)

3'-AAAAGGACUUCGGACCCUAAGGUAUAG-5' (SEQ ID NO: 6394)

C5-1138 Target:
5'-TTTTCCTGAAGCCTGGGATTCCATATC-3' (SEQ ID NO: 8704)

5'-UUUCCUGAAGCCUGGGAUUCCAUAUCC-3' (SEQ ID NO: 13325)

3'-AAAGGACUUCGGACCCUAAGGUAUAGG-5' (SEQ ID NO: 6395)

C5-1139 Target:
5'-TTTCCTGAAGCCTGGGATTCCATATCC-3' (SEQ ID NO: 8705)

5'-UUCCUGAAGCCUGGGAUUCCAUAUCCC-3' (SEQ ID NO: 13326)

3'-AAGGACUUCGGACCCUAAGGUAUAGGG-5' (SEQ ID NO: 6396)

C5-1140 Target:
5'-TTCCTGAAGCCTGGGATTCCATATCCC-3' (SEQ ID NO: 8706)

5'-UCCUGAAGCCUGGGAUUCCAUAUCCCA-3' (SEQ ID NO: 13327)

3'-AGGACUUCGGACCCUAAGGUAUAGGGU-5' (SEQ ID NO: 6397)

C5-1141 Target:
5'-TCCTGAAGCCTGGGATTCCATATCCCA-3' (SEQ ID NO: 8707)

5'-CCUGAAGCCUGGGAUUCCAUAUCCCAU-3' (SEQ ID NO: 13328)

3'-GGACUUCGGACCCUAAGGUAUAGGGUA-5' (SEQ ID NO: 6398)

C5-1142 Target:
5'-CCTGAAGCCTGGGATTCCATATCCCAT-3' (SEQ ID NO: 8708)

5'-CUGAAGCCUGGGAUUCCAUAUCCCAUC-3' (SEQ ID NO: 13329)

3'-GACUUCGGACCCUAAGGUAUAGGGUAG-5' (SEQ ID NO: 6399)

C5-1143 Target:
5'-CTGAAGCCTGGGATTCCATATCCCATC-3' (SEQ ID NO: 8709)

5'-UCCCAUCAAGGUGCAGGUUAAAGAUUC-3' (SEQ ID NO: 13330)

3'-AGGGUAGUUCCACGUCCAAUUUCUAAG-5' (SEQ ID NO: 6400)

C5-1163 Target:
5'-TCCCATCAAGGTGCAGGTTAAAGATTC-3' (SEQ ID NO: 8710)

5'-CCCAUCAAGGUGCAGGUUAAAGAUUCG-3' (SEQ ID NO: 13331)

3'-GGGUAGUUCCACGUCCAAUUUCUAAGC-5' (SEQ ID NO: 6401)

C5-1164 Target:
5'-CCCATCAAGGTGCAGGTTAAAGATTCG-3' (SEQ ID NO: 8711)

5'-CCAUCAAGGUGCAGGUUAAAGAUUCGC-3' (SEQ ID NO: 13332)

3'-GGUAGUUCCACGUCCAAUUUCUAAGCG-5' (SEQ ID NO: 6402)

TABLE 9-continued

"Blunt/Blunt" DsiRNAs Corresponding to Human Anti-C5 DsiRNAs Predicted to have >50% Knockdown Efficacy C5-1165 Target:
5'-CCATCAAGGTGCAGGTTAAAGATTCGC-3' (SEQ ID NO: 8712)

5'-CAUCAAGGUGCAGGUUAAAGAUUCGCU-3' (SEQ ID NO: 13333)

3'-GUAGUUCCACGUCCAAUUUCUAAGCGA-5' (SEQ ID NO: 6403)

C5-1166 Target:
5'-CATCAAGGTGCAGGTTAAAGATTCGCT-3' (SEQ ID NO: 8713)

5'-AUCAAGGUGCAGGUUAAAGAUUCGCUU-3' (SEQ ID NO: 13334)

3'-UAGUUCCACGUCCAAUUUCUAAGCGAA-5' (SEQ ID NO: 6404)

C5-1167 Target:
5'-ATCAAGGTGCAGGTTAAAGATTCGCTT-3' (SEQ ID NO: 8714)

5'-UUCGCUUGACCAGUUGGUAGGAGGAGU-3' (SEQ ID NO: 13335)

3'-AAGCGAACUGGUCAACCAUCCUCCUCA-5' (SEQ ID NO: 6405)

C5-1187 Target:
5'-TTCGCTTGACCAGTTGGTAGGAGGAGT-3' (SEQ ID NO: 8715)

5'-UCGCUUGACCAGUUGGUAGGAGGAGUC-3' (SEQ ID NO: 13336)

3'-AGCGAACUGGUCAACCAUCCUCCUCAG-5' (SEQ ID NO: 6406)

C5-1188 Target:
5'-TCGCTTGACCAGTTGGTAGGAGGAGTC-3' (SEQ ID NO: 8716)

5'-CGCUUGACCAGUUGGUAGGAGGAGUCC-3' (SEQ ID NO: 13337)

3'-GCGAACUGGUCAACCAUCCUCCUCAGG-5' (SEQ ID NO: 6407)

C5-1189 Target:
5'-CGCTTGACCAGTTGGTAGGAGGAGTCC-3' (SEQ ID NO: 8717)

5'-GCUUGACCAGUUGGUAGGAGGAGUCCC-3' (SEQ ID NO: 13338)

3'-CGAACUGGUCAACCAUCCUCCUCAGGG-5' (SEQ ID NO: 6408)

C5-1190 Target:
5'-GCTTGACCAGTTGGTAGGAGGAGTCCC-3' (SEQ ID NO: 8718)

5'-GAGUCCCAGUAACACUGAAUGCACAAA-3' (SEQ ID NO: 13339)

3'-CUCAGGGUCAUUGUGACUUACGUGUUU-5' (SEQ ID NO: 6409)

C5-1210 Target:
5'-GAGTCCCAGTAACACTGAATGCACAAA-3' (SEQ ID NO: 8719)

5'-AGUCCCAGUAACACUGAAUGCACAAAC-3' (SEQ ID NO: 13340)

3'-UCAGGGUCAUUGUGACUUACGUGUUUG-5' (SEQ ID NO: 6410)

C5-1211 Target:
5'-AGTCCCAGTAACACTGAATGCACAAAC-3' (SEQ ID NO: 8720)

5'-GUCCCAGUAACACUGAAUGCACAAACA-3' (SEQ ID NO: 13341)

3'-CAGGGUCAUUGUGACUUACGUGUUUGU-5' (SEQ ID NO: 6411)

C5-1212 Target:
5'-GTCCCAGTAACACTGAATGCACAAACA-3' (SEQ ID NO: 8721)

5'-UCCCAGUAACACUGAAUGCACAAACAA-3' (SEQ ID NO: 13342)

3'-AGGGUCAUUGUGACUUACGUGUUUGUU-5' (SEQ ID NO: 6412)

C5-1213 Target:
5'-TCCCAGTAACACTGAATGCACAAACAA-3' (SEQ ID NO: 8722)

5'-CCCAGUAACACUGAAUGCACAAACAAU-3' (SEQ ID NO: 13343)

3'-GGGUCAUUGUGACUUACGUGUUUGUUA-5' (SEQ ID NO: 6413)

C5-1214 Target:
5'-CCCAGTAACACTGAATGCACAAACAAT-3' (SEQ ID NO: 8723)

5'-CCAGUAACACUGAAUGCACAAACAAUU-3' (SEQ ID NO: 13344)

3'-GGUCAUUGUGACUUACGUGUUUGUUAA-5' (SEQ ID NO: 6414)

C5-1215 Target:
5'-CCAGTAACACTGAATGCACAAACAATT-3' (SEQ ID NO: 8724)

5'-CAGUAACACUGAAUGCACAAACAAUUG-3' (SEQ ID NO: 13345)

3'-GUCAUUGUGACUUACGUGUUUGUUAAC-5' (SEQ ID NO: 6415)

C5-1216 Target:
5'-CAGTAACACTGAATGCACAAACAATTG-3' (SEQ ID NO: 8725)

5'-AGUAACACUGAAUGCACAAACAAUUGA-3' (SEQ ID NO: 13346)

3'-UCAUUGUGACUUACGUGUUUGUUAACU-5' (SEQ ID NO: 6416)

C5-1217 Target:
5'-AGTAACACTGAATGCACAAACAATTGA-3' (SEQ ID NO: 8726)

5'-GUAACACUGAAUGCACAAACAAUUGAU-3' (SEQ ID NO: 13347)

3'-CAUUGUGACUUACGUGUUUGUUAACUA-5' (SEQ ID NO: 6417)

C5-1218 Target:
5'-GTAACACTGAATGCACAAACAATTGAT-3' (SEQ ID NO: 8727)

5'-UAACACUGAAUGCACAAACAAUUGAUG-3' (SEQ ID NO: 13348)

3'-AUUGUGACUUACGUGUUUGUUAACUAC-5' (SEQ ID NO: 6418)

C5-1219 Target:
5'-TAACACTGAATGCACAAACAATTGATG-3' (SEQ ID NO: 8728)

5'-AACACUGAAUGCACAAACAAUUGAUGU-3' (SEQ ID NO: 13349)

3'-UUGUGACUUACGUGUUUGUUAACUACA-5' (SEQ ID NO: 6419)

C5-1220 Target:
5'-AACACTGAATGCACAAACAATTGATGT-3' (SEQ ID NO: 8729)

5'-ACACUGAAUGCACAAACAAUUGAUGUA-3' (SEQ ID NO: 13350)

3'-UGUGACUUACGUGUUUGUUAACUACAU-5' (SEQ ID NO: 6420)

C5-1221 Target:
5'-ACACTGAATGCACAAACAATTGATGTA-3' (SEQ ID NO: 8730)

5'-CUGAAUGCACAAACAAUUGAUGUAAAC-3' (SEQ ID NO: 13351)

3'-GACUUACGUGUUUGUUAACUACAUUUG-5' (SEQ ID NO: 6421)

C5-1224 Target:
5'-CTGAATGCACAAACAATTGATGTAAAC-3' (SEQ ID NO: 8731)

5'-UGAAUGCACAAACAAUUGAUGUAAACC-3' (SEQ ID NO: 13352)

3'-ACUUACGUGUUUGUUAACUACAUUUGG-5' (SEQ ID NO: 6422)

TABLE 9-continued

"Blunt/Blunt" DsiRNAs Corresponding to Human Anti-C5 DsiRNAs Predicted to have >50% Knockdown Efficacy C5-1225 Target:
5'-TGAATGCACAAACAATTGATGTAAACC-3' (SEQ ID NO: 8732)

5'-GAAUGCACAAACAAUUGAUGUAAACCA-3' (SEQ ID NO: 13353)

3'-CUUACGUGUUUGUUAACUACAUUUGGU-5' (SEQ ID NO: 6423)

C5-1226 Target:
5'-GAATGCACAAACAATTGATGTAAACCA-3' (SEQ ID NO: 8733)

5'-UAAACCAAGAGACAUCUGACUUGGAUC-3' (SEQ ID NO: 13354)

3'-AUUUGGUUCUCUGUAGACUGAACCUAG-5' (SEQ ID NO: 6424)

C5-1246 Target:
5'-TAAACCAAGAGACATCTGACTTGGATC-3' (SEQ ID NO: 8734)

5'-AAACCAAGAGACAUCUGACUUGGAUCC-3' (SEQ ID NO: 13355)

3'-UUUGGUUCUCUGUAGACUGAACCUAGG-5' (SEQ ID NO: 6425)

C5-1247 Target:
5'-AAACCAAGAGACATCTGACTTGGATCC-3' (SEQ ID NO: 8735)

5'-AACCAAGAGACAUCUGACUUGGAUCCA-3' (SEQ ID NO: 13356)

3'-UUGGUUCUCUGUAGACUGAACCUAGGU-5' (SEQ ID NO: 6426)

C5-1248 Target:
5'-AACCAAGAGACATCTGACTTGGATCCA-3' (SEQ ID NO: 8736)

5'-GCAAAAGUGUAACACGUGUUGAUGAUG-3' (SEQ ID NO: 13357)

3'-CGUUUUCACAUUGUGCACAACUACUAC-5' (SEQ ID NO: 6427)

C5-1276 Target:
5'-GCAAAAGTGTAACACGTGTTGATGATG-3' (SEQ ID NO: 8737)

5'-CAAAAGUGUAACACGUGUUGAUGAUGG-3' (SEQ ID NO: 13358)

3'-GUUUUCACAUUGUGCACAACUACUACC-5' (SEQ ID NO: 6428)

C5-1277 Target:
5'-CAAAAGTGTAACACGTGTTGATGATGG-3' (SEQ ID NO: 8738)

5'-AAAAGUGUAACACGUGUUGAUGAUGGA-3' (SEQ ID NO: 13359)

3'-UUUUCACAUUGUGCACAACUACUACCU-5' (SEQ ID NO: 6429)

C5-1278 Target:
5'-AAAAGTGTAACACGTGTTGATGATGGA-3' (SEQ ID NO: 8739)

5'-AAAGUGUAACACGUGUUGAUGAUGGAG-3' (SEQ ID NO: 13360)

3'-UUUCACAUUGUGCACAACUACUACCUC-5' (SEQ ID NO: 6430)

C5-1279 Target:
5'-AAAGTGTAACACGTGTTGATGATGGAG-3' (SEQ ID NO: 8740)

5'-AAGUGUAACACGUGUUGAUGAUGGAGU-3' (SEQ ID NO: 13361)

3'-UUCACAUUGUGCACAACUACUACCUCA-5' (SEQ ID NO: 6431)

C5-1280 Target:
5'-AAGTGTAACACGTGTTGATGATGGAGT-3' (SEQ ID NO: 8741)

5'-AGUGUAACACGUGUUGAUGAUGGAGUA-3' (SEQ ID NO: 13362)

3'-UCACAUUGUGCACAACUACUACCUCAU-5' (SEQ ID NO: 6432)

C5-1281 Target:
5'-AGTGTAACACGTGTTGATGATGGAGTA-3' (SEQ ID NO: 8742)

5'-GUGUAACACGUGUUGAUGAUGGAGUAG-3' (SEQ ID NO: 13363)

3'-CACAUUGUGCACAACUACUACCUCAUC-5' (SEQ ID NO: 6433)

C5-1282 Target:
5'-GTGTAACACGTGTTGATGATGGAGTAG-3' (SEQ ID NO: 8743)

5'-UGUAACACGUGUUGAUGAUGGAGUAGC-3' (SEQ ID NO: 13364)

3'-ACAUUGUGCACAACUACUACCUCAUCG-5' (SEQ ID NO: 6434)

C5-1283 Target:
5'-TGTAACACGTGTTGATGATGGAGTAGC-3' (SEQ ID NO: 8744)

5'-GUAACACGUGUUGAUGAUGGAGUAGCU-3' (SEQ ID NO: 13365)

3'-CAUUGUGCACAACUACUACCUCAUCGA-5' (SEQ ID NO: 6435)

C5-1284 Target:
5'-GTAACACGTGTTGATGATGGAGTAGCT-3' (SEQ ID NO: 8745)

5'-UAACACGUGUUGAUGAUGGAGUAGCUU-3' (SEQ ID NO: 13366)

3'-AUUGUGCACAACUACUACCUCAUCGAA-5' (SEQ ID NO: 6436)

C5-1285 Target:
5'-TAACACGTGTTGATGATGGAGTAGCTT-3' (SEQ ID NO: 8746)

5'-AACACGUGUUGAUGAUGGAGUAGCUUC-3' (SEQ ID NO: 13367)

3'-UUGUGCACAACUACUACCUCAUCGAAG-5' (SEQ ID NO: 6437)

C5-1286 Target:
5'-AACACGTGTTGATGATGGAGTAGCTTC-3' (SEQ ID NO: 8747)

5'-ACACGUGUUGAUGAUGGAGUAGCUUCC-3' (SEQ ID NO: 13368)

3'-UGUGCACAACUACUACCUCAUCGAAGG-5' (SEQ ID NO: 6438)

C5-1287 Target:
5'-ACACGTGTTGATGATGGAGTAGCTTCC-3' (SEQ ID NO: 8748)

5'-CACGUGUUGAUGAUGGAGUAGCUUCCU-3' (SEQ ID NO: 13369)

3'-GUGCACAACUACUACCUCAUCGAAGGA-5' (SEQ ID NO: 6439)

C5-1288 Target:
5'-CACGTGTTGATGATGGAGTAGCTTCCT-3' (SEQ ID NO: 8749)

5'-ACGUGUUGAUGAUGGAGUAGCUUCCUU-3' (SEQ ID NO: 13370)

3'-UGCACAACUACUACCUCAUCGAAGGAA-5' (SEQ ID NO: 6440)

C5-1289 Target:
5'-ACGTGTTGATGATGGAGTAGCTTCCTT-3' (SEQ ID NO: 8750)

5'-CGUGUUGAUGAUGGAGUAGCUUCCUUU-3' (SEQ ID NO: 13371)

3'-GCACAACUACUACCUCAUCGAAGGAAA-5' (SEQ ID NO: 6441)

C5-1290 Target:
5'-CGTGTTGATGATGGAGTAGCTTCCTTT-3' (SEQ ID NO: 8751)

5'-GUGUUGAUGAUGGAGUAGCUUCCUUUG-3' (SEQ ID NO: 13372)

3'-CACAACUACUACCUCAUCGAAGGAAAC-5' (SEQ ID NO: 6442)

TABLE 9-continued

"Blunt/Blunt" DsiRNAs Corresponding to Human Anti-C5 DsiRNAs Predicted to have >50% Knockdown Efficacy C5-1291 Target:
5'-GTGTTGATGATGGAGTAGCTTCCTTTG-3' (SEQ ID NO: 8752)

5'-UGUUGAUGAUGGAGUAGCUUCCUUUGU-3' (SEQ ID NO: 13373)

3'-ACAACUACUACCUCAUCGAAGGAAACA-5' (SEQ ID NO: 6443)

C5-1292 Target:
5'-TGTTGATGATGGAGTAGCTTCCTTTGT-3' (SEQ ID NO: 8753)

5'-GCUUAAUCUCCCAUCUGGAGUGACGGU-3' (SEQ ID NO: 13374)

3'-CGAAUUAGAGGGUAGACCUCACUGCCA-5' (SEQ ID NO: 6444)

C5-1319 Target:
5'-GCTTAATCTCCCATCTGGAGTGACGGT-3' (SEQ ID NO: 8754)

5'-CUUAAUCUCCCAUCUGGAGUGACGGUG-3' (SEQ ID NO: 13375)

3'-GAAUUAGAGGGUAGACCUCACUGCCAC-5' (SEQ ID NO: 6445)

C5-1320 Target:
5'-CTTAATCTCCCATCTGGAGTGACGGTG-3' (SEQ ID NO: 8755)

5'-UUAAUCUCCCAUCUGGAGUGACGGUGC-3' (SEQ ID NO: 13376)

3'-AAUUAGAGGGUAGACCUCACUGCCACG-5' (SEQ ID NO: 6446)

C5-1321 Target:
5'-TTAATCTCCCATCTGGAGTGACGGTGC-3' (SEQ ID NO: 8756)

5'-UAAUCUCCCAUCUGGAGUGACGGUGCU-3' (SEQ ID NO: 13377)

3'-AUUAGAGGGUAGACCUCACUGCCACGA-5' (SEQ ID NO: 6447)

C5-1322 Target:
5'-TAATCTCCCATCTGGAGTGACGGTGCT-3' (SEQ ID NO: 8757)

5'-AAUCUCCCAUCUGGAGUGACGGUGCUG-3' (SEQ ID NO: 13378)

3'-UUAGAGGGUAGACCUCACUGCCACGAC-5' (SEQ ID NO: 6448)

C5-1323 Target:
5'-AATCTCCCATCTGGAGTGACGGTGCTG-3' (SEQ ID NO: 8758)

5'-UCUCCCAUCUGGAGUGACGGUGCUGGA-3' (SEQ ID NO: 13379)

3'-AGAGGGUAGACCUCACUGCCACGACCU-5' (SEQ ID NO: 6449)

C5-1325 Target:
5'-TCTCCCATCTGGAGTGACGGTGCTGGA-3' (SEQ ID NO: 8759)

5'-UCCCAUCUGGAGUGACGGUGCUGGAGU-3' (SEQ ID NO: 13380)

3'-AGGGUAGACCUCACUGCCACGACCUCA-5' (SEQ ID NO: 6450)

C5-1327 Target:
5'-TCCCATCTGGAGTGACGGTGCTGGAGT-3' (SEQ ID NO: 8760)

5'-CCCAUCUGGAGUGACGGUGCUGGAGUU-3' (SEQ ID NO: 13381)

3'-GGGUAGACCUCACUGCCACGACCUCAA-5' (SEQ ID NO: 6451)

C5-1328 Target:
5'-CCCATCTGGAGTGACGGTGCTGGAGTT-3' (SEQ ID NO: 8761)

5'-CCAUCUGGAGUGACGGUGCUGGAGUUU-3' (SEQ ID NO: 13382)

3'-GGUAGACCUCACUGCCACGACCUCAAA-5' (SEQ ID NO: 6452)

C5-1329 Target:
5'-CCATCTGGAGTGACGGTGCTGGAGTTT-3' (SEQ ID NO: 8762)

5'-CAUCUGGAGUGACGGUGCUGGAGUUUA-3' (SEQ ID NO: 13383)

3'-GUAGACCUCACUGCCACGACCUCAAAU-5' (SEQ ID NO: 6453)

C5-1330 Target:
5'-CATCTGGAGTGACGGTGCTGGAGTTTA-3' (SEQ ID NO: 8763)

5'-AUCUGGAGUGACGGUGCUGGAGUUUAA-3' (SEQ ID NO: 13384)

3'-UAGACCUCACUGCCACGACCUCAAAUU-5' (SEQ ID NO: 6454)

C5-1331 Target:
5'-ATCTGGAGTGACGGTGCTGGAGTTTAA-3' (SEQ ID NO: 8764)

5'-UCUGGAGUGACGGUGCUGGAGUUUAAU-3' (SEQ ID NO: 13385)

3'-AGACCUCACUGCCACGACCUCAAAUUA-5' (SEQ ID NO: 6455)

C5-1332 Target:
5'-TCTGGAGTGACGGTGCTGGAGTTTAAT-3' (SEQ ID NO: 8765)

5'-CUGGAGUGACGGUGCUGGAGUUUAAUG-3' (SEQ ID NO: 13386)

3'-GACCUCACUGCCACGACCUCAAAUUAC-5' (SEQ ID NO: 6456)

C5-1333 Target:
5'-CTGGAGTGACGGTGCTGGAGTTTAATG-3' (SEQ ID NO: 8766)

5'-UGGAGUGACGGUGCUGGAGUUUAAUGU-3' (SEQ ID NO: 13387)

3'-ACCUCACUGCCACGACCUCAAAUUACA-5' (SEQ ID NO: 6457)

C5-1334 Target:
5'-TGGAGTGACGGTGCTGGAGTTTAATGT-3' (SEQ ID NO: 8767)

5'-GGAGUGACGGUGCUGGAGUUUAAUGUC-3' (SEQ ID NO: 13388)

3'-CCUCACUGCCACGACCUCAAAUUACAG-5' (SEQ ID NO: 6458)

C5-1335 Target:
5'-GGAGTGACGGTGCTGGAGTTTAATGTC-3' (SEQ ID NO: 8768)

5'-GAGUGACGGUGCUGGAGUUUAAUGUCA-3' (SEQ ID NO: 13389)

3'-CUCACUGCCACGACCUCAAAUUACAGU-5' (SEQ ID NO: 6459)

C5-1336 Target:
5'-GAGTGACGGTGCTGGAGTTTAATGTCA-3' (SEQ ID NO: 8769)

5'-AGUGACGGUGCUGGAGUUUAAUGUCAA-3' (SEQ ID NO: 13390)

3'-UCACUGCCACGACCUCAAAUUACAGUU-5' (SEQ ID NO: 6460)

C5-1337 Target:
5'-AGTGACGGTGCTGGAGTTTAATGTCAA-3' (SEQ ID NO: 8770)

5'-GUGACGGUGCUGGAGUUUAAUGUCAAA-3' (SEQ ID NO: 13391)

3'-CACUGCCACGACCUCAAAUUACAGUUU-5' (SEQ ID NO: 6461)

C5-1338 Target:
5'-GTGACGGTGCTGGAGTTTAATGTCAAA-3' (SEQ ID NO: 8771)

5'-UGACGGUGCUGGAGUUUAAUGUCAAAA-3' (SEQ ID NO: 13392)

3'-ACUGCCACGACCUCAAAUUACAGUUUU-5' (SEQ ID NO: 6462)

TABLE 9-continued

"Blunt/Blunt" DsiRNAs Corresponding to Human Anti-C5
DsiRNAs Predicted to have >50% Knockdown Efficacy C5-1339 Target:
5'-TGACGGTGCTGGAGTTTAATGTCAAAA-3' (SEQ ID NO: 8772)

5'-GACGGUGCUGGAGUUUAAUGUCAAAAC-3' (SEQ ID NO: 13393)

3'-CUGCCACGACCUCAAAUUACAGUUUUG-5' (SEQ ID NO: 6463)

C5-1340 Target:
5'-GACGGTGCTGGAGTTTAATGTCAAAAC-3' (SEQ ID NO: 8773)

5'-ACGGUGCUGGAGUUUAAUGUCAAAACU-3' (SEQ ID NO: 13394)

3'-UGCCACGACCUCAAAUUACAGUUUUGA-5' (SEQ ID NO: 6464)

C5-1341 Target:
5'-ACGGTGCTGGAGTTTAATGTCAAAACT-3' (SEQ ID NO: 8774)

5'-CGGUGCUGGAGUUUAAUGUCAAAACUG-3' (SEQ ID NO: 13395)

3'-GCCACGACCUCAAAUUACAGUUUUGAC-5' (SEQ ID NO: 6465)

C5-1342 Target:
5'-CGGTGCTGGAGTTTAATGTCAAAACTG-3' (SEQ ID NO: 8775)

5'-GGUGCUGGAGUUUAAUGUCAAAACUGA-3' (SEQ ID NO: 13396)

3'-CCACGACCUCAAAUUACAGUUUUGACU-5' (SEQ ID NO: 6466)

C5-1343 Target:
5'-GGTGCTGGAGTTTAATGTCAAAACTGA-3' (SEQ ID NO: 8776)

5'-GUGCUGGAGUUUAAUGUCAAAACUGAU-3' (SEQ ID NO: 13397)

3'-CACGACCUCAAAUUACAGUUUUGACUA-5' (SEQ ID NO: 6467)

C5-1344 Target:
5'-GTGCTGGAGTTTAATGTCAAAACTGAT-3' (SEQ ID NO: 8777)

5'-UGCUGGAGUUUAAUGUCAAAACUGAUG-3' (SEQ ID NO: 13398)

3'-ACGACCUCAAAUUACAGUUUUGACUAC-5' (SEQ ID NO: 6468)

C5-1345 Target:
5'-TGCTGGAGTTTAATGTCAAAACTGATG-3' (SEQ ID NO: 8778)

5'-GCUGGAGUUUAAUGUCAAAACUGAUGC-3' (SEQ ID NO: 13399)

3'-CGACCUCAAAUUACAGUUUUGACUACG-5' (SEQ ID NO: 6469)

C5-1346 Target:
5'-GCTGGAGTTTAATGTCAAAACTGATGC-3' (SEQ ID NO: 8779)

5'-CUGGAGUUUAAUGUCAAAACUGAUGCU-3' (SEQ ID NO: 13400)

3'-GACCUCAAAUUACAGUUUUGACUACGA-5' (SEQ ID NO: 6470)

C5-1347 Target:
5'-CTGGAGTTTAATGTCAAAACTGATGCT-3' (SEQ ID NO: 8780)

5'-UGGAGUUUAAUGUCAAAACUGAUGCUC-3' (SEQ ID NO: 13401)

3'-ACCUCAAAUUACAGUUUUGACUACGAG-5' (SEQ ID NO: 6471)

C5-1348 Target:
5'-TGGAGTTTAATGTCAAAACTGATGCTC-3' (SEQ ID NO: 8781)

5'-GGAGUUUAAUGUCAAAACUGAUGCUCC-3' (SEQ ID NO: 13402)

3'-CCUCAAAUUACAGUUUUGACUACGAGG-5' (SEQ ID NO: 6472)

C5-1349 Target:
5'-GGAGTTTAATGTCAAAACTGATGCTCC-3' (SEQ ID NO: 8782)

5'-GAGUUUAAUGUCAAAACUGAUGCUCCA-3' (SEQ ID NO: 13403)

3'-CUCAAAUUACAGUUUUGACUACGAGGU-5' (SEQ ID NO: 6473)

C5-1350 Target:
5'-GAGTTTAATGTCAAAACTGATGCTCCA-3' (SEQ ID NO: 8783)

5'-AGUUUAAUGUCAAAACUGAUGCUCCAG-3' (SEQ ID NO: 13404)

3'-UCAAAUUACAGUUUUGACUACGAGGUC-5' (SEQ ID NO: 6474)

C5-1351 Target:
5'-AGTTTAATGTCAAAACTGATGCTCCAG-3' (SEQ ID NO: 8784)

5'-GUUUAAUGUCAAAACUGAUGCUCCAGA-3' (SEQ ID NO: 13405)

3'-CAAAUUACAGUUUUGACUACGAGGUCU-5' (SEQ ID NO: 6475)

C5-1352 Target:
5'-GTTTAATGTCAAAACTGATGCTCCAGA-3' (SEQ ID NO: 8785)

5'-UUUAAUGUCAAAACUGAUGCUCCAGAU-3' (SEQ ID NO: 13406)

3'-AAAUUACAGUUUUGACUACGAGGUCUA-5' (SEQ ID NO: 6476)

C5-1353 Target:
5'-TTTAATGTCAAAACTGATGCTCCAGAT-3' (SEQ ID NO: 8786)

5'-UUAAUGUCAAAACUGAUGCUCCAGAUC-3' (SEQ ID NO: 13407)

3'-AAUUACAGUUUUGACUACGAGGUCUAG-5' (SEQ ID NO: 6477)

C5-1354 Target:
5'-TTAATGTCAAAACTGATGCTCCAGATC-3' (SEQ ID NO: 8787)

5'-UAAUGUCAAAACUGAUGCUCCAGAUCU-3' (SEQ ID NO: 13408)

3'-AUUACAGUUUUGACUACGAGGUCUAGA-5' (SEQ ID NO: 6478)

C5-1355 Target:
5'-TAATGTCAAAACTGATGCTCCAGATCT-3' (SEQ ID NO: 8788)

5'-AAUGUCAAAACUGAUGCUCCAGAUCUU-3' (SEQ ID NO: 13409)

3'-UUACAGUUUUGACUACGAGGUCUAGAA-5' (SEQ ID NO: 6479)

C5-1356 Target:
5'-AATGTCAAAACTGATGCTCCAGATCTT-3' (SEQ ID NO: 8789)

5'-AUGUCAAAACUGAUGCUCCAGAUCUUC-3' (SEQ ID NO: 13410)

3'-UACAGUUUUGACUACGAGGUCUAGAAG-5' (SEQ ID NO: 6480)

C5-1357 Target:
5'-ATGTCAAAACTGATGCTCCAGATCTTC-3' (SEQ ID NO: 8790)

5'-UGUCAAAACUGAUGCUCCAGAUCUUCC-3' (SEQ ID NO: 13411)

3'-ACAGUUUUGACUACGAGGUCUAGAAGG-5' (SEQ ID NO: 6481)

C5-1358 Target:
5'-TGTCAAAACTGATGCTCCAGATCTTCC-3' (SEQ ID NO: 8791)

5'-GUCAAAACUGAUGCUCCAGAUCUUCCA-3' (SEQ ID NO: 13412)

3'-CAGUUUUGACUACGAGGUCUAGAAGGU-5' (SEQ ID NO: 6482)

TABLE 9-continued

"Blunt/Blunt" DsiRNAs Corresponding to Human Anti-C5 DsiRNAs Predicted to have >50% Knockdown Efficacy C5-1359 Target:
5'-GTCAAAACTGATGCTCCAGATCTTCCA-3' (SEQ ID NO: 8792)

5'-UCAAAACUGAUGCUCCAGAUCUUCCAG-3' (SEQ ID NO: 13413)

3'-AGUUUUGACUACGAGGUCUAGAAGGUC-5' (SEQ ID NO: 6483)

C5-1360 Target:
5'-TCAAAACTGATGCTCCAGATCTTCCAG-3' (SEQ ID NO: 8793)

5'-CAAAACUGAUGCUCCAGAUCUUCCAGA-3' (SEQ ID NO: 13414)

3'-GUUUUGACUACGAGGUCUAGAAGGUCU-5' (SEQ ID NO: 6484)

C5-1361 Target:
5'-CAAAACTGATGCTCCAGATCTTCCAGA-3' (SEQ ID NO: 8794)

5'-AAAACUGAUGCUCCAGAUCUUCCAGAA-3' (SEQ ID NO: 13415)

3'-UUUUGACUACGAGGUCUAGAAGGUCUU-5' (SEQ ID NO: 6485)

C5-1362 Target:
5'-AAAACTGATGCTCCAGATCTTCCAGAA-3' (SEQ ID NO: 8795)

5'-AAACUGAUGCUCCAGAUCUUCCAGAAG-3' (SEQ ID NO: 13416)

3'-UUUGACUACGAGGUCUAGAAGGUCUUC-5' (SEQ ID NO: 6486)

C5-1363 Target:
5'-AAACTGATGCTCCAGATCTTCCAGAAG-3' (SEQ ID NO: 8796)

5'-AACUGAUGCUCCAGAUCUUCCAGAAGA-3' (SEQ ID NO: 13417)

3'-UUGACUACGAGGUCUAGAAGGUCUUCU-5' (SEQ ID NO: 6487)

C5-1364 Target:
5'-AACTGATGCTCCAGATCTTCCAGAAGA-3' (SEQ ID NO: 8797)

5'-ACUGAUGCUCCAGAUCUUCCAGAAGAA-3' (SEQ ID NO: 13418)

3'-UGACUACGAGGUCUAGAAGGUCUUCUU-5' (SEQ ID NO: 6488)

C5-1365 Target:
5'-ACTGATGCTCCAGATCTTCCAGAAGAA-3' (SEQ ID NO: 8798)

5'-CUGAUGCUCCAGAUCUUCCAGAAGAAA-3' (SEQ ID NO: 13419)

3'-GACUACGAGGUCUAGAAGGUCUUCUUU-5' (SEQ ID NO: 6489)

C5-1366 Target:
5'-CTGATGCTCCAGATCTTCCAGAAGAAA-3' (SEQ ID NO: 8799)

5'-UGAUGCUCCAGAUCUUCCAGAAGAAAA-3' (SEQ ID NO: 13420)

3'-ACUACGAGGUCUAGAAGGUCUUCUUUU-5' (SEQ ID NO: 6490)

C5-1367 Target:
5'-TGATGCTCCAGATCTTCCAGAAGAAAA-3' (SEQ ID NO: 8800)

5'-AAGAAAAUCAGGCCAGGGAAGGUUACC-3' (SEQ ID NO: 13421)

3'-UUCUUUUAGUCCGGUCCCUUCCAAUGG-5' (SEQ ID NO: 6491)

C5-1387 Target:
5'-AAGAAAATCAGGCCAGGGAAGGTTACC-3' (SEQ ID NO: 8801)

5'-AGAAAAUCAGGCCAGGGAAGGUUACCG-3' (SEQ ID NO: 13422)

3'-UCUUUUAGUCCGGUCCCUUCCAAUGGC-5' (SEQ ID NO: 6492)

C5-1388 Target:
5'-AGAAAATCAGGCCAGGGAAGGTTACCG-3' (SEQ ID NO: 8802)

5'-GAAAAUCAGGCCAGGGAAGGUUACCGA-3' (SEQ ID NO: 13423)

3'-CUUUUAGUCCGGUCCCUUCCAAUGGCU-5' (SEQ ID NO: 6493)

C5-1389 Target:
5'-GAAAATCAGGCCAGGGAAGGTTACCGA-3' (SEQ ID NO: 8803)

5'-AAAAUCAGGCCAGGGAAGGUUACCGAG-3' (SEQ ID NO: 13424)

3'-UUUUAGUCCGGUCCCUUCCAAUGGCUC-5' (SEQ ID NO: 6494)

C5-1390 Target:
5'-AAAATCAGGCCAGGGAAGGTTACCGAG-3' (SEQ ID NO: 8804)

5'-AAAUCAGGCCAGGGAAGGUUACCGAGC-3' (SEQ ID NO: 13425)

3'-UUUAGUCCGGUCCCUUCCAAUGGCUCG-5' (SEQ ID NO: 6495)

C5-1391 Target:
5'-AAATCAGGCCAGGGAAGGTTACCGAGC-3' (SEQ ID NO: 8805)

5'-AAUCAGGCCAGGGAAGGUUACCGAGCA-3' (SEQ ID NO: 13426)

3'-UUAGUCCGGUCCCUUCCAAUGGCUCGU-5' (SEQ ID NO: 6496)

C5-1392 Target:
5'-AATCAGGCCAGGGAAGGTTACCGAGCA-3' (SEQ ID NO: 8806)

5'-AUCAGGCCAGGGAAGGUUACCGAGCAA-3' (SEQ ID NO: 13427)

3'-UAGUCCGGUCCCUUCCAAUGGCUCGUU-5' (SEQ ID NO: 6497)

C5-1393 Target:
5'-ATCAGGCCAGGGAAGGTTACCGAGCAA-3' (SEQ ID NO: 8807)

5'-UCAGGCCAGGGAAGGUUACCGAGCAAU-3' (SEQ ID NO: 13428)

3'-AGUCCGGUCCCUUCCAAUGGCUCGUUA-5' (SEQ ID NO: 6498)

C5-1394 Target:
5'-TCAGGCCAGGGAAGGTTACCGAGCAAT-3' (SEQ ID NO: 8808)

5'-CAGGCCAGGGAAGGUUACCGAGCAAUA-3' (SEQ ID NO: 13429)

3'-GUCCGGUCCCUUCCAAUGGCUCGUUAU-5' (SEQ ID NO: 6499)

C5-1395 Target:
5'-CAGGCCAGGGAAGGTTACCGAGCAATA-3' (SEQ ID NO: 8809)

5'-AGGCCAGGGAAGGUUACCGAGCAAUAG-3' (SEQ ID NO: 13430)

3'-UCCGGUCCCUUCCAAUGGCUCGUUAUC-5' (SEQ ID NO: 6500)

C5-1396 Target:
5'-AGGCCAGGGAAGGTTACCGAGCAATAG-3' (SEQ ID NO: 8810)

5'-GGCCAGGGAAGGUUACCGAGCAAUAGC-3' (SEQ ID NO: 13431)

3'-CCGGUCCCUUCCAAUGGCUCGUUAUCG-5' (SEQ ID NO: 6501)

C5-1397 Target:
5'-GGCCAGGGAAGGTTACCGAGCAATAGC-3' (SEQ ID NO: 8811)

5'-GCCAGGGAAGGUUACCGAGCAAUAGCA-3' (SEQ ID NO: 13432)

3'-CGGUCCCUUCCAAUGGCUCGUUAUCGU-5' (SEQ ID NO: 6502)

TABLE 9-continued

"Blunt/Blunt" DsiRNAs Corresponding to Human Anti-C5 DsiRNAs Predicted to have >50% Knockdown Efficacy C5-1398 Target:
5'-GCCAGGGAAGGTTACCGAGCAATAGCA-3' (SEQ ID NO: 8812)

5'-CCAGGGAAGGUUACCGAGCAAUAGCAU-3' (SEQ ID NO: 13433)

3'-GGUCCCUUCCAAUGGCUCGUUAUCGUA-5' (SEQ ID NO: 6503)

C5-1399 Target:
5'-CCAGGGAAGGTTACCGAGCAATAGCAT-3' (SEQ ID NO: 8813)

5'-CAGGGAAGGUUACCGAGCAAUAGCAUA-3' (SEQ ID NO: 13434)

3'-GUCCCUUCCAAUGGCUCGUUAUCGUAU-5' (SEQ ID NO: 6504)

C5-1400 Target:
5'-CAGGGAAGGTTACCGAGCAATAGCATA-3' (SEQ ID NO: 8814)

5'-AGGGAAGGUUACCGAGCAAUAGCAUAC-3' (SEQ ID NO: 13435)

3'-UCCCUUCCAAUGGCUCGUUAUCGUAUG-5' (SEQ ID NO: 6505)

C5-1401 Target:
5'-AGGGAAGGTTACCGAGCAATAGCATAC-3' (SEQ ID NO: 8815)

5'-GGGAAGGUUACCGAGCAAUAGCAUACU-3' (SEQ ID NO: 13436)

3'-CCCUUCCAAUGGCUCGUUAUCGUAUGA-5' (SEQ ID NO: 6506)

C5-1402 Target:
5'-GGGAAGGTTACCGAGCAATAGCATACT-3' (SEQ ID NO: 8816)

5'-GGAAGGUUACCGAGCAAUAGCAUACUC-3' (SEQ ID NO: 13437)

3'-CCUUCCAAUGGCUCGUUAUCGUAUGAG-5' (SEQ ID NO: 6507)

C5-1403 Target:
5'-GGAAGGTTACCGAGCAATAGCATACTC-3' (SEQ ID NO: 8817)

5'-GAAGGUUACCGAGCAAUAGCAUACUCA-3' (SEQ ID NO: 13438)

3'-CUUCCAAUGGCUCGUUAUCGUAUGAGU-5' (SEQ ID NO: 6508)

C5-1404 Target:
5'-GAAGGTTACCGAGCAATAGCATACTCA-3' (SEQ ID NO: 8818)

5'-AGGUUACCGAGCAAUAGCAUACUCAUC-3' (SEQ ID NO: 13439)

3'-UCCAAUGGCUCGUUAUCGUAUGAGUAG-5' (SEQ ID NO: 6509)

C5-1406 Target:
5'-AGGTTACCGAGCAATAGCATACTCATC-3' (SEQ ID NO: 8819)

5'-GGUUACCGAGCAAUAGCAUACUCAUCU-3' (SEQ ID NO: 13440)

3'-CCAAUGGCUCGUUAUCGUAUGAGUAGA-5' (SEQ ID NO: 6510)

C5-1407 Target:
5'-GGTTACCGAGCAATAGCATACTCATCT-3' (SEQ ID NO: 8820)

5'-GUUACCGAGCAAUAGCAUACUCAUCUC-3' (SEQ ID NO: 13441)

3'-CAAUGGCUCGUUAUCGUAUGAGUAGAG-5' (SEQ ID NO: 6511)

C5-1408 Target:
5'-GTTACCGAGCAATAGCATACTCATCTC-3' (SEQ ID NO: 8821)

5'-UUACCGAGCAAUAGCAUACUCAUCUCU-3' (SEQ ID NO: 13442)

3'-AAUGGCUCGUUAUCGUAUGAGUAGAGA-5' (SEQ ID NO: 6512)

C5-1409 Target:
5'-TTACCGAGCAATAGCATACTCATCTCT-3' (SEQ ID NO: 8822)

5'-UACCGAGCAAUAGCAUACUCAUCUCUC-3' (SEQ ID NO: 13443)

3'-AUGGCUCGUUAUCGUAUGAGUAGAGAG-5' (SEQ ID NO: 6513)

C5-1410 Target:
5'-TACCGAGCAATAGCATACTCATCTCTC-3' (SEQ ID NO: 8823)

5'-ACCGAGCAAUAGCAUACUCAUCUCUCA-3' (SEQ ID NO: 13444)

3'-UGGCUCGUUAUCGUAUGAGUAGAGAGU-5' (SEQ ID NO: 6514)

C5-1411 Target:
5'-ACCGAGCAATAGCATACTCATCTCTCA-3' (SEQ ID NO: 8824)

5'-CCGAGCAAUAGCAUACUCAUCUCUCAG-3' (SEQ ID NO: 13445)

3'-GGCUCGUUAUCGUAUGAGUAGAGAGUC-5' (SEQ ID NO: 6515)

C5-1412 Target:
5'-CCGAGCAATAGCATACTCATCTCTCAG-3' (SEQ ID NO: 8825)

5'-CGAGCAAUAGCAUACUCAUCUCUCAGC-3' (SEQ ID NO: 13446)

3'-GCUCGUUAUCGUAUGAGUAGAGAGUCG-5' (SEQ ID NO: 6516)

C5-1413 Target:
5'-CGAGCAATAGCATACTCATCTCTCAGC-3' (SEQ ID NO: 8826)

5'-GAGCAAUAGCAUACUCAUCUCUCAGCC-3' (SEQ ID NO: 13447)

3'-CUCGUUAUCGUAUGAGUAGAGAGUCGG-5' (SEQ ID NO: 6517)

C5-1414 Target:
5'-GAGCAATAGCATACTCATCTCTCAGCC-3' (SEQ ID NO: 8827)

5'-AGCAAUAGCAUACUCAUCUCUCAGCCA-3' (SEQ ID NO: 13448)

3'-UCGUUAUCGUAUGAGUAGAGAGUCGGU-5' (SEQ ID NO: 6518)

C5-1415 Target:
5'-AGCAATAGCATACTCATCTCTCAGCCA-3' (SEQ ID NO: 8828)

5'-GCAAUAGCAUACUCAUCUCUCAGCCAA-3' (SEQ ID NO: 13449)

3'-CGUUAUCGUAUGAGUAGAGAGUCGGUU-5' (SEQ ID NO: 6519)

C5-1416 Target:
5'-GCAATAGCATACTCATCTCTCAGCCAA-3' (SEQ ID NO: 8829)

5'-CAAUAGCAUACUCAUCUCUCAGCCAAA-3' (SEQ ID NO: 13450)

3'-GUUAUCGUAUGAGUAGAGAGUCGGUUU-5' (SEQ ID NO: 6520)

C5-1417 Target:
5'-CAATAGCATACTCATCTCTCAGCCAAA-3' (SEQ ID NO: 8830)

5'-AAUAGCAUACUCAUCUCUCAGCCAAAG-3' (SEQ ID NO: 13451)

3'-UUAUCGUAUGAGUAGAGAGUCGGUUUC-5' (SEQ ID NO: 6521)

C5-1418 Target:
5'-AATAGCATACTCATCTCTCAGCCAAAG-3' (SEQ ID NO: 8831)

5'-AUAGCAUACUCAUCUCUCAGCCAAAGU-3' (SEQ ID NO: 13452)

3'-UAUCGUAUGAGUAGAGAGUCGGUUUCA-5' (SEQ ID NO: 6522)

TABLE 9-continued

"Blunt/Blunt" DsiRNAs Corresponding to Human Anti-C5 DsiRNAs Predicted to have >50% Knockdown Efficacy C5-1419 Target:
5'-ATAGCATACTCATCTCTCAGCCAAAGT-3' (SEQ ID NO: 8832)

5'-UAGCAUACUCAUCUCUCAGCCAAAGUU-3' (SEQ ID NO: 13453)

3'-AUCGUAUGAGUAGAGAGUCGGUUUCAA-5' (SEQ ID NO: 6523)

C5-1420 Target:
5'-TAGCATACTCATCTCTCAGCCAAAGTT-3' (SEQ ID NO: 8833)

5'-AGCAUACUCAUCUCUCAGCCAAAGUUA-3' (SEQ ID NO: 13454)

3'-UCGUAUGAGUAGAGAGUCGGUUUCAAU-5' (SEQ ID NO: 6524)

C5-1421 Target:
5'-AGCATACTCATCTCTCAGCCAAAGTTA-3' (SEQ ID NO: 8834)

5'-GCAUACUCAUCUCUCAGCCAAAGUUAC-3' (SEQ ID NO: 13455)

3'-CGUAUGAGUAGAGAGUCGGUUUCAAUG-5' (SEQ ID NO: 6525)

C5-1422 Target:
5'-GCATACTCATCTCTCAGCCAAAGTTAC-3' (SEQ ID NO: 8835)

5'-CAUACUCAUCUCUCAGCCAAAGUUACC-3' (SEQ ID NO: 13456)

3'-GUAUGAGUAGAGAGUCGGUUUCAAUGG-5' (SEQ ID NO: 6526)

C5-1423 Target:
5'-CATACTCATCTCTCAGCCAAAGTTACC-3' (SEQ ID NO: 8836)

5'-AUACUCAUCUCUCAGCCAAAGUUACCU-3' (SEQ ID NO: 13457)

3'-UAUGAGUAGAGAGUCGGUUUCAAUGGA-5' (SEQ ID NO: 6527)

C5-1424 Target:
5'-ATACTCATCTCTCAGCCAAAGTTACCT-3' (SEQ ID NO: 8837)

5'-UACUCAUCUCUCAGCCAAAGUUACCUU-3' (SEQ ID NO: 13458)

3'-AUGAGUAGAGAGUCGGUUUCAAUGGAA-5' (SEQ ID NO: 6528)

C5-1425 Target:
5'-TACTCATCTCTCAGCCAAAGTTACCTT-3' (SEQ ID NO: 8838)

5'-ACUCAUCUCUCAGCCAAAGUUACCUUU-3' (SEQ ID NO: 13459)

3'-UGAGUAGAGAGUCGGUUUCAAUGGAAA-5' (SEQ ID NO: 6529)

C5-1426 Target:
5'-ACTCATCTCTCAGCCAAAGTTACCTTT-3' (SEQ ID NO: 8839)

5'-CUCAUCUCUCAGCCAAAGUUACCUUUA-3' (SEQ ID NO: 13460)

3'-GAGUAGAGAGUCGGUUUCAAUGGAAAU-5' (SEQ ID NO: 6530)

C5-1427 Target:
5'-CTCATCTCTCAGCCAAAGTTACCTTTA-3' (SEQ ID NO: 8840)

5'-UCAUCUCUCAGCCAAAGUUACCUUUAU-3' (SEQ ID NO: 13461)

3'-AGUAGAGAGUCGGUUUCAAUGGAAAUA-5' (SEQ ID NO: 6531)

C5-1428 Target:
5'-TCATCTCTCAGCCAAAGTTACCTTTAT-3' (SEQ ID NO: 8841)

5'-CAUCUCUCAGCCAAAGUUACCUUUAUA-3' (SEQ ID NO: 13462)

3'-GUAGAGAGUCGGUUUCAAUGGAAAUAU-5' (SEQ ID NO: 6532)

C5-1429 Target:
5'-CATCTCTCAGCCAAAGTTACCTTTATA-3' (SEQ ID NO: 8842)

5'-AUCUCUCAGCCAAAGUUACCUUUAUAU-3' (SEQ ID NO: 13463)

3'-UAGAGAGUCGGUUUCAAUGGAAAUAUA-5' (SEQ ID NO: 6533)

C5-1430 Target:
5'-ATCTCTCAGCCAAAGTTACCTTTATAT-3' (SEQ ID NO: 8843)

5'-UCUCUCAGCCAAAGUUACCUUUAUAUU-3' (SEQ ID NO: 13464)

3'-AGAGAGUCGGUUUCAAUGGAAAUAUAA-5' (SEQ ID NO: 6534)

C5-1431 Target:
5'-TCTCTCAGCCAAAGTTACCTTTATATT-3' (SEQ ID NO: 8844)

5'-CUCUCAGCCAAAGUUACCUUUAUAUUG-3' (SEQ ID NO: 13465)

3'-GAGAGUCGGUUUCAAUGGAAAUAUAAC-5' (SEQ ID NO: 6535)

C5-1432 Target:
5'-CTCTCAGCCAAAGTTACCTTTATATTG-3' (SEQ ID NO: 8845)

5'-AUAAGGCUUUGCUAGUGGGAGAACAUC-3' (SEQ ID NO: 13466)

3'-UAUUCCGAAACGAUCACCCUCUUGUAG-5' (SEQ ID NO: 6536)

C5-1474 Target:
5'-ATAAGGCTTTGCTAGTGGGAGAACATC-3' (SEQ ID NO: 8846)

5'-UAAGGCUUUGCUAGUGGGAGAACAUCU-3' (SEQ ID NO: 13467)

3'-AUUCCGAAACGAUCACCCUCUUGUAGA-5' (SEQ ID NO: 6537)

C5-1475 Target:
5'-TAAGGCTTTGCTAGTGGGAGAACATCT-3' (SEQ ID NO: 8847)

5'-AAGGCUUUGCUAGUGGGAGAACAUCUG-3' (SEQ ID NO: 13468)

3'-UUCCGAAACGAUCACCCUCUUGUAGAC-5' (SEQ ID NO: 6538)

C5-1476 Target:
5'-AAGGCTTTGCTAGTGGGAGAACATCTG-3' (SEQ ID NO: 8848)

5'-CCCCAAAAGCCCAUAUAUUGACAAAAU-3' (SEQ ID NO: 13469)

3'-GGGGUUUUCGGGUAUAUAACUGUUUUA-5' (SEQ ID NO: 6539)

C5-1517 Target:
5'-CCCCAAAAGCCCATATATTGACAAAAT-3' (SEQ ID NO: 8849)

5'-CCCAAAAGCCCAUAUAUUGACAAAAUA-3' (SEQ ID NO: 13470)

3'-GGGUUUUCGGGUAUAUAACUGUUUUAU-5' (SEQ ID NO: 6540)

C5-1518 Target:
5'-CCCAAAAGCCCATATATTGACAAAATA-3' (SEQ ID NO: 8850)

5'-CAAAAGCCCAUAUAUUGACAAAAUAAC-3' (SEQ ID NO: 13471)

3'-GUUUUCGGGUAUAUAACUGUUUUAUUG-5' (SEQ ID NO: 6541)

C5-1520 Target:
5'-CAAAAGCCCATATATTGACAAAATAAC-3' (SEQ ID NO: 8851)

5'-AAAAGCCCAUAUAUUGACAAAAUAACU-3' (SEQ ID NO: 13472)

3'-UUUUCGGGUAUAUAACUGUUUUAUUGA-5' (SEQ ID NO: 6542)

TABLE 9-continued

"Blunt/Blunt" DsiRNAs Corresponding to Human Anti-C5 DsiRNAs Predicted to have >50% Knockdown Efficacy C5-1521 Target:
5'-AAAAGCCCATATATTGACAAAATAACT-3' (SEQ ID NO: 8852)

5'-AAAGCCCAUAUAUUGACAAAAUAACUC-3' (SEQ ID NO: 13473)

3'-UUUCGGGUAUAUAACUGUUUUAUUGAG-5' (SEQ ID NO: 6543)

C5-1522 Target:
5'-AAAGCCCATATATTGACAAAATAACTC-3' (SEQ ID NO: 8853)

5'-GCCCAUAUAUUGACAAAAUAACUCACU-3' (SEQ ID NO: 13474)

3'-CGGGUAUAUAACUGUUUUAUUGAGUGA-5' (SEQ ID NO: 6544)

C5-1525 Target:
5'-GCCCATATATTGACAAAATAACTCACT-3' (SEQ ID NO: 8854)

5'-AUAUAUUGACAAAAUAACUCACUAUAA-3' (SEQ ID NO: 13475)

3'-UAUAUAACUGUUUUAUUGAGUGAUAUU-5' (SEQ ID NO: 6545)

C5-1529 Target:
5'-ATATATTGACAAAATAACTCACTATAA-3' (SEQ ID NO: 8855)

5'-UAUAUUGACAAAAUAACUCACUAUAAU-3' (SEQ ID NO: 13476)

3'-AUAUAACUGUUUUAUUGAGUGAUAUUA-5' (SEQ ID NO: 6546)

C5-1530 Target:
5'-TATATTGACAAAATAACTCACTATAAT-3' (SEQ ID NO: 8856)

5'-UAUUGACAAAAUAACUCACUAUAAUUA-3' (SEQ ID NO: 13477)

3'-AUAACUGUUUUAUUGAGUGAUAUUAAU-5' (SEQ ID NO: 6547)

C5-1532 Target:
5'-TATTGACAAAATAACTCACTATAATTA-3' (SEQ ID NO: 8857)

5'-AUUACUUGAUUUUAUCCAAGGGCAAAA-3' (SEQ ID NO: 13478)

3'-UAAUGAACUAAAAUAGGUUCCCGUUUU-5' (SEQ ID NO: 6548)

C5-1555 Target:
5'-ATTACTTGATTTTATCCAAGGGCAAAA-3' (SEQ ID NO: 8858)

5'-UUACUUGAUUUUAUCCAAGGGCAAAAU-3' (SEQ ID NO: 13479)

3'-AAUGAACUAAAAUAGGUUCCCGUUUUA-5' (SEQ ID NO: 6549)

C5-1556 Target:
5'-TTACTTGATTTTATCCAAGGGCAAAAT-3' (SEQ ID NO: 8859)

5'-UACUUGAUUUUAUCCAAGGGCAAAAUU-3' (SEQ ID NO: 13480)

3'-AUGAACUAAAAUAGGUUCCCGUUUUAA-5' (SEQ ID NO: 6550)

C5-1557 Target:
5'-TACTTGATTTTATCCAAGGGCAAAATT-3' (SEQ ID NO: 8860)

5'-ACUUGAUUUUAUCCAAGGGCAAAAUUA-3' (SEQ ID NO: 13481)

3'-UGAACUAAAAUAGGUUCCCGUUUUAAU-5' (SEQ ID NO: 6551)

C5-1558 Target:
5'-ACTTGATTTTATCCAAGGGCAAAATTA-3' (SEQ ID NO: 8861)

5'-CUUGAUUUUAUCCAAGGGCAAAAUUAU-3' (SEQ ID NO: 13482)

3'-GAACUAAAAUAGGUUCCCGUUUUAAUA-5' (SEQ ID NO: 6552)

C5-1559 Target:
5'-CTTGATTTTATCCAAGGGCAAAATTAT-3' (SEQ ID NO: 8862)

5'-UUGAUUUUAUCCAAGGGCAAAAUUAUC-3' (SEQ ID NO: 13483)

3'-AACUAAAAUAGGUUCCCGUUUUAAUAG-5' (SEQ ID NO: 6553)

C5-1560 Target:
5'-TTGATTTTATCCAAGGGCAAAATTATC-3' (SEQ ID NO: 8863)

5'-UGAUUUUAUCCAAGGGCAAAAUUAUCC-3' (SEQ ID NO: 13484)

3'-ACUAAAAUAGGUUCCCGUUUUAAUAGG-5' (SEQ ID NO: 6554)

C5-1561 Target:
5'-TGATTTTATCCAAGGGCAAAATTATCC-3' (SEQ ID NO: 8864)

5'-GAUUUUAUCCAAGGGCAAAAUUAUCCA-3' (SEQ ID NO: 13485)

3'-CUAAAAUAGGUUCCCGUUUUAAUAGGU-5' (SEQ ID NO: 6555)

C5-1562 Target:
5'-GATTTTATCCAAGGGCAAAATTATCCA-3' (SEQ ID NO: 8865)

5'-AUUUUAUCCAAGGGCAAAAUUAUCCAC-3' (SEQ ID NO: 13486)

3'-UAAAAUAGGUUCCCGUUUUAAUAGGUG-5' (SEQ ID NO: 6556)

C5-1563 Target:
5'-ATTTTATCCAAGGGCAAAATTATCCAC-3' (SEQ ID NO: 8866)

5'-UUUUAUCCAAGGGCAAAAUUAUCCACU-3' (SEQ ID NO: 13487)

3'-AAAAUAGGUUCCCGUUUUAAUAGGUGA-5' (SEQ ID NO: 6557)

C5-1564 Target:
5'-TTTTATCCAAGGGCAAAATTATCCACT-3' (SEQ ID NO: 8867)

5'-UUUUAUCCAAGGGCAAAAUUAUCCACUU-3' (SEQ ID NO: 13488)

3'-AAAUAGGUUCCCGUUUUAAUAGGUGAA-5' (SEQ ID NO: 6558)

C5-1565 Target:
5'-TTTATCCAAGGGCAAAATTATCCACTT-3' (SEQ ID NO: 8868)

5'-UUAUCCAAGGGCAAAAUUAUCCACUUU-3' (SEQ ID NO: 13489)

3'-AAUAGGUUCCCGUUUUAAUAGGUGAAA-5' (SEQ ID NO: 6559)

C5-1566 Target:
5'-TTATCCAAGGGCAAAATTATCCACTTT-3' (SEQ ID NO: 8869)

5'-UAUCCAAGGGCAAAAUUAUCCACUUUG-3' (SEQ ID NO: 13490)

3'-AUAGGUUCCCGUUUUAAUAGGUGAAAC-5' (SEQ ID NO: 6560)

C5-1567 Target:
5'-TATCCAAGGGCAAAATTATCCACTTTG-3' (SEQ ID NO: 8870)

5'-AUCCAAGGGCAAAAUUAUCCACUUUGG-3' (SEQ ID NO: 13491)

3'-UAGGUUCCCGUUUUAAUAGGUGAAACC-5' (SEQ ID NO: 6561)

C5-1568 Target:
5'-ATCCAAGGGCAAAATTATCCACTTTGG-3' (SEQ ID NO: 8871)

5'-UCCAAGGGCAAAAUUAUCCACUUUGGC-3' (SEQ ID NO: 13492)

3'-AGGUUCCCGUUUUAAUAGGUGAAACCG-5' (SEQ ID NO: 6562)

TABLE 9-continued

"Blunt/Blunt" DsiRNAs Corresponding to Human Anti-C5 DsiRNAs Predicted to have >50% Knockdown Efficacy C5-1569 Target:
5'-TCCAAGGGCAAAATTATCCACTTTGGC-3' (SEQ ID NO: 8872)

5'-CCAAGGGCAAAAUUAUCCACUUUGGCA-3' (SEQ ID NO: 13493)

3'-GGUUCCCGUUUUAAUAGGUGAAACCGU-5' (SEQ ID NO: 6563)

C5-1570 Target:
5'-CCAAGGGCAAAATTATCCACTTTGGCA-3' (SEQ ID NO: 8873)

5'-CAAGGGCAAAAUUAUCCACUUUGGCAC-3' (SEQ ID NO: 13494)

3'-GUUCCCGUUUUAAUAGGUGAAACCGUG-5' (SEQ ID NO: 6564)

C5-1571 Target:
5'-CAAGGGCAAAATTATCCACTTTGGCAC-3' (SEQ ID NO: 8874)

5'-AAGGGCAAAAUUAUCCACUUUGGCACG-3' (SEQ ID NO: 13495)

3'-UUCCCGUUUUAAUAGGUGAAACCGUGC-5' (SEQ ID NO: 6565)

C5-1572 Target:
5'-AAGGGCAAAATTATCCACTTTGGCACG-3' (SEQ ID NO: 8875)

5'-AGGGCAAAAUUAUCCACUUUGGCACGA-3' (SEQ ID NO: 13496)

3'-UCCCGUUUUAAUAGGUGAAACCGUGCU-5' (SEQ ID NO: 6566)

C5-1573 Target:
5'-AGGGCAAAATTATCCACTTTGGCACGA-3' (SEQ ID NO: 8876)

5'-GGGCAAAAUUAUCCACUUUGGCACGAG-3' (SEQ ID NO: 13497)

3'-CCCGUUUUAAUAGGUGAAACCGUGCUC-5' (SEQ ID NO: 6567)

C5-1574 Target:
5'-GGGCAAAATTATCCACTTTGGCACGAG-3' (SEQ ID NO: 8877)

5'-GGCAAAAUUAUCCACUUUGGCACGAGG-3' (SEQ ID NO: 13498)

3'-CCGUUUUAAUAGGUGAAACCGUGCUCC-5' (SEQ ID NO: 6568)

C5-1575 Target:
5'-GGCAAAATTATCCACTTTGGCACGAGG-3' (SEQ ID NO: 8878)

5'-GCAAAAUUAUCCACUUUGGCACGAGGG-3' (SEQ ID NO: 13499)

3'-CGUUUUAAUAGGUGAAACCGUGCUCCC-5' (SEQ ID NO: 6569)

C5-1576 Target:
5'-GCAAAATTATCCACTTTGGCACGAGGG-3' (SEQ ID NO: 8879)

5'-CAAAAUUAUCCACUUUGGCACGAGGGA-3' (SEQ ID NO: 13500)

3'-GUUUUAAUAGGUGAAACCGUGCUCCCU-5' (SEQ ID NO: 6570)

C5-1577 Target:
5'-CAAAATTATCCACTTTGGCACGAGGGA-3' (SEQ ID NO: 8880)

5'-AUUUUCAGAUGCAUCUUAUCAAAGUAU-3' (SEQ ID NO: 13501)

3'-UAAAAGUCUACGUAGAAUAGUUUCAUA-5' (SEQ ID NO: 6571)

C5-1607 Target:
5'-ATTTTCAGATGCATCTTATCAAAGTAT-3' (SEQ ID NO: 8881)

5'-UUUUCAGAUGCAUCUUAUCAAAGUAUA-3' (SEQ ID NO: 13502)

3'-AAAAGUCUACGUAGAAUAGUUUCAUAU-5' (SEQ ID NO: 6572)

C5-1608 Target:
5'-TTTTCAGATGCATCTTATCAAAGTATA-3' (SEQ ID NO: 8882)

5'-UUUCAGAUGCAUCUUAUCAAAGUAUAA-3' (SEQ ID NO: 13503)

3'-AAAGUCUACGUAGAAUAGUUUCAUAUU-5' (SEQ ID NO: 6573)

C5-1609 Target:
5'-TTTCAGATGCATCTTATCAAAGTATAA-3' (SEQ ID NO: 8883)

5'-UUCAGAUGCAUCUUAUCAAAGUAUAAA-3' (SEQ ID NO: 13504)

3'-AAGUCUACGUAGAAUAGUUUCAUAUUU-5' (SEQ ID NO: 6574)

C5-1610 Target:
5'-TTCAGATGCATCTTATCAAAGTATAAA-3' (SEQ ID NO: 8884)

5'-UCAGAUGCAUCUUAUCAAAGUAUAAAC-3' (SEQ ID NO: 13505)

3'-AGUCUACGUAGAAUAGUUUCAUAUUUG-5' (SEQ ID NO: 6575)

C5-1611 Target:
5'-TCAGATGCATCTTATCAAAGTATAAAC-3' (SEQ ID NO: 8885)

5'-CAGAUGCAUCUUAUCAAAGUAUAAACA-3' (SEQ ID NO: 13506)

3'-GUCUACGUAGAAUAGUUUCAUAUUUGU-5' (SEQ ID NO: 6576)

C5-1612 Target:
5'-CAGATGCATCTTATCAAAGTATAAACA-3' (SEQ ID NO: 8886)

5'-AGAUGCAUCUUAUCAAAGUAUAAACAU-3' (SEQ ID NO: 13507)

3'-UCUACGUAGAAUAGUUUCAUAUUUGUA-5' (SEQ ID NO: 6577)

C5-1613 Target:
5'-AGATGCATCTTATCAAAGTATAAACAT-3' (SEQ ID NO: 8887)

5'-GAUGCAUCUUAUCAAAGUAUAAACAUU-3' (SEQ ID NO: 13508)

3'-CUACGUAGAAUAGUUUCAUAUUUGUAA-5' (SEQ ID NO: 6578)

C5-1614 Target:
5'-GATGCATCTTATCAAAGTATAAACATT-3' (SEQ ID NO: 8888)

5'-AUGCAUCUUAUCAAAGUAUAAACAUUC-3' (SEQ ID NO: 13509)

3'-UACGUAGAAUAGUUUCAUAUUUGUAAG-5' (SEQ ID NO: 6579)

C5-1615 Target:
5'-ATGCATCTTATCAAAGTATAAACATTC-3' (SEQ ID NO: 8889)

5'-UGCAUCUUAUCAAAGUAUAAACAUUCC-3' (SEQ ID NO: 13510)

3'-ACGUAGAAUAGUUUCAUAUUUGUAAGG-5' (SEQ ID NO: 6580)

C5-1616 Target:
5'-TGCATCTTATCAAAGTATAAACATTCC-3' (SEQ ID NO: 8890)

5'-GCAUCUUAUCAAAGUAUAAACAUUCCA-3' (SEQ ID NO: 13511)

3'-CGUAGAAUAGUUUCAUAUUUGUAAGGU-5' (SEQ ID NO: 6581)

C5-1617 Target:
5'-GCATCTTATCAAAGTATAAACATTCCA-3' (SEQ ID NO: 8891)

5'-CAUCUUAUCAAAGUAUAAACAUUCCAG-3' (SEQ ID NO: 13512)

3'-GUAGAAUAGUUUCAUAUUUGUAAGGUC-5' (SEQ ID NO: 6582)

TABLE 9-continued

"Blunt/Blunt" DsiRNAs Corresponding to Human Anti-C5 DsiRNAs Predicted to have >50% Knockdown Efficacy C5-1618 Target:
5'-CATCTTATCAAAGTATAAACATTCCAG-3' (SEQ ID NO: 8892)

5'-AUCUUAUCAAAGUAUAAACAUUCCAGU-3' (SEQ ID NO: 13513)

3'-UAGAAUAGUUUCAUAUUUGUAAGGUCA-5' (SEQ ID NO: 6583)

C5-1619 Target:
5'-ATCTTATCAAAGTATAAACATTCCAGT-3' (SEQ ID NO: 8893)

5'-UCUUAUCAAAGUAUAAACAUUCCAGUA-3' (SEQ ID NO: 13514)

3'-AGAAUAGUUUCAUAUUUGUAAGGUCAU-5' (SEQ ID NO: 6584)

C5-1620 Target:
5'-TCTTATCAAAGTATAAACATTCCAGTA-3' (SEQ ID NO: 8894)

5'-CUUAUCAAAGUAUAAACAUUCCAGUAA-3' (SEQ ID NO: 13515)

3'-GAAUAGUUUCAUAUUUGUAAGGUCAUU-5' (SEQ ID NO: 6585)

C5-1621 Target:
5'-CTTATCAAAGTATAAACATTCCAGTAA-3' (SEQ ID NO: 8895)

5'-UUAUCAAAGUAUAAACAUUCCAGUAAC-3' (SEQ ID NO: 13516)

3'-AAUAGUUUCAUAUUUGUAAGGUCAUUG-5' (SEQ ID NO: 6586)

C5-1622 Target:
5'-TTATCAAAGTATAAACATTCCAGTAAC-3' (SEQ ID NO: 8896)

5'-UAUCAAAGUAUAAACAUUCCAGUAACA-3' (SEQ ID NO: 13517)

3'-AUAGUUUCAUAUUUGUAAGGUCAUUGU-5' (SEQ ID NO: 6587)

C5-1623 Target:
5'-TATCAAAGTATAAACATTCCAGTAACA-3' (SEQ ID NO: 8897)

5'-AUCAAAGUAUAAACAUUCCAGUAACAC-3' (SEQ ID NO: 13518)

3'-UAGUUUCAUAUUUGUAAGGUCAUUGUG-5' (SEQ ID NO: 6588)

C5-1624 Target:
5'-ATCAAAGTATAAACATTCCAGTAACAC-3' (SEQ ID NO: 8898)

5'-CACAGAACAUGGUUCCUUCAUCCCGAC-3' (SEQ ID NO: 13519)

3'-GUGUCUUGUACCAAGGAAGUAGGGCUG-5' (SEQ ID NO: 6589)

C5-1648 Target:
5'-CACAGAACATGGTTCCTTCATCCCGAC-3' (SEQ ID NO: 8899)

5'-ACAGAACAUGGUUCCUUCAUCCCGACU-3' (SEQ ID NO: 13520)

3'-UGUCUUGUACCAAGGAAGUAGGGCUGA-5' (SEQ ID NO: 6590)

C5-1649 Target:
5'-ACAGAACATGGTTCCTTCATCCCGACT-3' (SEQ ID NO: 8900)

5'-CAGAACAUGGUUCCUUCAUCCCGACUU-3' (SEQ ID NO: 13521)

3'-GUCUUGUACCAAGGAAGUAGGGCUGAA-5' (SEQ ID NO: 6591)

C5-1650 Target:
5'-CAGAACATGGTTCCTTCATCCCGACTT-3' (SEQ ID NO: 8901)

5'-AGAACAUGGUUCCUUCAUCCCGACUUC-3' (SEQ ID NO: 13522)

3'-UCUUGUACCAAGGAAGUAGGGCUGAAG-5' (SEQ ID NO: 6592)

C5-1651 Target:
5'-AGAACATGGTTCCTTCATCCCGACTTC-3' (SEQ ID NO: 8902)

5'-GAACAUGGUUCCUUCAUCCCGACUUCU-3' (SEQ ID NO: 13523)

3'-CUUGUACCAAGGAAGUAGGGCUGAAGA-5' (SEQ ID NO: 6593)

C5-1652 Target:
5'-GAACATGGTTCCTTCATCCCGACTTCT-3' (SEQ ID NO: 8903)

5'-AACAUGGUUCCUUCAUCCCGACUUCUG-3' (SEQ ID NO: 13524)

3'-UUGUACCAAGGAAGUAGGGCUGAAGAC-5' (SEQ ID NO: 6594)

C5-1653 Target:
5'-AACATGGTTCCTTCATCCCGACTTCTG-3' (SEQ ID NO: 8904)

5'-ACAUGGUUCCUUCAUCCCGACUUCUGG-3' (SEQ ID NO: 13525)

3'-UGUACCAAGGAAGUAGGGCUGAAGACC-5' (SEQ ID NO: 6595)

C5-1654 Target:
5'-ACATGGTTCCTTCATCCCGACTTCTGG-3' (SEQ ID NO: 8905)

5'-CAUGGUUCCUUCAUCCCGACUUCUGGU-3' (SEQ ID NO: 13526)

3'-GUACCAAGGAAGUAGGGCUGAAGACCA-5' (SEQ ID NO: 6596)

C5-1655 Target:
5'-CATGGTTCCTTCATCCCGACTTCTGGT-3' (SEQ ID NO: 8906)

5'-UUCUGGUCUAUUACAUCGUCACAGGAG-3' (SEQ ID NO: 13527)

3'-AAGACCAGAUAAUGUAGCAGUGUCCUC-5' (SEQ ID NO: 6597)

C5-1675 Target:
5'-TTCTGGTCTATTACATCGTCACAGGAG-3' (SEQ ID NO: 8907)

5'-UCUGGUCUAUUACAUCGUCACAGGAGA-3' (SEQ ID NO: 13528)

3'-AGACCAGAUAAUGUAGCAGUGUCCUCU-5' (SEQ ID NO: 6598)

C5-1676 Target:
5'-TCTGGTCTATTACATCGTCACAGGAGA-3' (SEQ ID NO: 8908)

5'-CUGGUCUAUUACAUCGUCACAGGAGAA-3' (SEQ ID NO: 13529)

3'-GACCAGAUAAUGUAGCAGUGUCCUCUU-5' (SEQ ID NO: 6599)

C5-1677 Target:
5'-CTGGTCTATTACATCGTCACAGGAGAA-3' (SEQ ID NO: 8909)

5'-UGGUCUAUUACAUCGUCACAGGAGAAC-3' (SEQ ID NO: 13530)

3'-ACCAGAUAAUGUAGCAGUGUCCUCUUG-5' (SEQ ID NO: 6600)

C5-1678 Target:
5'-TGGTCTATTACATCGTCACAGGAGAAC-3' (SEQ ID NO: 8910)

5'-GGUCUAUUACAUCGUCACAGGAGAACA-3' (SEQ ID NO: 13531)

3'-CCAGAUAAUGUAGCAGUGUCCUCUUGU-5' (SEQ ID NO: 6601)

C5-1679 Target:
5'-GGTCTATTACATCGTCACAGGAGAACA-3' (SEQ ID NO: 8911)

5'-GUCUAUUACAUCGUCACAGGAGAACAG-3' (SEQ ID NO: 13532)

3'-CAGAUAAUGUAGCAGUGUCCUCUUGUC-5' (SEQ ID NO: 6602)

TABLE 9-continued

"Blunt/Blunt" DsiRNAs Corresponding to Human Anti-C5 DsiRNAs Predicted to have >50% Knockdown Efficacy C5-1680 Target:
5'-GTCTATTACATCGTCACAGGAGAACAG-3' (SEQ ID NO: 8912)

5'-UCUAUUACAUCGUCACAGGAGAACAGA-3' (SEQ ID NO: 13533)

3'-AGAUAAUGUAGCAGUGUCCUCUUGUCU-5' (SEQ ID NO: 6603)

C5-1681 Target:
5'-TCTATTACATCGTCACAGGAGAACAGA-3' (SEQ ID NO: 8913)

5'-CUAUUACAUCGUCACAGGAGAACAGAC-3' (SEQ ID NO: 13534)

3'-GAUAAUGUAGCAGUGUCCUCUUGUCUG-5' (SEQ ID NO: 6604)

C5-1682 Target:
5'-CTATTACATCGTCACAGGAGAACAGAC-3' (SEQ ID NO: 8914)

5'-AACAGACAGCAGAAUUAGUGUCUGAUU-3' (SEQ ID NO: 13535)

3'-UUGUCUGUCGUCUUAAUCACAGACUAA-5' (SEQ ID NO: 6605)

C5-1702 Target:
5'-AACAGACAGCAGAATTAGTGTCTGATT-3' (SEQ ID NO: 8915)

5'-ACAGACAGCAGAAUUAGUGUCUGAUUC-3' (SEQ ID NO: 13536)

3'-UGUCUGUCGUCUUAAUCACAGACUAAG-5' (SEQ ID NO: 6606)

C5-1703 Target:
5'-ACAGACAGCAGAATTAGTGTCTGATTC-3' (SEQ ID NO: 8916)

5'-CAGACAGCAGAAUUAGUGUCUGAUUCA-3' (SEQ ID NO: 13537)

3'-GUCUGUCGUCUUAAUCACAGACUAAGU-5' (SEQ ID NO: 6607)

C5-1704 Target:
5'-CAGACAGCAGAATTAGTGTCTGATTCA-3' (SEQ ID NO: 8917)

5'-AGACAGCAGAAUUAGUGUCUGAUUCAG-3' (SEQ ID NO: 13538)

3'-UCUGUCGUCUUAAUCACAGACUAAGUC-5' (SEQ ID NO: 6608)

C5-1705 Target:
5'-AGACAGCAGAATTAGTGTCTGATTCAG-3' (SEQ ID NO: 8918)

5'-GACAGCAGAAUUAGUGUCUGAUUCAGU-3' (SEQ ID NO: 13539)

3'-CUGUCGUCUUAAUCACAGACUAAGUCA-5' (SEQ ID NO: 6609)

C5-1706 Target:
5'-GACAGCAGAATTAGTGTCTGATTCAGT-3' (SEQ ID NO: 8919)

5'-ACAGCAGAAUUAGUGUCUGAUUCAGUC-3' (SEQ ID NO: 13540)

3'-UGUCGUCUUAAUCACAGACUAAGUCAG-5' (SEQ ID NO: 6610)

C5-1707 Target:
5'-ACAGCAGAATTAGTGTCTGATTCAGTC-3' (SEQ ID NO: 8920)

5'-CAGCAGAAUUAGUGUCUGAUUCAGUCU-3' (SEQ ID NO: 13541)

3'-GUCGUCUUAAUCACAGACUAAGUCAGA-5' (SEQ ID NO: 6611)

C5-1708 Target:
5'-CAGCAGAATTAGTGTCTGATTCAGTCT-3' (SEQ ID NO: 8921)

5'-AGCAGAAUUAGUGUCUGAUUCAGUCUG-3' (SEQ ID NO: 13542)

3'-UCGUCUUAAUCACAGACUAAGUCAGAC-5' (SEQ ID NO: 6612)

C5-1709 Target:
5'-AGCAGAATTAGTGTCTGATTCAGTCTG-3' (SEQ ID NO: 8922)

5'-GCAGAAUUAGUGUCUGAUUCAGUCUGG-3' (SEQ ID NO: 13543)

3'-CGUCUUAAUCACAGACUAAGUCAGACC-5' (SEQ ID NO: 6613)

C5-1710 Target:
5'-GCAGAATTAGTGTCTGATTCAGTCTGG-3' (SEQ ID NO: 8923)

5'-CAGAAUUAGUGUCUGAUUCAGUCUGGU-3' (SEQ ID NO: 13544)

3'-GUCUUAAUCACAGACUAAGUCAGACCA-5' (SEQ ID NO: 6614)

C5-1711 Target:
5'-CAGAATTAGTGTCTGATTCAGTCTGGT-3' (SEQ ID NO: 8924)

5'-AGAAUUAGUGUCUGAUUCAGUCUGGUU-3' (SEQ ID NO: 13545)

3'-UCUUAAUCACAGACUAAGUCAGACCAA-5' (SEQ ID NO: 6615)

C5-1712 Target:
5'-AGAATTAGTGTCTGATTCAGTCTGGTT-3' (SEQ ID NO: 8925)

5'-GAAUUAGUGUCUGAUUCAGUCUGGUUA-3' (SEQ ID NO: 13546)

3'-CUUAAUCACAGACUAAGUCAGACCAAU-5' (SEQ ID NO: 6616)

C5-1713 Target:
5'-GAATTAGTGTCTGATTCAGTCTGGTTA-3' (SEQ ID NO: 8926)

5'-AAUUAGUGUCUGAUUCAGUCUGGUUAA-3' (SEQ ID NO: 13547)

3'-UUAAUCACAGACUAAGUCAGACCAAUU-5' (SEQ ID NO: 6617)

C5-1714 Target:
5'-AATTAGTGTCTGATTCAGTCTGGTTAA-3' (SEQ ID NO: 8927)

5'-AUUAGUGUCUGAUUCAGUCUGGUUAAA-3' (SEQ ID NO: 13548)

3'-UAAUCACAGACUAAGUCAGACCAAUUU-5' (SEQ ID NO: 6618)

C5-1715 Target:
5'-ATTAGTGTCTGATTCAGTCTGGTTAAA-3' (SEQ ID NO: 8928)

5'-UUAGUGUCUGAUUCAGUCUGGUUAAAU-3' (SEQ ID NO: 13549)

3'-AAUCACAGACUAAGUCAGACCAAUUUA-5' (SEQ ID NO: 6619)

C5-1716 Target:
5'-TTAGTGTCTGATTCAGTCTGGTTAAAT-3' (SEQ ID NO: 8929)

5'-UAGUGUCUGAUUCAGUCUGGUUAAAUA-3' (SEQ ID NO: 13550)

3'-AUCACAGACUAAGUCAGACCAAUUUAU-5' (SEQ ID NO: 6620)

C5-1717 Target:
5'-TAGTGTCTGATTCAGTCTGGTTAAATA-3' (SEQ ID NO: 8930)

5'-AGUGUCUGAUUCAGUCUGGUUAAAUAU-3' (SEQ ID NO: 13551)

3'-UCACAGACUAAGUCAGACCAAUUUAUA-5' (SEQ ID NO: 6621)

C5-1718 Target:
5'-AGTGTCTGATTCAGTCTGGTTAAATAT-3' (SEQ ID NO: 8931)

5'-UGUCUGAUUCAGUCUGGUUAAAUAUUG-3' (SEQ ID NO: 13552)

3'-ACAGACUAAGUCAGACCAAUUUAUAAC-5' (SEQ ID NO: 6622)

TABLE 9-continued

"Blunt/Blunt" DsiRNAs Corresponding to Human Anti-C5 DsiRNAs Predicted to have >50% Knockdown Efficacy C5-1720 Target:
5'-TGTCTGATTCAGTCTGGTTAAATATTG-3' (SEQ ID NO: 8932)

5'-GAUUCAGUCUGGUUAAAUAUUGAAGAA-3' (SEQ ID NO: 13553)

3'-CUAAGUCAGACCAAUUUAUAACUUCUU-5' (SEQ ID NO: 6623)

C5-1725 Target:
5'-GATTCAGTCTGGTTAAATATTGAAGAA-3' (SEQ ID NO: 8933)

5'-UGGUUAAAUAUUGAAGAAAAAUGUGGC-3' (SEQ ID NO: 13554)

3'-ACCAAUUUAUAACUUCUUUUUACACCG-5' (SEQ ID NO: 6624)

C5-1734 Target:
5'-TGGTTAAATATTGAAGAAAATGTGGC-3' (SEQ ID NO: 8934)

5'-GGUUAAAUAUUGAAGAAAAAUGUGGCA-3' (SEQ ID NO: 13555)

3'-CCAAUUUAUAACUUCUUUUUACACCGU-5' (SEQ ID NO: 6625)

C5-1735 Target:
5'-GGTTAAATATTGAAGAAAATGTGGCA-3' (SEQ ID NO: 8935)

5'-GUUAAAUAUUGAAGAAAAAUGUGGCAA-3' (SEQ ID NO: 13556)

3'-CAAUUUAUAACUUCUUUUUACACCGUU-5' (SEQ ID NO: 6626)

C5-1736 Target:
5'-GTTAAATATTGAAGAAAATGTGGCAA-3' (SEQ ID NO: 8936)

5'-UUAAAUAUUGAAGAAAAAUGUGGCAAC-3' (SEQ ID NO: 13557)

3'-AAUUUAUAACUUCUUUUUACACCGUUG-5' (SEQ ID NO: 6627)

C5-1737 Target:
5'-TTAAATATTGAAGAAAATGTGGCAAC-3' (SEQ ID NO: 8937)

5'-UAAAUAUUGAAGAAAAAUGUGGCAACC-3' (SEQ ID NO: 13558)

3'-AUUUAUAACUUCUUUUUACACCGUUGG-5' (SEQ ID NO: 6628)

C5-1738 Target:
5'-TAAATATTGAAGAAAATGTGGCAACC-3' (SEQ ID NO: 8938)

5'-AAAUAUUGAAGAAAAAUGUGGCAACCA-3' (SEQ ID NO: 13559)

3'-UUUAUAACUUCUUUUUACACCGUUGGU-5' (SEQ ID NO: 6629)

C5-1739 Target:
5'-AAATATTGAAGAAAATGTGGCAACCA-3' (SEQ ID NO: 8939)

5'-AAUAUUGAAGAAAAAUGUGGCAACCAG-3' (SEQ ID NO: 13560)

3'-UUAUAACUUCUUUUUACACCGUUGGUC-5' (SEQ ID NO: 6630)

C5-1740 Target:
5'-AATATTGAAGAAAATGTGGCAACCAG-3' (SEQ ID NO: 8940)

5'-AUAUUGAAGAAAAAUGUGGCAACCAGC-3' (SEQ ID NO: 13561)

3'-UAUAACUUCUUUUUACACCGUUGGUCG-5' (SEQ ID NO: 6631)

C5-1741 Target:
5'-ATATTGAAGAAAATGTGGCAACCAGC-3' (SEQ ID NO: 8941)

5'-UAUUGAAGAAAAAUGUGGCAACCAGCU-3' (SEQ ID NO: 13562)

3'-AUAACUUCUUUUUACACCGUUGGUCGA-5' (SEQ ID NO: 6632)

C5-1742 Target:
5'-TATTGAAGAAAATGTGGCAACCAGCT-3' (SEQ ID NO: 8942)

5'-AUUGAAGAAAAAUGUGGCAACCAGCUC-3' (SEQ ID NO: 13563)

3'-UAACUUCUUUUUACACCGUUGGUCGAG-5' (SEQ ID NO: 6633)

C5-1743 Target:
5'-ATTGAAGAAAATGTGGCAACCAGCTC-3' (SEQ ID NO: 8943)

5'-UUGAAGAAAAAUGUGGCAACCAGCUCC-3' (SEQ ID NO: 13564)

3'-AACUUCUUUUUACACCGUUGGUCGAGG-5' (SEQ ID NO: 6634)

C5-1744 Target:
5'-TTGAAGAAAATGTGGCAACCAGCTCC-3' (SEQ ID NO: 8944)

5'-UGAAGAAAAAUGUGGCAACCAGCUCCA-3' (SEQ ID NO: 13565)

3'-ACUUCUUUUUACACCGUUGGUCGAGGU-5' (SEQ ID NO: 6635)

C5-1745 Target:
5'-TGAAGAAAATGTGGCAACCAGCTCCA-3' (SEQ ID NO: 8945)

5'-GAAGAAAAAUGUGGCAACCAGCUCCAG-3' (SEQ ID NO: 13566)

3'-CUUCUUUUUACACCGUUGGUCGAGGUC-5' (SEQ ID NO: 6636)

C5-1746 Target:
5'-GAAGAAAATGTGGCAACCAGCTCCAG-3' (SEQ ID NO: 8946)

5'-AAGAAAAAUGUGGCAACCAGCUCCAGG-3' (SEQ ID NO: 13567)

3'-UUCUUUUUACACCGUUGGUCGAGGUCC-5' (SEQ ID NO: 6637)

C5-1747 Target:
5'-AAGAAAATGTGGCAACCAGCTCCAGG-3' (SEQ ID NO: 8947)

5'-AGAAAAAUGUGGCAACCAGCUCCAGGU-3' (SEQ ID NO: 13568)

3'-UCUUUUUACACCGUUGGUCGAGGUCCA-5' (SEQ ID NO: 6638)

C5-1748 Target:
5'-AGAAAATGTGGCAACCAGCTCCAGGT-3' (SEQ ID NO: 8948)

5'-GAAAAAUGUGGCAACCAGCUCCAGGUU-3' (SEQ ID NO: 13569)

3'-CUUUUUACACCGUUGGUCGAGGUCCAA-5' (SEQ ID NO: 6639)

C5-1749 Target:
5'-GAAAATGTGGCAACCAGCTCCAGGTT-3' (SEQ ID NO: 8949)

5'-AAAAAUGUGGCAACCAGCUCCAGGUUC-3' (SEQ ID NO: 13570)

3'-UUUUUACACCGUUGGUCGAGGUCCAAG-5' (SEQ ID NO: 6640)

C5-1750 Target:
5'-AAAATGTGGCAACCAGCTCCAGGTTC-3' (SEQ ID NO: 8950)

5'-AAAAUGUGGCAACCAGCUCCAGGUUCA-3' (SEQ ID NO: 13571)

3'-UUUUACACCGUUGGUCGAGGUCCAAGU-5' (SEQ ID NO: 6641)

C5-1751 Target:
5'-AAAATGTGGCAACCAGCTCCAGGTTCA-3' (SEQ ID NO: 8951)

5'-AAAUGUGGCAACCAGCUCCAGGUUCAU-3' (SEQ ID NO: 13572)

3'-UUUACACCGUUGGUCGAGGUCCAAGUA-5' (SEQ ID NO: 6642)

TABLE 9-continued

"Blunt/Blunt" DsiRNAs Corresponding to Human Anti-C5 DsiRNAs Predicted to have >50% Knockdown Efficacy C5-1752 Target:
5'-AAATGTGGCAACCAGCTCCAGGTTCAT-3' (SEQ ID NO: 8952)

5'-UGUGGCAACCAGCUCCAGGUUCAUCUG-3' (SEQ ID NO: 13573)

3'-ACACCGUUGGUCGAGGUCCAAGUAGAC-5' (SEQ ID NO: 6643)

C5-1755 Target:
5'-TGTGGCAACCAGCTCCAGGTTCATCTG-3' (SEQ ID NO: 8953)

5'-GUGGCAACCAGCUCCAGGUUCAUCUGU-3' (SEQ ID NO: 13574)

3'-CACCGUUGGUCGAGGUCCAAGUAGACA-5' (SEQ ID NO: 6644)

C5-1756 Target:
5'-GTGGCAACCAGCTCCAGGTTCATCTGT-3' (SEQ ID NO: 8954)

5'-UGGCAACCAGCUCCAGGUUCAUCUGUC-3' (SEQ ID NO: 13575)

3'-ACCGUUGGUCGAGGUCCAAGUAGACAG-5' (SEQ ID NO: 6645)

C5-1757 Target:
5'-TGGCAACCAGCTCCAGGTTCATCTGTC-3' (SEQ ID NO: 8955)

5'-GGCAACCAGCUCCAGGUUCAUCUGUCU-3' (SEQ ID NO: 13576)

3'-CCGUUGGUCGAGGUCCAAGUAGACAGA-5' (SEQ ID NO: 6646)

C5-1758 Target:
5'-GGCAACCAGCTCCAGGTTCATCTGTCT-3' (SEQ ID NO: 8956)

5'-GCAACCAGCUCCAGGUUCAUCUGUCUC-3' (SEQ ID NO: 13577)

3'-CGUUGGUCGAGGUCCAAGUAGACAGAG-5' (SEQ ID NO: 6647)

C5-1759 Target:
5'-GCAACCAGCTCCAGGTTCATCTGTCTC-3' (SEQ ID NO: 8957)

5'-CAACCAGCUCCAGGUUCAUCUGUCUCC-3' (SEQ ID NO: 13578)

3'-GUUGGUCGAGGUCCAAGUAGACAGAGG-5' (SEQ ID NO: 6648)

C5-1760 Target:
5'-CAACCAGCTCCAGGTTCATCTGTCTCC-3' (SEQ ID NO: 8958)

5'-AACCAGCUCCAGGUUCAUCUGUCUCCU-3' (SEQ ID NO: 13579)

3'-UUGGUCGAGGUCCAAGUAGACAGAGGA-5' (SEQ ID NO: 6649)

C5-1761 Target:
5'-AACCAGCTCCAGGTTCATCTGTCTCCT-3' (SEQ ID NO: 8959)

5'-ACCAGCUCCAGGUUCAUCUGUCUCCUG-3' (SEQ ID NO: 13580)

3'-UGGUCGAGGUCCAAGUAGACAGAGGAC-5' (SEQ ID NO: 6650)

C5-1762 Target:
5'-ACCAGCTCCAGGTTCATCTGTCTCCTG-3' (SEQ ID NO: 8960)

5'-CCAGCUCCAGGUUCAUCUGUCUCCUGA-3' (SEQ ID NO: 13581)

3'-GGUCGAGGUCCAAGUAGACAGAGGACU-5' (SEQ ID NO: 6651)

C5-1763 Target:
5'-CCAGCTCCAGGTTCATCTGTCTCCTGA-3' (SEQ ID NO: 8961)

5'-CAGCUCCAGGUUCAUCUGUCUCCUGAU-3' (SEQ ID NO: 13582)

3'-GUCGAGGUCCAAGUAGACAGAGGACUA-5' (SEQ ID NO: 6652)

C5-1764 Target:
5'-CAGCTCCAGGTTCATCTGTCTCCTGAT-3' (SEQ ID NO: 8962)

5'-AGCUCCAGGUUCAUCUGUCUCCUGAUG-3' (SEQ ID NO: 13583)

3'-UCGAGGUCCAAGUAGACAGAGGACUAC-5' (SEQ ID NO: 6653)

C5-1765 Target:
5'-AGCTCCAGGTTCATCTGTCTCCTGATG-3' (SEQ ID NO: 8963)

5'-GCUCCAGGUUCAUCUGUCUCCUGAUGC-3' (SEQ ID NO: 13584)

3'-CGAGGUCCAAGUAGACAGAGGACUACG-5' (SEQ ID NO: 6654)

C5-1766 Target:
5'-GCTCCAGGTTCATCTGTCTCCTGATGC-3' (SEQ ID NO: 8964)

5'-CUCCAGGUUCAUCUGUCUCCUGAUGCA-3' (SEQ ID NO: 13585)

3'-GAGGUCCAAGUAGACAGAGGACUACGU-5' (SEQ ID NO: 6655)

C5-1767 Target:
5'-CTCCAGGTTCATCTGTCTCCTGATGCA-3' (SEQ ID NO: 8965)

5'-UCCAGGUUCAUCUGUCUCCUGAUGCAG-3' (SEQ ID NO: 13586)

3'-AGGUCCAAGUAGACAGAGGACUACGUC-5' (SEQ ID NO: 6656)

C5-1768 Target:
5'-TCCAGGTTCATCTGTCTCCTGATGCAG-3' (SEQ ID NO: 8966)

5'-CCAGGUUCAUCUGUCUCCUGAUGCAGA-3' (SEQ ID NO: 13587)

3'-GGUCCAAGUAGACAGAGGACUACGUCU-5' (SEQ ID NO: 6657)

C5-1769 Target:
5'-CCAGGTTCATCTGTCTCCTGATGCAGA-3' (SEQ ID NO: 8967)

5'-CAGGUUCAUCUGUCUCCUGAUGCAGAU-3' (SEQ ID NO: 13588)

3'-GUCCAAGUAGACAGAGGACUACGUCUA-5' (SEQ ID NO: 6658)

C5-1770 Target:
5'-CAGGTTCATCTGTCTCCTGATGCAGAT-3' (SEQ ID NO: 8968)

5'-AGGUUCAUCUGUCUCCUGAUGCAGAUG-3' (SEQ ID NO: 13589)

3'-UCCAAGUAGACAGAGGACUACGUCUAC-5' (SEQ ID NO: 6659)

C5-1771 Target:
5'-AGGTTCATCTGTCTCCTGATGCAGATG-3' (SEQ ID NO: 8969)

5'-GGUUCAUCUGUCUCCUGAUGCAGAUGC-3' (SEQ ID NO: 13590)

3'-CCAAGUAGACAGAGGACUACGUCUACG-5' (SEQ ID NO: 6660)

C5-1772 Target:
5'-GGTTCATCTGTCTCCTGATGCAGATGC-3' (SEQ ID NO: 8970)

5'-GUUCAUCUGUCUCCUGAUGCAGAUGCA-3' (SEQ ID NO: 13591)

3'-CAAGUAGACAGAGGACUACGUCUACGU-5' (SEQ ID NO: 6661)

C5-1773 Target:
5'-GTTCATCTGTCTCCTGATGCAGATGCA-3' (SEQ ID NO: 8971)

5'-UUCAUCUGUCUCCUGAUGCAGAUGCAU-3' (SEQ ID NO: 13592)

3'-AAGUAGACAGAGGACUACGUCUACGUA-5' (SEQ ID NO: 6662)

TABLE 9-continued

"Blunt/Blunt" DsiRNAs Corresponding to Human Anti-C5 DsiRNAs Predicted to have >50% Knockdown Efficacy C5-1774 Target:
5'-TTCATCTGTCTCCTGATGCAGATGCAT-3' (SEQ ID NO: 8972)

5'-UCAUCUGUCUCCUGAUGCAGAUGCAUA-3' (SEQ ID NO: 13593)

3'-AGUAGACAGAGGACUACGUCUACGUAU-5' (SEQ ID NO: 6663)

C5-1775 Target:
5'-TCATCTGTCTCCTGATGCAGATGCATA-3' (SEQ ID NO: 8973)

5'-CAUCUGUCUCCUGAUGCAGAUGCAUAU-3' (SEQ ID NO: 13594)

3'-GUAGACAGAGGACUACGUCUACGUAUA-5' (SEQ ID NO: 6664)

C5-1776 Target:
5'-CATCTGTCTCCTGATGCAGATGCATAT-3' (SEQ ID NO: 8974)

5'-GAAUGGAUUCCUGGGUGGCAUUAGCAG-3' (SEQ ID NO: 13595)

3'-CUUACCUAAGGACCCACCGUAAUCGUC-5' (SEQ ID NO: 6665)

C5-1840 Target:
5'-GAATGGATTCCTGGGTGGCATTAGCAG-3' (SEQ ID NO: 8975)

5'-AAUGGAUUCCUGGGUGGCAUUAGCAGC-3' (SEQ ID NO: 13596)

3'-UUACCUAAGGACCCACCGUAAUCGUCG-5' (SEQ ID NO: 6666)

C5-1841 Target:
5'-AATGGATTCCTGGGTGGCATTAGCAGC-3' (SEQ ID NO: 8976)

5'-AUGGAUUCCUGGGUGGCAUUAGCAGCA-3' (SEQ ID NO: 13597)

3'-UACCUAAGGACCCACCGUAAUCGUCGU-5' (SEQ ID NO: 6667)

C5-1842 Target:
5'-ATGGATTCCTGGGTGGCATTAGCAGCA-3' (SEQ ID NO: 8977)

5'-AGGAGCCAAAAAGCCCUUGGAAAGAGU-3' (SEQ ID NO: 13598)

3'-UCCUCGGUUUUUCGGGAACCUUUCUCA-5' (SEQ ID NO: 6668)

C5-1898 Target:
5'-AGGAGCCAAAAAGCCCTTGGAAAGAGT-3' (SEQ ID NO: 8978)

5'-GGAGCCAAAAAGCCCUUGGAAAGAGUA-3' (SEQ ID NO: 13599)

3'-CCUCGGUUUUUCGGGAACCUUUCUCAU-5' (SEQ ID NO: 6669)

C5-1899 Target:
5'-GGAGCCAAAAAGCCCTTGGAAAGAGTA-3' (SEQ ID NO: 8979)

5'-GAGCCAAAAAGCCCUUGGAAAGAGUAU-3' (SEQ ID NO: 13600)

3'-CUCGGUUUUUCGGGAACCUUUCUCAUA-5' (SEQ ID NO: 6670)

C5-1900 Target:
5'-GAGCCAAAAAGCCCTTGGAAAGAGTAT-3' (SEQ ID NO: 8980)

5'-AGCCAAAAAGCCCUUGGAAAGAGUAUU-3' (SEQ ID NO: 13601)

3'-UCGGUUUUUCGGGAACCUUUCUCAUAA-5' (SEQ ID NO: 6671)

C5-1901 Target:
5'-AGCCAAAAAGCCCTTGGAAAGAGTATT-3' (SEQ ID NO: 8981)

5'-GCCAAAAAGCCCUUGGAAAGAGUAUUU-3' (SEQ ID NO: 13602)

3'-CGGUUUUUCGGGAACCUUUCUCAUAAA-5' (SEQ ID NO: 6672)

C5-1902 Target:
5'-GCCAAAAAGCCCTTGGAAAGAGTATTT-3' (SEQ ID NO: 8982)

5'-CCAAAAAGCCCUUGGAAAGAGUAUUUC-3' (SEQ ID NO: 13603)

3'-GGUUUUUCGGGAACCUUUCUCAUAAAG-5' (SEQ ID NO: 6673)

C5-1903 Target:
5'-CCAAAAAGCCCTTGGAAAGAGTATTTC-3' (SEQ ID NO: 8983)

5'-CAAAAAGCCCUUGGAAAGAGUAUUUCA-3' (SEQ ID NO: 13604)

3'-GUUUUUCGGGAACCUUUCUCAUAAAGU-5' (SEQ ID NO: 6674)

C5-1904 Target:
5'-CAAAAAGCCCTTGGAAAGAGTATTTCA-3' (SEQ ID NO: 8984)

5'-AAAAAGCCCUUGGAAAGAGUAUUUCAA-3' (SEQ ID NO: 13605)

3'-UUUUUCGGGAACCUUUCUCAUAAAGUU-5' (SEQ ID NO: 6675)

C5-1905 Target:
5'-AAAAAGCCCTTGGAAAGAGTATTTCAA-3' (SEQ ID NO: 8985)

5'-AAAAGCCCUUGGAAAGAGUAUUUCAAU-3' (SEQ ID NO: 13606)

3'-UUUUCGGGAACCUUUCUCAUAAAGUUA-5' (SEQ ID NO: 6676)

C5-1906 Target:
5'-AAAAGCCCTTGGAAAGAGTATTTCAAT-3' (SEQ ID NO: 8986)

5'-AAAGCCCUUGGAAAGAGUAUUUCAAUU-3' (SEQ ID NO: 13607)

3'-UUUCGGGAACCUUUCUCAUAAAGUUAA-5' (SEQ ID NO: 6677)

C5-1907 Target:
5'-AAAGCCCTTGGAAAGAGTATTTCAATT-3' (SEQ ID NO: 8987)

5'-AAGCCCUUGGAAAGAGUAUUUCAAUUC-3' (SEQ ID NO: 13608)

3'-UUCGGGAACCUUUCUCAUAAAGUUAAG-5' (SEQ ID NO: 6678)

C5-1908 Target:
5'-AAGCCCTTGGAAAGAGTATTTCAATTC-3' (SEQ ID NO: 8988)

5'-AGCCCUUGGAAAGAGUAUUUCAAUUCU-3' (SEQ ID NO: 13609)

3'-UCGGGAACCUUUCUCAUAAAGUUAAGA-5' (SEQ ID NO: 6679)

C5-1909 Target:
5'-AGCCCTTGGAAAGAGTATTTCAATTCT-3' (SEQ ID NO: 8989)

5'-GCCCUUGGAAAGAGUAUUUCAAUUCUU-3' (SEQ ID NO: 13610)

3'-CGGGAACCUUUCUCAUAAAGUUAAGAA-5' (SEQ ID NO: 6680)

C5-1910 Target:
5'-GCCCTTGGAAAGAGTATTTCAATTCTT-3' (SEQ ID NO: 8990)

5'-CCCUUGGAAAGAGUAUUUCAAUUCUUA-3' (SEQ ID NO: 13611)

3'-GGGAACCUUUCUCAUAAAGUUAAGAAU-5' (SEQ ID NO: 6681)

C5-1911 Target:
5'-CCCTTGGAAAGAGTATTTCAATTCTTA-3' (SEQ ID NO: 8991)

5'-CCUUGGAAAGAGUAUUUCAAUUCUUAG-3' (SEQ ID NO: 13612)

3'-GGAACCUUUCUCAUAAAGUUAAGAAUC-5' (SEQ ID NO: 6682)

TABLE 9-continued

"Blunt/Blunt" DsiRNAs Corresponding to Human Anti-C5 DsiRNAs Predicted to have >50% Knockdown Efficacy C5-1912 Target:
5'-CCTTGGAAAGAGTATTTCAATTCTTAG-3' (SEQ ID NO: 8992)

5'-CUUGGAAAGAGUAUUUCAAUUCUUAGA-3' (SEQ ID NO: 13613)

3'-GAACCUUUCUCAUAAAGUUAAGAAUCU-5' (SEQ ID NO: 6683)

C5-1913 Target:
5'-CTTGGAAAGAGTATTTCAATTCTTAGA-3' (SEQ ID NO: 8993)

5'-UUGGAAAGAGUAUUUCAAUUCUUAGAG-3' (SEQ ID NO: 13614)

3'-AACCUUUCUCAUAAAGUUAAGAAUCUC-5' (SEQ ID NO: 6684)

C5-1914 Target:
5'-TTGGAAAGAGTATTTCAATTCTTAGAG-3' (SEQ ID NO: 8994)

5'-UGGAAAGAGUAUUUCAAUUCUUAGAGA-3' (SEQ ID NO: 13615)

3'-ACCUUUCUCAUAAAGUUAAGAAUCUCU-5' (SEQ ID NO: 6685)

C5-1915 Target:
5'-TGGAAAGAGTATTTCAATTCTTAGAGA-3' (SEQ ID NO: 8995)

5'-GGAAAGAGUAUUUCAAUUCUUAGAGAA-3' (SEQ ID NO: 13616)

3'-CCUUUCUCAUAAAGUUAAGAAUCUCUU-5' (SEQ ID NO: 6686)

C5-1916 Target:
5'-GGAAAGAGTATTTCAATTCTTAGAGAA-3' (SEQ ID NO: 8996)

5'-GAAAGAGUAUUUCAAUUCUUAGAGAAG-3' (SEQ ID NO: 13617)

3'-CUUUCUCAUAAAGUUAAGAAUCUCUUC-5' (SEQ ID NO: 6687)

C5-1917 Target:
5'-GAAAGAGTATTTCAATTCTTAGAGAAG-3' (SEQ ID NO: 8997)

5'-AAAGAGUAUUUCAAUUCUUAGAGAAGA-3' (SEQ ID NO: 13618)

3'-UUUCUCAUAAAGUUAAGAAUCUCUUCU-5' (SEQ ID NO: 6688)

C5-1918 Target:
5'-AAAGAGTATTTCAATTCTTAGAGAAGA-3' (SEQ ID NO: 8998)

5'-AAGAGUAUUUCAAUUCUUAGAGAAGAG-3' (SEQ ID NO: 13619)

3'-UUCUCAUAAAGUUAAGAAUCUCUUCUC-5' (SEQ ID NO: 6689)

C5-1919 Target:
5'-AAGAGTATTTCAATTCTTAGAGAAGAG-3' (SEQ ID NO: 8999)

5'-AGAGUAUUUCAAUUCUUAGAGAAGAGU-3' (SEQ ID NO: 13620)

3'-UCUCAUAAAGUUAAGAAUCUCUUCUCA-5' (SEQ ID NO: 6690)

C5-1920 Target:
5'-AGAGTATTTCAATTCTTAGAGAAGAGT-3' (SEQ ID NO: 9000)

5'-GAGUAUUUCAAUUCUUAGAGAAGAGUG-3' (SEQ ID NO: 13621)

3'-CUCAUAAAGUUAAGAAUCUCUUCUCAC-5' (SEQ ID NO: 6691)

C5-1921 Target:
5'-GAGTATTTCAATTCTTAGAGAAGAGTG-3' (SEQ ID NO: 9001)

5'-AGUAUUUCAAUUCUUAGAGAAGAGUGA-3' (SEQ ID NO: 13622)

3'-UCAUAAAGUUAAGAAUCUCUUCUCACU-5' (SEQ ID NO: 6692)

C5-1922 Target:
5'-AGTATTTCAATTCTTAGAGAAGAGTGA-3' (SEQ ID NO: 9002)

5'-GUAUUUCAAUUCUUAGAGAAGAGUGAU-3' (SEQ ID NO: 13623)

3'-CAUAAAGUUAAGAAUCUCUUCUCACUA-5' (SEQ ID NO: 6693)

C5-1923 Target:
5'-GTATTTCAATTCTTAGAGAAGAGTGAT-3' (SEQ ID NO: 9003)

5'-UAUUUCAAUUCUUAGAGAAGAGUGAUC-3' (SEQ ID NO: 13624)

3'-AUAAAGUUAAGAAUCUCUUCUCACUAG-5' (SEQ ID NO: 6694)

C5-1924 Target:
5'-TATTTCAATTCTTAGAGAAGAGTGATC-3' (SEQ ID NO: 9004)

5'-AUUUCAAUUCUUAGAGAAGAGUGAUCU-3' (SEQ ID NO: 13625)

3'-UAAAGUUAAGAAUCUCUUCUCACUAGA-5' (SEQ ID NO: 6695)

C5-1925 Target:
5'-ATTTCAATTCTTAGAGAAGAGTGATCT-3' (SEQ ID NO: 9005)

5'-UUUCAAUUCUUAGAGAAGAGUGAUCUG-3' (SEQ ID NO: 13626)

3'-AAAGUUAAGAAUCUCUUCUCACUAGAC-5' (SEQ ID NO: 6696)

C5-1926 Target:
5'-TTTCAATTCTTAGAGAAGAGTGATCTG-3' (SEQ ID NO: 9006)

5'-UUCAAUUCUUAGAGAAGAGUGAUCUGG-3' (SEQ ID NO: 13627)

3'-AAGUUAAGAAUCUCUUCUCACUAGACC-5' (SEQ ID NO: 6697)

C5-1927 Target:
5'-TTCAATTCTTAGAGAAGAGTGATCTGG-3' (SEQ ID NO: 9007)

5'-UCAAUUCUUAGAGAAGAGUGAUCUGGG-3' (SEQ ID NO: 13628)

3'-AGUUAAGAAUCUCUUCUCACUAGACCC-5' (SEQ ID NO: 6698)

C5-1928 Target:
5'-TCAATTCTTAGAGAAGAGTGATCTGGG-3' (SEQ ID NO: 9008)

5'-CAAUUCUUAGAGAAGAGUGAUCUGGGC-3' (SEQ ID NO: 13629)

3'-GUUAAGAAUCUCUUCUCACUAGACCCG-5' (SEQ ID NO: 6699)

C5-1929 Target:
5'-CAATTCTTAGAGAAGAGTGATCTGGGC-3' (SEQ ID NO: 9009)

5'-AAUUCUUAGAGAAGAGUGAUCUGGGCU-3' (SEQ ID NO: 13630)

3'-UUAAGAAUCUCUUCUCACUAGACCCGA-5' (SEQ ID NO: 6700)

C5-1930 Target:
5'-AATTCTTAGAGAAGAGTGATCTGGGCT-3' (SEQ ID NO: 9010)

5'-UUCUUAGAGAAGAGUGAUCUGGGCUGU-3' (SEQ ID NO: 13631)

3'-AAGAAUCUCUUCUCACUAGACCCGACA-5' (SEQ ID NO: 6701)

C5-1932 Target:
5'-TTCTTAGAGAAGAGTGATCTGGGCTGT-3' (SEQ ID NO: 9011)

5'-UCUUAGAGAAGAGUGAUCUGGGCUGUG-3' (SEQ ID NO: 13632)

3'-AGAAUCUCUUCUCACUAGACCCGACAC-5' (SEQ ID NO: 6702)

TABLE 9-continued

"Blunt/Blunt" DsiRNAs Corresponding to Human Anti-C5 DsiRNAs Predicted to have >50% Knockdown Efficacy C5-1933 Target:
5'-TCTTAGAGAAGAGTGATCTGGGCTGTG-3' (SEQ ID NO: 9012)

5'-UUAGAGAAGAGUGAUCUGGGCUGUGGG-3' (SEQ ID NO: 13633)

3'-AAUCUCUUCUCACUAGACCCGACACCC-5' (SEQ ID NO: 6703)

C5-1935 Target:
5'-TTAGAGAAGAGTGATCTGGGCTGTGGG-3' (SEQ ID NO: 9013)

5'-UGUGGGGCAGGUGGUGGCCUCAACAAU-3' (SEQ ID NO: 13634)

3'-ACACCCCGUCCACCACCGGAGUUGUUA-5' (SEQ ID NO: 6704)

C5-1956 Target:
5'-TGTGGGGCAGGTGGTGGCCTCAACAAT-3' (SEQ ID NO: 9014)

5'-GGGCAGGUGGUGGCCUCAACAAUGCCA-3' (SEQ ID NO: 13635)

3'-CCCGUCCACCACCGGAGUUGUUACGGU-5' (SEQ ID NO: 6705)

C5-1960 Target:
5'-GGGCAGGTGGTGGCCTCAACAATGCCA-3' (SEQ ID NO: 9015)

5'-GGCAGGUGGUGGCCUCAACAAUGCCAA-3' (SEQ ID NO: 13636)

3'-CCGUCCACCACCGGAGUUGUUACGGUU-5' (SEQ ID NO: 6706)

C5-1961 Target:
5'-GGCAGGTGGTGGCCTCAACAATGCCAA-3' (SEQ ID NO: 9016)

5'-GCAGGUGGUGGCCUCAACAAUGCCAAU-3' (SEQ ID NO: 13637)

3'-CGUCCACCACCGGAGUUGUUACGGUUA-5' (SEQ ID NO: 6707)

C5-1962 Target:
5'-GCAGGTGGTGGCCTCAACAATGCCAAT-3' (SEQ ID NO: 9017)

5'-CAGGUGGUGGCCUCAACAAUGCCAAUG-3' (SEQ ID NO: 13638)

3'-GUCCACCACCGGAGUUGUUACGGUUAC-5' (SEQ ID NO: 6708)

C5-1963 Target:
5'-CAGGTGGTGGCCTCAACAATGCCAATG-3' (SEQ ID NO: 9018)

5'-AGGUGGUGGCCUCAACAAUGCCAAUGU-3' (SEQ ID NO: 13639)

3'-UCCACCACCGGAGUUGUUACGGUUACA-5' (SEQ ID NO: 6709)

C5-1964 Target:
5'-AGGTGGTGGCCTCAACAATGCCAATGT-3' (SEQ ID NO: 9019)

5'-GGUGGUGGCCUCAACAAUGCCAAUGUG-3' (SEQ ID NO: 13640)

3'-CCACCACCGGAGUUGUUACGGUUACAC-5' (SEQ ID NO: 6710)

C5-1965 Target:
5'-GGTGGTGGCCTCAACAATGCCAATGTG-3' (SEQ ID NO: 9020)

5'-GUGUUCCACCUAGCUGGACUUACCUUC-3' (SEQ ID NO: 13641)

3'-CACAAGGUGGAUCGACCUGAAUGGAAG-5' (SEQ ID NO: 6711)

C5-1989 Target:
5'-GTGTTCCACCTAGCTGGACTTACCTTC-3' (SEQ ID NO: 9021)

5'-UGUUCCACCUAGCUGGACUUACCUUCC-3' (SEQ ID NO: 13642)

3'-ACAAGGUGGAUCGACCUGAAUGGAAGG-5' (SEQ ID NO: 6712)

C5-1990 Target:
5'-TGTTCCACCTAGCTGGACTTACCTTCC-3' (SEQ ID NO: 9022)

5'-GUUCCACCUAGCUGGACUUACCUUCCU-3' (SEQ ID NO: 13643)

3'-CAAGGUGGAUCGACCUGAAUGGAAGGA-5' (SEQ ID NO: 6713)

C5-1991 Target:
5'-GTTCCACCTAGCTGGACTTACCTTCCT-3' (SEQ ID NO: 9023)

5'-UUCCACCUAGCUGGACUUACCUUCCUC-3' (SEQ ID NO: 13644)

3'-AAGGUGGAUCGACCUGAAUGGAAGGAG-5' (SEQ ID NO: 6714)

C5-1992 Target:
5'-TTCCACCTAGCTGGACTTACCTTCCTC-3' (SEQ ID NO: 9024)

5'-UCCACCUAGCUGGACUUACCUUCCUCA-3' (SEQ ID NO: 13645)

3'-AGGUGGAUCGACCUGAAUGGAAGGAGU-5' (SEQ ID NO: 6715)

C5-1993 Target:
5'-TCCACCTAGCTGGACTTACCTTCCTCA-3' (SEQ ID NO: 9025)

5'-CCACCUAGCUGGACUUACCUUCCUCAC-3' (SEQ ID NO: 13646)

3'-GGUGGAUCGACCUGAAUGGAAGGAGUG-5' (SEQ ID NO: 6716)

C5-1994 Target:
5'-CCACCTAGCTGGACTTACCTTCCTCAC-3' (SEQ ID NO: 9026)

5'-CACCUAGCUGGACUUACCUUCCUCACU-3' (SEQ ID NO: 13647)

3'-GUGGAUCGACCUGAAUGGAAGGAGUGA-5' (SEQ ID NO: 6717)

C5-1995 Target:
5'-CACCTAGCTGGACTTACCTTCCTCACT-3' (SEQ ID NO: 9027)

5'-ACCUAGCUGGACUUACCUUCCUCACUA-3' (SEQ ID NO: 13648)

3'-UGGAUCGACCUGAAUGGAAGGAGUGAU-5' (SEQ ID NO: 6718)

C5-1996 Target:
5'-ACCTAGCTGGACTTACCTTCCTCACTA-3' (SEQ ID NO: 9028)

5'-CCUAGCUGGACUUACCUUCCUCACUAA-3' (SEQ ID NO: 13649)

3'-GGAUCGACCUGAAUGGAAGGAGUGAUU-5' (SEQ ID NO: 6719)

C5-1997 Target:
5'-CCTAGCTGGACTTACCTTCCTCACTAA-3' (SEQ ID NO: 9029)

5'-CUAGCUGGACUUACCUUCCUCACUAAU-3' (SEQ ID NO: 13650)

3'-GAUCGACCUGAAUGGAAGGAGUGAUUA-5' (SEQ ID NO: 6720)

C5-1998 Target:
5'-CTAGCTGGACTTACCTTCCTCACTAAT-3' (SEQ ID NO: 9030)

5'-UAGCUGGACUUACCUUCCUCACUAAUG-3' (SEQ ID NO: 13651)

3'-AUCGACCUGAAUGGAAGGAGUGAUUAC-5' (SEQ ID NO: 6721)

C5-1999 Target:
5'-TAGCTGGACTTACCTTCCTCACTAATG-3' (SEQ ID NO: 9031)

5'-AGCUGGACUUACCUUCCUCACUAAUGC-3' (SEQ ID NO: 13652)

3'-UCGACCUGAAUGGAAGGAGUGAUUACG-5' (SEQ ID NO: 6722)

TABLE 9-continued

"Blunt/Blunt" DsiRNAs Corresponding to Human Anti-C5 DsiRNAs Predicted to have >50% Knockdown Efficacy C5-2000 Target:
5'-AGCTGGACTTACCTTCCTCACTAATGC-3' (SEQ ID NO: 9032)

5'-GCUGGACUUACCUUCCUCACUAAUGCA-3' (SEQ ID NO: 13653)

3'-CGACCUGAAUGGAAGGAGUGAUUACGU-5' (SEQ ID NO: 6723)

C5-2001 Target:
5'-GCTGGACTTACCTTCCTCACTAATGCA-3' (SEQ ID NO: 9033)

5'-CUGGACUUACCUUCCUCACUAAUGCAA-3' (SEQ ID NO: 13654)

3'-GACCUGAAUGGAAGGAGUGAUUACGUU-5' (SEQ ID NO: 6724)

C5-2002 Target:
5'-CTGGACTTACCTTCCTCACTAATGCAA-3' (SEQ ID NO: 9034)

5'-UGGACUUACCUUCCUCACUAAUGCAAA-3' (SEQ ID NO: 13655)

3'-ACCUGAAUGGAAGGAGUGAUUACGUUU-5' (SEQ ID NO: 6725)

C5-2003 Target:
5'-TGGACTTACCTTCCTCACTAATGCAAA-3' (SEQ ID NO: 9035)

5'-GGACUUACCUUCCUCACUAAUGCAAAU-3' (SEQ ID NO: 13656)

3'-CCUGAAUGGAAGGAGUGAUUACGUUUA-5' (SEQ ID NO: 6726)

C5-2004 Target:
5'-GGACTTACCTTCCTCACTAATGCAAAT-3' (SEQ ID NO: 9036)

5'-GACUUACCUUCCUCACUAAUGCAAAUG-3' (SEQ ID NO: 13657)

3'-CUGAAUGGAAGGAGUGAUUACGUUUAC-5' (SEQ ID NO: 6727)

C5-2005 Target:
5'-GACTTACCTTCCTCACTAATGCAAATG-3' (SEQ ID NO: 9037)

5'-ACUUACCUUCCUCACUAAUGCAAAUGC-3' (SEQ ID NO: 13658)

3'-UGAAUGGAAGGAGUGAUUACGUUUACG-5' (SEQ ID NO: 6728)

C5-2006 Target:
5'-ACTTACCTTCCTCACTAATGCAAATGC-3' (SEQ ID NO: 9038)

5'-CUUACCUUCCUCACUAAUGCAAAUGCA-3' (SEQ ID NO: 13659)

3'-GAAUGGAAGGAGUGAUUACGUUUACGU-5' (SEQ ID NO: 6729)

C5-2007 Target:
5'-CTTACCTTCCTCACTAATGCAAATGCA-3' (SEQ ID NO: 9039)

5'-UUACCUUCCUCACUAAUGCAAAUGCAG-3' (SEQ ID NO: 13660)

3'-AAUGGAAGGAGUGAUUACGUUUACGUC-5' (SEQ ID NO: 6730)

C5-2008 Target:
5'-TTACCTTCCTCACTAATGCAAATGCAG-3' (SEQ ID NO: 9040)

5'-UACCUUCCUCACUAAUGCAAAUGCAGA-3' (SEQ ID NO: 13661)

3'-AUGGAAGGAGUGAUUACGUUUACGUCU-5' (SEQ ID NO: 6731)

C5-2009 Target:
5'-TACCTTCCTCACTAATGCAAATGCAGA-3' (SEQ ID NO: 9041)

5'-ACCUUCCUCACUAAUGCAAAUGCAGAU-3' (SEQ ID NO: 13662)

3'-UGGAAGGAGUGAUUACGUUUACGUCUA-5' (SEQ ID NO: 6732)

C5-2010 Target:
5'-ACCTTCCTCACTAATGCAAATGCAGAT-3' (SEQ ID NO: 9042)

5'-CCUUCCUCACUAAUGCAAAUGCAGAUG-3' (SEQ ID NO: 13663)

3'-GGAAGGAGUGAUUACGUUUACGUCUAC-5' (SEQ ID NO: 6733)

C5-2011 Target:
5'-CCTTCCTCACTAATGCAAATGCAGATG-3' (SEQ ID NO: 9043)

5'-CUUCCUCACUAAUGCAAAUGCAGAUGA-3' (SEQ ID NO: 13664)

3'-GAAGGAGUGAUUACGUUUACGUCUACU-5' (SEQ ID NO: 6734)

C5-2012 Target:
5'-CTTCCTCACTAATGCAAATGCAGATGA-3' (SEQ ID NO: 9044)

5'-UUCCUCACUAAUGCAAAUGCAGAUGAC-3' (SEQ ID NO: 13665)

3'-AAGGAGUGAUUACGUUUACGUCUACUG-5' (SEQ ID NO: 6735)

C5-2013 Target:
5'-TTCCTCACTAATGCAAATGCAGATGAC-3' (SEQ ID NO: 9045)

5'-UCCUCACUAAUGCAAAUGCAGAUGACU-3' (SEQ ID NO: 13666)

3'-AGGAGUGAUUACGUUUACGUCUACUGA-5' (SEQ ID NO: 6736)

C5-2014 Target:
5'-TCCTCACTAATGCAAATGCAGATGACT-3' (SEQ ID NO: 9046)

5'-CCUCACUAAUGCAAAUGCAGAUGACUC-3' (SEQ ID NO: 13667)

3'-GGAGUGAUUACGUUUACGUCUACUGAG-5' (SEQ ID NO: 6737)

C5-2015 Target:
5'-CCTCACTAATGCAAATGCAGATGACTC-3' (SEQ ID NO: 9047)

5'-CUCACUAAUGCAAAUGCAGAUGACUCC-3' (SEQ ID NO: 13668)

3'-GAGUGAUUACGUUUACGUCUACUGAGG-5' (SEQ ID NO: 6738)

C5-2016 Target:
5'-CTCACTAATGCAAATGCAGATGACTCC-3' (SEQ ID NO: 9048)

5'-UCACUAAUGCAAAUGCAGAUGACUCCC-3' (SEQ ID NO: 13669)

3'-AGUGAUUACGUUUACGUCUACUGAGGG-5' (SEQ ID NO: 6739)

C5-2017 Target:
5'-TCACTAATGCAAATGCAGATGACTCCC-3' (SEQ ID NO: 9049)

5'-CACUAAUGCAAAUGCAGAUGACUCCCA-3' (SEQ ID NO: 13670)

3'-GUGAUUACGUUUACGUCUACUGAGGGU-5' (SEQ ID NO: 6740)

C5-2018 Target:
5'-CACTAATGCAAATGCAGATGACTCCCA-3' (SEQ ID NO: 9050)

5'-ACUAAUGCAAAUGCAGAUGACUCCCAA-3' (SEQ ID NO: 13671)

3'-UGAUUACGUUUACGUCUACUGAGGGUU-5' (SEQ ID NO: 6741)

C5-2019 Target:
5'-ACTAATGCAAATGCAGATGACTCCCAA-3' (SEQ ID NO: 9051)

5'-CUAAUGCAAAUGCAGAUGACUCCCAAG-3' (SEQ ID NO: 13672)

3'-GAUUACGUUUACGUCUACUGAGGGUUC-5' (SEQ ID NO: 6742)

TABLE 9-continued

"Blunt/Blunt" DsiRNAs Corresponding to Human Anti-C5 DsiRNAs Predicted to have >50% Knockdown Efficacy C5-2020 Target:
5'-CTAATGCAAATGCAGATGACTCCCAAG-3' (SEQ ID NO: 9052)

5'-UAAUGCAAAUGCAGAUGACUCCCAAGA-3' (SEQ ID NO: 13673)

3'-AUUACGUUUACGUCUACUGAGGGUUCU-5' (SEQ ID NO: 6743)

C5-2021 Target:
5'-TAATGCAAATGCAGATGACTCCCAAGA-3' (SEQ ID NO: 9053)

5'-AAUGCAAAUGCAGAUGACUCCCAAGAA-3' (SEQ ID NO: 13674)

3'-UUACGUUUACGUCUACUGAGGGUUCUU-5' (SEQ ID NO: 6744)

C5-2022 Target:
5'-AATGCAAATGCAGATGACTCCCAAGAA-3' (SEQ ID NO: 9054)

5'-AUGCAAAUGCAGAUGACUCCCAAGAAA-3' (SEQ ID NO: 13675)

3'-UACGUUUACGUCUACUGAGGGUUCUUU-5' (SEQ ID NO: 6745)

C5-2023 Target:
5'-ATGCAAATGCAGATGACTCCCAAGAAA-3' (SEQ ID NO: 9055)

5'-UGCAAAUGCAGAUGACUCCCAAGAAAA-3' (SEQ ID NO: 13676)

3'-ACGUUUACGUCUACUGAGGGUUCUUUU-5' (SEQ ID NO: 6746)

C5-2024 Target:
5'-TGCAAATGCAGATGACTCCCAAGAAAA-3' (SEQ ID NO: 9056)

5'-GCAAAUGCAGAUGACUCCCAAGAAAAU-3' (SEQ ID NO: 13677)

3'-CGUUUACGUCUACUGAGGGUUCUUUUA-5' (SEQ ID NO: 6747)

C5-2025 Target:
5'-GCAAATGCAGATGACTCCCAAGAAAAT-3' (SEQ ID NO: 9057)

5'-CAAAUGCAGAUGACUCCCAAGAAAAUG-3' (SEQ ID NO: 13678)

3'-GUUUACGUCUACUGAGGGUUCUUUUAC-5' (SEQ ID NO: 6748)

C5-2026 Target:
5'-CAAATGCAGATGACTCCCAAGAAAATG-3' (SEQ ID NO: 9058)

5'-AAAUGCAGAUGACUCCCAAGAAAAUGA-3' (SEQ ID NO: 13679)

3'-UUUACGUCUACUGAGGGUUCUUUUACU-5' (SEQ ID NO: 6749)

C5-2027 Target:
5'-AAATGCAGATGACTCCCAAGAAAATGA-3' (SEQ ID NO: 9059)

5'-AAUGCAGAUGACUCCCAAGAAAAUGAU-3' (SEQ ID NO: 13680)

3'-UUACGUCUACUGAGGGUUCUUUUACUA-5' (SEQ ID NO: 6750)

C5-2028 Target:
5'-AATGCAGATGACTCCCAAGAAAATGAT-3' (SEQ ID NO: 9060)

5'-AUGCAGAUGACUCCCAAGAAAAUGAUG-3' (SEQ ID NO: 13681)

3'-UACGUCUACUGAGGGUUCUUUUACUAC-5' (SEQ ID NO: 6751)

C5-2029 Target:
5'-ATGCAGATGACTCCCAAGAAAATGATG-3' (SEQ ID NO: 9061)

5'-UGCAGAUGACUCCCAAGAAAAUGAUGA-3' (SEQ ID NO: 13682)

3'-ACGUCUACUGAGGGUUCUUUUACUACU-5' (SEQ ID NO: 6752)

C5-2030 Target:
5'-TGCAGATGACTCCCAAGAAAATGATGA-3' (SEQ ID NO: 9062)

5'-GCAGAUGACUCCCAAGAAAAUGAUGAA-3' (SEQ ID NO: 13683)

3'-CGUCUACUGAGGGUUCUUUUACUACUU-5' (SEQ ID NO: 6753)

C5-2031 Target:
5'-GCAGATGACTCCCAAGAAAATGATGAA-3' (SEQ ID NO: 9063)

5'-CAGAUGACUCCCAAGAAAAUGAUGAAC-3' (SEQ ID NO: 13684)

3'-GUCUACUGAGGGUUCUUUUACUACUUG-5' (SEQ ID NO: 6754)

C5-2032 Target:
5'-CAGATGACTCCCAAGAAAATGATGAAC-3' (SEQ ID NO: 9064)

5'-AGAUGACUCCCAAGAAAAUGAUGAACC-3' (SEQ ID NO: 13685)

3'-UCUACUGAGGGUUCUUUUACUACUUGG-5' (SEQ ID NO: 6755)

C5-2033 Target:
5'-AGATGACTCCCAAGAAAATGATGAACC-3' (SEQ ID NO: 9065)

5'-GAUGACUCCCAAGAAAAUGAUGAACCU-3' (SEQ ID NO: 13686)

3'-CUACUGAGGGUUCUUUUACUACUUGGA-5' (SEQ ID NO: 6756)

C5-2034 Target:
5'-GATGACTCCCAAGAAAATGATGAACCT-3' (SEQ ID NO: 9066)

5'-AUGACUCCCAAGAAAAUGAUGAACCUU-3' (SEQ ID NO: 13687)

3'-UACUGAGGGUUCUUUUACUACUUGGAA-5' (SEQ ID NO: 6757)

C5-2035 Target:
5'-ATGACTCCCAAGAAAATGATGAACCTT-3' (SEQ ID NO: 9067)

5'-UGACUCCCAAGAAAAUGAUGAACCUUG-3' (SEQ ID NO: 13688)

3'-ACUGAGGGUUCUUUUACUACUUGGAAC-5' (SEQ ID NO: 6758)

C5-2036 Target:
5'-TGACTCCCAAGAAAATGATGAACCTTG-3' (SEQ ID NO: 9068)

5'-GACUCCCAAGAAAAUGAUGAACCUUGU-3' (SEQ ID NO: 13689)

3'-CUGAGGGUUCUUUUACUACUUGGAACA-5' (SEQ ID NO: 6759)

C5-2037 Target:
5'-GACTCCCAAGAAAATGATGAACCTTGT-3' (SEQ ID NO: 9069)

5'-ACUCCCAAGAAAAUGAUGAACCUUGUA-3' (SEQ ID NO: 13690)

3'-UGAGGGUUCUUUUACUACUUGGAACAU-5' (SEQ ID NO: 6760)

C5-2038 Target:
5'-ACTCCCAAGAAAATGATGAACCTTGTA-3' (SEQ ID NO: 9070)

5'-CUCCCAAGAAAAUGAUGAACCUUGUAA-3' (SEQ ID NO: 13691)

3'-GAGGGUUCUUUUACUACUUGGAACAUU-5' (SEQ ID NO: 6761)

C5-2039 Target:
5'-CTCCCAAGAAAATGATGAACCTTGTAA-3' (SEQ ID NO: 9071)

5'-UCCCAAGAAAAUGAUGAACCUUGUAAA-3' (SEQ ID NO: 13692)

3'-AGGGUUCUUUUACUACUUGGAACAUUU-5' (SEQ ID NO: 6762)

TABLE 9-continued

"Blunt/Blunt" DsiRNAs Corresponding to Human Anti-C5 DsiRNAs Predicted to have >50% Knockdown Efficacy C5-2040 Target:
5'-TCCCAAGAAAATGATGAACCTTGTAAA-3' (SEQ ID NO: 9072)

5'-CCCAAGAAAAUGAUGAACCUUGUAAAG-3' (SEQ ID NO: 13693)

3'-GGGUUCUUUUACUACUUGGAACAUUUC-5' (SEQ ID NO: 6763)

C5-2041 Target:
5'-CCCAAGAAAATGATGAACCTTGTAAAG-3' (SEQ ID NO: 9073)

5'-CCAAGAAAAUGAUGAACCUUGUAAAGA-3' (SEQ ID NO: 13694)

3'-GGUUCUUUUACUACUUGGAACAUUUCU-5' (SEQ ID NO: 6764)

C5-2042 Target:
5'-CCAAGAAAATGATGAACCTTGTAAAGA-3' (SEQ ID NO: 9074)

5'-AAGAAAAUGAUGAACCUUGUAAAGAAA-3' (SEQ ID NO: 13695)

3'-UUCUUUUACUACUUGGAACAUUUCUUU-5' (SEQ ID NO: 6765)

C5-2044 Target:
5'-AAGAAAATGATGAACCTTGTAAAGAAA-3' (SEQ ID NO: 9075)

5'-AGAAAAUGAUGAACCUUGUAAAGAAAU-3' (SEQ ID NO: 13696)

3'-UCUUUUACUACUUGGAACAUUUCUUUA-5' (SEQ ID NO: 6766)

C5-2045 Target:
5'-AGAAAATGATGAACCTTGTAAAGAAAT-3' (SEQ ID NO: 9076)

5'-GAAAAUGAUGAACCUUGUAAAGAAAUU-3' (SEQ ID NO: 13697)

3'-CUUUUACUACUUGGAACAUUUCUUUAA-5' (SEQ ID NO: 6767)

C5-2046 Target:
5'-GAAAATGATGAACCTTGTAAAGAAATT-3' (SEQ ID NO: 9077)

5'-AAAAUGAUGAACCUUGUAAAGAAAUUC-3' (SEQ ID NO: 13698)

3'-UUUUACUACUUGGAACAUUUCUUUAAG-5' (SEQ ID NO: 6768)

C5-2047 Target:
5'-AAAATGATGAACCTTGTAAAGAAATTC-3' (SEQ ID NO: 9078)

5'-AAUGAUGAACCUUGUAAAGAAAUUCUC-3' (SEQ ID NO: 13699)

3'-UUACUACUUGGAACAUUUCUUUAAGAG-5' (SEQ ID NO: 6769)

C5-2049 Target:
5'-AATGATGAACCTTGTAAAGAAATTCTC-3' (SEQ ID NO: 9079)

5'-GAUGAACCUUGUAAAGAAAUUCUCAGG-3' (SEQ ID NO: 13700)

3'-CUACUUGGAACAUUUCUUUAAGAGUCC-5' (SEQ ID NO: 6770)

C5-2052 Target:
5'-GATGAACCTTGTAAAGAAATTCTCAGG-3' (SEQ ID NO: 9080)

5'-AAAGAAGAUAGAAGAAAUAGCUGCUAA-3' (SEQ ID NO: 13701)

3'-UUUCUUCUAUCUUCUUUAUCGACGAUU-5' (SEQ ID NO: 6771)

C5-2096 Target:
5'-AAAGAAGATAGAAGAAATAGCTGCTAA-3' (SEQ ID NO: 9081)

5'-AAGAAGAUAGAAGAAAUAGCUGCUAAA-3' (SEQ ID NO: 13702)

3'-UUCUUCUAUCUUCUUUAUCGACGAUUU-5' (SEQ ID NO: 6772)

C5-2097 Target:
5'-AAGAAGATAGAAGAAATAGCTGCTAAA-3' (SEQ ID NO: 9082)

5'-AGAAGAUAGAAGAAAUAGCUGCUAAAU-3' (SEQ ID NO: 13703)

3'-UCUUCUAUCUUCUUUAUCGACGAUUUA-5' (SEQ ID NO: 6773)

C5-2098 Target:
5'-AGAAGATAGAAGAAATAGCTGCTAAAT-3' (SEQ ID NO: 9083)

5'-GAAGAUAGAAGAAAUAGCUGCUAAAUA-3' (SEQ ID NO: 13704)

3'-CUUCUAUCUUCUUUAUCGACGAUUUAU-5' (SEQ ID NO: 6774)

C5-2099 Target:
5'-GAAGATAGAAGAAATAGCTGCTAAATA-3' (SEQ ID NO: 9084)

5'-AAGAUAGAAGAAAUAGCUGCUAAAUAU-3' (SEQ ID NO: 13705)

3'-UUCUAUCUUCUUUAUCGACGAUUUAUA-5' (SEQ ID NO: 6775)

C5-2100 Target:
5'-AAGATAGAAGAAATAGCTGCTAAATAT-3' (SEQ ID NO: 9085)

5'-AGAUAGAAGAAAUAGCUGCUAAAUAUA-3' (SEQ ID NO: 13706)

3'-UCUAUCUUCUUUAUCGACGAUUUAUAU-5' (SEQ ID NO: 6776)

C5-2101 Target:
5'-AGATAGAAGAAATAGCTGCTAAATATA-3' (SEQ ID NO: 9086)

5'-GAUAGAAGAAAUAGCUGCUAAAUAUAA-3' (SEQ ID NO: 13707)

3'-CUAUCUUCUUUAUCGACGAUUUAUAUU-5' (SEQ ID NO: 6777)

C5-2102 Target:
5'-GATAGAAGAAATAGCTGCTAAATATAA-3' (SEQ ID NO: 9087)

5'-AUAGAAGAAAUAGCUGCUAAAUAUAAA-3' (SEQ ID NO: 13708)

3'-UAUCUUCUUUAUCGACGAUUUAUAUUU-5' (SEQ ID NO: 6778)

C5-2103 Target:
5'-ATAGAAGAAATAGCTGCTAAATATAAA-3' (SEQ ID NO: 9088)

5'-UAGAAGAAAUAGCUGCUAAAUAUAAAC-3' (SEQ ID NO: 13709)

3'-AUCUUCUUUAUCGACGAUUUAUAUUUG-5' (SEQ ID NO: 6779)

C5-2104 Target:
5'-TAGAAGAAATAGCTGCTAAATATAAAC-3' (SEQ ID NO: 9089)

5'-AGAAGAAAUAGCUGCUAAAUAUAAACA-3' (SEQ ID NO: 13710)

3'-UCUUCUUUAUCGACGAUUUAUAUUUGU-5' (SEQ ID NO: 6780)

C5-2105 Target:
5'-AGAAGAAATAGCTGCTAAATATAAACA-3' (SEQ ID NO: 9090)

5'-GAAGAAAUAGCUGCUAAAUAUAAACAU-3' (SEQ ID NO: 13711)

3'-CUUCUUUAUCGACGAUUUAUAUUUGUA-5' (SEQ ID NO: 6781)

C5-2106 Target:
5'-GAAGAAATAGCTGCTAAATATAAACAT-3' (SEQ ID NO: 9091)

5'-AAGAAAUAGCUGCUAAAUAUAAACAUU-3' (SEQ ID NO: 13712)

3'-UUCUUUAUCGACGAUUUAUAUUUGUAA-5' (SEQ ID NO: 6782)

TABLE 9-continued

"Blunt/Blunt" DsiRNAs Corresponding to Human Anti-C5 DsiRNAs Predicted to have >50% Knockdown Efficacy C5-2107 Target:
5'-AAGAAATAGCTGCTAAATATAAACATT-3' (SEQ ID NO: 9092)

5'-AGAAAUAGCUGCUAAAUAUAAACAUUC-3' (SEQ ID NO: 13713)

3'-UCUUUAUCGACGAUUUAUAUUUGUAAG-5' (SEQ ID NO: 6783)

C5-2108 Target:
5'-AGAAATAGCTGCTAAATATAAACATTC-3' (SEQ ID NO: 9093)

5'-GAAAUAGCUGCUAAAUAUAAACAUUCA-3' (SEQ ID NO: 13714)

3'-CUUUAUCGACGAUUUAUAUUUGUAAGU-5' (SEQ ID NO: 6784)

C5-2109 Target:
5'-GAAATAGCTGCTAAATATAAACATTCA-3' (SEQ ID NO: 9094)

5'-AAAUAGCUGCUAAAUAUAAACAUUCAG-3' (SEQ ID NO: 13715)

3'-UUUAUCGACGAUUUAUAUUUGUAAGUC-5' (SEQ ID NO: 6785)

C5-2110 Target:
5'-AAATAGCTGCTAAATATAAACATTCAG-3' (SEQ ID NO: 9095)

5'-AAUAGCUGCUAAAUAUAAACAUUCAGU-3' (SEQ ID NO: 13716)

3'-UUAUCGACGAUUUAUAUUUGUAAGUCA-5' (SEQ ID NO: 6786)

C5-2111 Target:
5'-AATAGCTGCTAAATATAAACATTCAGT-3' (SEQ ID NO: 9096)

5'-AUAGCUGCUAAAUAUAAACAUUCAGUA-3' (SEQ ID NO: 13717)

3'-UAUCGACGAUUUAUAUUUGUAAGUCAU-5' (SEQ ID NO: 6787)

C5-2112 Target:
5'-ATAGCTGCTAAATATAAACATTCAGTA-3' (SEQ ID NO: 9097)

5'-UAGCUGCUAAAUAUAAACAUUCAGUAG-3' (SEQ ID NO: 13718)

3'-AUCGACGAUUUAUAUUUGUAAGUCAUC-5' (SEQ ID NO: 6788)

C5-2113 Target:
5'-TAGCTGCTAAATATAAACATTCAGTAG-3' (SEQ ID NO: 9098)

5'-AGUAGUGAAGAAAUGUUGUUACGAUGG-3' (SEQ ID NO: 13719)

3'-UCAUCACUUCUUUACAACAAUGCUACC-5' (SEQ ID NO: 6789)

C5-2135 Target:
5'-AGTAGTGAAGAAATGTTGTTACGATGG-3' (SEQ ID NO: 9099)

5'-GUAGUGAAGAAAUGUUGUUACGAUGGA-3' (SEQ ID NO: 13720)

3'-CAUCACUUCUUUACAACAAUGCUACCU-5' (SEQ ID NO: 6790)

C5-2136 Target:
5'-GTAGTGAAGAAATGTTGTTACGATGGA-3' (SEQ ID NO: 9100)

5'-UAGUGAAGAAAUGUUGUUACGAUGGAG-3' (SEQ ID NO: 13721)

3'-AUCACUUCUUUACAACAAUGCUACCUC-5' (SEQ ID NO: 6791)

C5-2137 Target:
5'-TAGTGAAGAAATGTTGTTACGATGGAG-3' (SEQ ID NO: 9101)

5'-AGUGAAGAAAUGUUGUUACGAUGGAGC-3' (SEQ ID NO: 13722)

3'-UCACUUCUUUACAACAAUGCUACCUCG-5' (SEQ ID NO: 6792)

C5-2138 Target:
5'-AGTGAAGAAATGTTGTTACGATGGAGC-3' (SEQ ID NO: 9102)

5'-GUGAAGAAAUGUUGUUACGAUGGAGCC-3' (SEQ ID NO: 13723)

3'-CACUUCUUUACAACAAUGCUACCUCGG-5' (SEQ ID NO: 6793)

C5-2139 Target:
5'-GTGAAGAAATGTTGTTACGATGGAGCC-3' (SEQ ID NO: 9103)

5'-UGAAGAAAUGUUGUUACGAUGGAGCCU-3' (SEQ ID NO: 13724)

3'-ACUUCUUUACAACAAUGCUACCUCGGA-5' (SEQ ID NO: 6794)

C5-2140 Target:
5'-TGAAGAAATGTTGTTACGATGGAGCCT-3' (SEQ ID NO: 9104)

5'-GAAGAAAUGUUGUUACGAUGGAGCCUG-3' (SEQ ID NO: 13725)

3'-CUUCUUUACAACAAUGCUACCUCGGAC-5' (SEQ ID NO: 6795)

C5-2141 Target:
5'-GAAGAAATGTTGTTACGATGGAGCCTG-3' (SEQ ID NO: 9105)

5'-AAGAAAUGUUGUUACGAUGGAGCCUGC-3' (SEQ ID NO: 13726)

3'-UUCUUUACAACAAUGCUACCUCGGACG-5' (SEQ ID NO: 6796)

C5-2142 Target:
5'-AAGAAATGTTGTTACGATGGAGCCTGC-3' (SEQ ID NO: 9106)

5'-AGAAAUGUUGUUACGAUGGAGCCUGCG-3' (SEQ ID NO: 13727)

3'-UCUUUACAACAAUGCUACCUCGGACGC-5' (SEQ ID NO: 6797)

C5-2143 Target:
5'-AGAAATGTTGTTACGATGGAGCCTGCG-3' (SEQ ID NO: 9107)

5'-UAAUGAUGAAACCUGUGAGCAGCGAGC-3' (SEQ ID NO: 13728)

3'-AUUACUACUUUGGACACUCGUCGCUCG-5' (SEQ ID NO: 6798)

C5-2174 Target:
5'-TAATGATGAAACCTGTGAGCAGCGAGC-3' (SEQ ID NO: 9108)

5'-AAUGAUGAAACCUGUGAGCAGCGAGCU-3' (SEQ ID NO: 13729)

3'-UUACUACUUUGGACACUCGUCGCUCGA-5' (SEQ ID NO: 6799)

C5-2175 Target:
5'-AATGATGAAACCTGTGAGCAGCGAGCT-3' (SEQ ID NO: 9109)

5'-AUGAUGAAACCUGUGAGCAGCGAGCUG-3' (SEQ ID NO: 13730)

3'-UACUACUUUGGACACUCGUCGCUCGAC-5' (SEQ ID NO: 6800)

C5-2176 Target:
5'-ATGATGAAACCTGTGAGCAGCGAGCTG-3' (SEQ ID NO: 9110)

5'-UGAUGAAACCUGUGAGCAGCGAGCUGC-3' (SEQ ID NO: 13731)

3'-ACUACUUUGGACACUCGUCGCUCGACG-5' (SEQ ID NO: 6801)

C5-2177 Target:
5'-TGATGAAACCTGTGAGCAGCGAGCTGC-3' (SEQ ID NO: 9111)

5'-GAUGAAACCUGUGAGCAGCGAGCUGCA-3' (SEQ ID NO: 13732)

3'-CUACUUUGGACACUCGUCGCUCGACGU-5' (SEQ ID NO: 6802)

TABLE 9-continued

"Blunt/Blunt" DsiRNAs Corresponding to Human Anti-C5 DsiRNAs Predicted to have >50% Knockdown Efficacy C5-2178 Target:
5'-GATGAAACCTGTGAGCAGCGAGCTGCA-3' (SEQ ID NO: 9112)

5'-AUGAAACCUGUGAGCAGCGAGCUGCAC-3' (SEQ ID NO: 13733)

3'-UACUUUGGACACUCGUCGCUCGACGUG-5' (SEQ ID NO: 6803)

C5-2179 Target:
5'-ATGAAACCTGTGAGCAGCGAGCTGCAC-3' (SEQ ID NO: 9113)

5'-UGAAACCUGUGAGCAGCGAGCUGCACG-3' (SEQ ID NO: 13734)

3'-ACUUUGGACACUCGUCGCUCGACGUGC-5' (SEQ ID NO: 6804)

C5-2180 Target:
5'-TGAAACCTGTGAGCAGCGAGCTGCACG-3' (SEQ ID NO: 9114)

5'-AACCUGUGAGCAGCGAGCUGCACGGAU-3' (SEQ ID NO: 13735)

3'-UUGGACACUCGUCGCUCGACGUGCCUA-5' (SEQ ID NO: 6805)

C5-2183 Target:
5'-AACCTGTGAGCAGCGAGCTGCACGGAT-3' (SEQ ID NO: 9115)

5'-ACCUGUGAGCAGCGAGCUGCACGGAUU-3' (SEQ ID NO: 13736)

3'-UGGACACUCGUCGCUCGACGUGCCUAA-5' (SEQ ID NO: 6806)

C5-2184 Target:
5'-ACCTGTGAGCAGCGAGCTGCACGGATT-3' (SEQ ID NO: 9116)

5'-CCUGUGAGCAGCGAGCUGCACGGAUUA-3' (SEQ ID NO: 13737)

3'-GGACACUCGUCGCUCGACGUGCCUAAU-5' (SEQ ID NO: 6807)

C5-2185 Target:
5'-CCTGTGAGCAGCGAGCTGCACGGATTA-3' (SEQ ID NO: 9117)

5'-CUGUGAGCAGCGAGCUGCACGGAUUAG-3' (SEQ ID NO: 13738)

3'-GACACUCGUCGCUCGACGUGCCUAAUC-5' (SEQ ID NO: 6808)

C5-2186 Target:
5'-CTGTGAGCAGCGAGCTGCACGGATTAG-3' (SEQ ID NO: 9118)

5'-UGUGAGCAGCGAGCUGCACGGAUUAGU-3' (SEQ ID NO: 13739)

3'-ACACUCGUCGCUCGACGUGCCUAAUCA-5' (SEQ ID NO: 6809)

C5-2187 Target:
5'-TGTGAGCAGCGAGCTGCACGGATTAGT-3' (SEQ ID NO: 9119)

5'-GUGAGCAGCGAGCUGCACGGAUUAGUU-3' (SEQ ID NO: 13740)

3'-CACUCGUCGCUCGACGUGCCUAAUCAA-5' (SEQ ID NO: 6810)

C5-2188 Target:
5'-GTGAGCAGCGAGCTGCACGGATTAGTT-3' (SEQ ID NO: 9120)

5'-UGAGCAGCGAGCUGCACGGAUUAGUUU-3' (SEQ ID NO: 13741)

3'-ACUCGUCGCUCGACGUGCCUAAUCAAA-5' (SEQ ID NO: 6811)

C5-2189 Target:
5'-TGAGCAGCGAGCTGCACGGATTAGTTT-3' (SEQ ID NO: 9121)

5'-GAGCAGCGAGCUGCACGGAUUAGUUUA-3' (SEQ ID NO: 13742)

3'-CUCGUCGCUCGACGUGCCUAAUCAAAU-5' (SEQ ID NO: 6812)

C5-2190 Target:
5'-GAGCAGCGAGCTGCACGGATTAGTTTA-3' (SEQ ID NO: 9122)

5'-AGCAGCGAGCUGCACGGAUUAGUUUAG-3' (SEQ ID NO: 13743)

3'-UCGUCGCUCGACGUGCCUAAUCAAAUC-5' (SEQ ID NO: 6813)

C5-2191 Target:
5'-AGCAGCGAGCTGCACGGATTAGTTTAG-3' (SEQ ID NO: 9123)

5'-GCAGCGAGCUGCACGGAUUAGUUUAGG-3' (SEQ ID NO: 13744)

3'-CGUCGCUCGACGUGCCUAAUCAAAUCC-5' (SEQ ID NO: 6814)

C5-2192 Target:
5'-GCAGCGAGCTGCACGGATTAGTTTAGG-3' (SEQ ID NO: 9124)

5'-CAGCGAGCUGCACGGAUUAGUUUAGGG-3' (SEQ ID NO: 13745)

3'-GUCGCUCGACGUGCCUAAUCAAAUCCC-5' (SEQ ID NO: 6815)

C5-2193 Target:
5'-CAGCGAGCTGCACGGATTAGTTTAGGG-3' (SEQ ID NO: 9125)

5'-GUGUCGUCGCAAGCCAGCUCCGUGCUA-3' (SEQ ID NO: 13746)

3'-CACAGCAGCGUUCGGUCGAGGCACGAU-5' (SEQ ID NO: 6816)

C5-2251 Target:
5'-GTGTCGTCGCAAGCCAGCTCCGTGCTA-3' (SEQ ID NO: 9126)

5'-UGUCGUCGCAAGCCAGCUCCGUGCUAA-3' (SEQ ID NO: 13747)

3'-ACAGCAGCGUUCGGUCGAGGCACGAUU-5' (SEQ ID NO: 6817)

C5-2252 Target:
5'-TGTCGTCGCAAGCCAGCTCCGTGCTAA-3' (SEQ ID NO: 9127)

5'-GUCGUCGCAAGCCAGCUCCGUGCUAAU-3' (SEQ ID NO: 13748)

3'-CAGCAGCGUUCGGUCGAGGCACGAUUA-5' (SEQ ID NO: 6818)

C5-2253 Target:
5'-GTCGTCGCAAGCCAGCTCCGTGCTAAT-3' (SEQ ID NO: 9128)

5'-UCGUCGCAAGCCAGCUCCGUGCUAAUA-3' (SEQ ID NO: 13749)

3'-AGCAGCGUUCGGUCGAGGCACGAUUAU-5' (SEQ ID NO: 6819)

C5-2254 Target:
5'-TCGTCGCAAGCCAGCTCCGTGCTAATA-3' (SEQ ID NO: 9129)

5'-CGUCGCAAGCCAGCUCCGUGCUAAUAU-3' (SEQ ID NO: 13750)

3'-GCAGCGUUCGGUCGAGGCACGAUUAUA-5' (SEQ ID NO: 6820)

C5-2255 Target:
5'-CGTCGCAAGCCAGCTCCGTGCTAATAT-3' (SEQ ID NO: 9130)

5'-GUCGCAAGCCAGCUCCGUGCUAAUAUC-3' (SEQ ID NO: 13751)

3'-CAGCGUUCGGUCGAGGCACGAUUAUAG-5' (SEQ ID NO: 6821)

C5-2256 Target:
5'-GTCGCAAGCCAGCTCCGTGCTAATATC-3' (SEQ ID NO: 9131)

5'-UCGCAAGCCAGCUCCGUGCUAAUAUCU-3' (SEQ ID NO: 13752)

3'-AGCGUUCGGUCGAGGCACGAUUAUAGA-5' (SEQ ID NO: 6822)

TABLE 9-continued

"Blunt/Blunt" DsiRNAs Corresponding to Human Anti-C5 DsiRNAs Predicted to have >50% Knockdown Efficacy C5-2257 Target:
5'-TCGCAAGCCAGCTCCGTGCTAATATCT-3' (SEQ ID NO: 9132)

5'-CGCAAGCCAGCUCCGUGCUAAUAUCUC-3' (SEQ ID NO: 13753)

3'-GCGUUCGGUCGAGGCACGAUUAUAGAG-5' (SEQ ID NO: 6823)

C5-2258 Target:
5'-CGCAAGCCAGCTCCGTGCTAATATCTC-3' (SEQ ID NO: 9133)

5'-GCAAGCCAGCUCCGUGCUAAUAUCUCU-3' (SEQ ID NO: 13754)

3'-CGUUCGGUCGAGGCACGAUUAUAGAGA-5' (SEQ ID NO: 6824)

C5-2259 Target:
5'-GCAAGCCAGCTCCGTGCTAATATCTCT-3' (SEQ ID NO: 9134)

5'-CAAGCCAGCUCCGUGCUAAUAUCUCUC-3' (SEQ ID NO: 13755)

3'-GUUCGGUCGAGGCACGAUUAUAGAGAG-5' (SEQ ID NO: 6825)

C5-2260 Target:
5'-CAAGCCAGCTCCGTGCTAATATCTCTC-3' (SEQ ID NO: 9135)

5'-CACAUGAAGACCCUGUUACCAGUAAGC-3' (SEQ ID NO: 13756)

3'-GUGUACUUCUGGGACAAUGGUCAUUCG-5' (SEQ ID NO: 6826)

C5-2313 Target:
5'-CACATGAAGACCCTGTTACCAGTAAGC-3' (SEQ ID NO: 9136)

5'-ACAUGAAGACCCUGUUACCAGUAAGCA-3' (SEQ ID NO: 13757)

3'-UGUACUUCUGGGACAAUGGUCAUUCGU-5' (SEQ ID NO: 6827)

C5-2314 Target:
5'-ACATGAAGACCCTGTTACCAGTAAGCA-3' (SEQ ID NO: 9137)

5'-CAUGAAGACCCUGUUACCAGUAAGCAA-3' (SEQ ID NO: 13758)

3'-GUACUUCUGGGACAAUGGUCAUUCGUU-5' (SEQ ID NO: 6828)

C5-2315 Target:
5'-CATGAAGACCCTGTTACCAGTAAGCAA-3' (SEQ ID NO: 9138)

5'-UGAAGACCCUGUUACCAGUAAGCAAGC-3' (SEQ ID NO: 13759)

3'-ACUUCUGGGACAAUGGUCAUUCGUUCG-5' (SEQ ID NO: 6829)

C5-2317 Target:
5'-TGAAGACCCTGTTACCAGTAAGCAAGC-3' (SEQ ID NO: 9139)

5'-GAAGACCCUGUUACCAGUAAGCAAGCC-3' (SEQ ID NO: 13760)

3'-CUUCUGGGACAAUGGUCAUUCGUUCGG-5' (SEQ ID NO: 6830)

C5-2318 Target:
5'-GAAGACCCTGTTACCAGTAAGCAAGCC-3' (SEQ ID NO: 9140)

5'-AAGACCCUGUUACCAGUAAGCAAGCCA-3' (SEQ ID NO: 13761)

3'-UUCUGGGACAAUGGUCAUUCGUUCGGU-5' (SEQ ID NO: 6831)

C5-2319 Target:
5'-AAGACCCTGTTACCAGTAAGCAAGCCA-3' (SEQ ID NO: 9141)

5'-AGACCCUGUUACCAGUAAGCAAGCCAG-3' (SEQ ID NO: 13762)

3'-UCUGGGACAAUGGUCAUUCGUUCGGUC-5' (SEQ ID NO: 6832)

C5-2320 Target:
5'-AGACCCTGTTACCAGTAAGCAAGCCAG-3' (SEQ ID NO: 9142)

5'-GACCCUGUUACCAGUAAGCAAGCCAGA-3' (SEQ ID NO: 13763)

3'-CUGGGACAAUGGUCAUUCGUUCGGUCU-5' (SEQ ID NO: 6833)

C5-2321 Target:
5'-GACCCTGTTACCAGTAAGCAAGCCAGA-3' (SEQ ID NO: 9143)

5'-ACCCUGUUACCAGUAAGCAAGCCAGAA-3' (SEQ ID NO: 13764)

3'-UGGGACAAUGGUCAUUCGUUCGGUCUU-5' (SEQ ID NO: 6834)

C5-2322 Target:
5'-ACCCTGTTACCAGTAAGCAAGCCAGAA-3' (SEQ ID NO: 9144)

5'-CCCUGUUACCAGUAAGCAAGCCAGAAA-3' (SEQ ID NO: 13765)

3'-GGGACAAUGGUCAUUCGUUCGGUCUUU-5' (SEQ ID NO: 6835)

C5-2323 Target:
5'-CCCTGTTACCAGTAAGCAAGCCAGAAA-3' (SEQ ID NO: 9145)

5'-CCUGUUACCAGUAAGCAAGCCAGAAAU-3' (SEQ ID NO: 13766)

3'-GGACAAUGGUCAUUCGUUCGGUCUUUA-5' (SEQ ID NO: 6836)

C5-2324 Target:
5'-CCTGTTACCAGTAAGCAAGCCAGAAAT-3' (SEQ ID NO: 9146)

5'-CUGUUACCAGUAAGCAAGCCAGAAAUU-3' (SEQ ID NO: 13767)

3'-GACAAUGGUCAUUCGUUCGGUCUUUAA-5' (SEQ ID NO: 6837)

C5-2325 Target:
5'-CTGTTACCAGTAAGCAAGCCAGAAATT-3' (SEQ ID NO: 9147)

5'-UGUUACCAGUAAGCAAGCCAGAAAUUC-3' (SEQ ID NO: 13768)

3'-ACAAUGGUCAUUCGUUCGGUCUUUAAG-5' (SEQ ID NO: 6838)

C5-2326 Target:
5'-TGTTACCAGTAAGCAAGCCAGAAATTC-3' (SEQ ID NO: 9148)

5'-GUUACCAGUAAGCAAGCCAGAAAUUCG-3' (SEQ ID NO: 13769)

3'-CAAUGGUCAUUCGUUCGGUCUUUAAGC-5' (SEQ ID NO: 6839)

C5-2327 Target:
5'-GTTACCAGTAAGCAAGCCAGAAATTCG-3' (SEQ ID NO: 9149)

5'-UUACCAGUAAGCAAGCCAGAAAUUCGG-3' (SEQ ID NO: 13770)

3'-AAUGGUCAUUCGUUCGGUCUUUAAGCC-5' (SEQ ID NO: 6840)

C5-2328 Target:
5'-TTACCAGTAAGCAAGCCAGAAATTCGG-3' (SEQ ID NO: 9150)

5'-UACCAGUAAGCAAGCCAGAAAUUCGGA-3' (SEQ ID NO: 13771)

3'-AUGGUCAUUCGUUCGGUCUUUAAGCCU-5' (SEQ ID NO: 6841)

C5-2329 Target:
5'-TACCAGTAAGCAAGCCAGAAATTCGGA-3' (SEQ ID NO: 9151)

5'-ACCAGUAAGCAAGCCAGAAAUUCGGAG-3' (SEQ ID NO: 13772)

3'-UGGUCAUUCGUUCGGUCUUUAAGCCUC-5' (SEQ ID NO: 6842)

TABLE 9-continued

"Blunt/Blunt" DsiRNAs Corresponding to Human Anti-C5 DsiRNAs Predicted to have >50% Knockdown Efficacy C5-2330 Target:
5'-ACCAGTAAGCAAGCCAGAAATTCGGAG-3' (SEQ ID NO: 9152)

5'-CCAGUAAGCAAGCCAGAAAUUCGGAGU-3' (SEQ ID NO: 13773)

3'-GGUCAUUCGUUCGGUCUUUAAGCCUCA-5' (SEQ ID NO: 6843)

C5-2331 Target:
5'-CCAGTAAGCAAGCCAGAAATTCGGAGT-3' (SEQ ID NO: 9153)

5'-CAGUAAGCAAGCCAGAAAUUCGGAGUU-3' (SEQ ID NO: 13774)

3'-GUCAUUCGUUCGGUCUUUAAGCCUCAA-5' (SEQ ID NO: 6844)

C5-2332 Target:
5'-CAGTAAGCAAGCCAGAAATTCGGAGTT-3' (SEQ ID NO: 9154)

5'-AGUAAGCAAGCCAGAAAUUCGGAGUUA-3' (SEQ ID NO: 13775)

3'-UCAUUCGUUCGGUCUUUAAGCCUCAAU-5' (SEQ ID NO: 6845)

C5-2333 Target:
5'-AGTAAGCAAGCCAGAAATTCGGAGTTA-3' (SEQ ID NO: 9155)

5'-GUAAGCAAGCCAGAAAUUCGGAGUUAU-3' (SEQ ID NO: 13776)

3'-CAUUCGUUCGGUCUUUAAGCCUCAAUA-5' (SEQ ID NO: 6846)

C5-2334 Target:
5'-GTAAGCAAGCCAGAAATTCGGAGTTAT-3' (SEQ ID NO: 9156)

5'-UAAGCAAGCCAGAAAUUCGGAGUUAUU-3' (SEQ ID NO: 13777)

3'-AUUCGUUCGGUCUUUAAGCCUCAAUAA-5' (SEQ ID NO: 6847)

C5-2335 Target:
5'-TAAGCAAGCCAGAAATTCGGAGTTATT-3' (SEQ ID NO: 9157)

5'-AAGCAAGCCAGAAAUUCGGAGUUAUUU-3' (SEQ ID NO: 13778)

3'-UUCGUUCGGUCUUUAAGCCUCAAUAAA-5' (SEQ ID NO: 6848)

C5-2336 Target:
5'-AAGCAAGCCAGAAATTCGGAGTTATTT-3' (SEQ ID NO: 9158)

5'-GCAAGCCAGAAAUUCGGAGUUAUUUUC-3' (SEQ ID NO: 13779)

3'-CGUUCGGUCUUUAAGCCUCAAUAAAAG-5' (SEQ ID NO: 6849)

C5-2338 Target:
5'-GCAAGCCAGAAATTCGGAGTTATTTTC-3' (SEQ ID NO: 9159)

5'-CAAGCCAGAAAUUCGGAGUUAUUUUCC-3' (SEQ ID NO: 13780)

3'-GUUCGGUCUUUAAGCCUCAAUAAAAGG-5' (SEQ ID NO: 6850)

C5-2339 Target:
5'-CAAGCCAGAAATTCGGAGTTATTTTCC-3' (SEQ ID NO: 9160)

5'-AAGCCAGAAAUUCGGAGUUAUUUUCCA-3' (SEQ ID NO: 13781)

3'-UUCGGUCUUUAAGCCUCAAUAAAAGGU-5' (SEQ ID NO: 6851)

C5-2340 Target:
5'-AAGCCAGAAATTCGGAGTTATTTTCCA-3' (SEQ ID NO: 9161)

5'-AGCCAGAAAUUCGGAGUUAUUUUCCAG-3' (SEQ ID NO: 13782)

3'-UCGGUCUUUAAGCCUCAAUAAAAGGUC-5' (SEQ ID NO: 6852)

TABLE 9-continued

"Blunt/Blunt" DsiRNAs Corresponding to Human Anti-C5 DsiRNAs Predicted to have >50% Knockdown Efficacy C5-2341 Target:
5'-AGCCAGAAATTCGGAGTTATTTTCCAG-3' (SEQ ID NO: 9162)

5'-GCCAGAAAUUCGGAGUUAUUUUCCAGA-3' (SEQ ID NO: 13783)

3'-CGGUCUUUAAGCCUCAAUAAAAGGUCU-5' (SEQ ID NO: 6853)

C5-2342 Target:
5'-GCCAGAAATTCGGAGTTATTTTCCAGA-3' (SEQ ID NO: 9163)

5'-CCAGAAAUUCGGAGUUAUUUUCCAGAA-3' (SEQ ID NO: 13784)

3'-GGUCUUUAAGCCUCAAUAAAAGGUCUU-5' (SEQ ID NO: 6854)

C5-2343 Target:
5'-CCAGAAATTCGGAGTTATTTTCCAGAA-3' (SEQ ID NO: 9164)

5'-CAGAAAUUCGGAGUUAUUUUCCAGAAA-3' (SEQ ID NO: 13785)

3'-GUCUUUAAGCCUCAAUAAAAGGUCUUU-5' (SEQ ID NO: 6855)

C5-2344 Target:
5'-CAGAAATTCGGAGTTATTTTCCAGAAA-3' (SEQ ID NO: 9165)

5'-AGAAAUUCGGAGUUAUUUUCCAGAAAG-3' (SEQ ID NO: 13786)

3'-UCUUUAAGCCUCAAUAAAAGGUCUUUC-5' (SEQ ID NO: 6856)

C5-2345 Target:
5'-AGAAATTCGGAGTTATTTTCCAGAAAG-3' (SEQ ID NO: 9166)

5'-GAAAUUCGGAGUUAUUUUCCAGAAAGC-3' (SEQ ID NO: 13787)

3'-CUUUAAGCCUCAAUAAAAGGUCUUUCG-5' (SEQ ID NO: 6857)

C5-2346 Target:
5'-GAAATTCGGAGTTATTTTCCAGAAAGC-3' (SEQ ID NO: 9167)

5'-AAAUUCGGAGUUAUUUUCCAGAAAGCU-3' (SEQ ID NO: 13788)

3'-UUUAAGCCUCAAUAAAAGGUCUUUCGA-5' (SEQ ID NO: 6858)

C5-2347 Target:
5'-AAATTCGGAGTTATTTTCCAGAAAGCT-3' (SEQ ID NO: 9168)

5'-AAUUCGGAGUUAUUUUCCAGAAAGCUG-3' (SEQ ID NO: 13789)

3'-UUAAGCCUCAAUAAAAGGUCUUUCGAC-5' (SEQ ID NO: 6859)

C5-2348 Target:
5'-AATTCGGAGTTATTTTCCAGAAAGCTG-3' (SEQ ID NO: 9169)

5'-AUUCGGAGUUAUUUUCCAGAAAGCUGG-3' (SEQ ID NO: 13790)

3'-UAAGCCUCAAUAAAAGGUCUUUCGACC-5' (SEQ ID NO: 6860)

C5-2349 Target:
5'-ATTCGGAGTTATTTTCCAGAAAGCTGG-3' (SEQ ID NO: 9170)

5'-UUCGGAGUUAUUUUCCAGAAAGCUGGU-3' (SEQ ID NO: 13791)

3'-AAGCCUCAAUAAAAGGUCUUUCGACCA-5' (SEQ ID NO: 6861)

C5-2350 Target:
5'-TTCGGAGTTATTTTCCAGAAAGCTGGT-3' (SEQ ID NO: 9171)

5'-UCGGAGUUAUUUUCCAGAAAGCUGGUU-3' (SEQ ID NO: 13792)

3'-AGCCUCAAUAAAAGGUCUUUCGACCAA-5' (SEQ ID NO: 6862)

TABLE 9-continued

"Blunt/Blunt" DsiRNAs Corresponding to Human Anti-C5 DsiRNAs Predicted to have >50% Knockdown Efficacy C5-2351 Target:
5'-TCGGAGTTATTTTCCAGAAAGCTGGTT-3' (SEQ ID NO: 9172)

5'-CGGAGUUAUUUUCCAGAAAGCUGGUUG-3' (SEQ ID NO: 13793)

3'-GCCUCAAUAAAAGGUCUUUCGACCAAC-5' (SEQ ID NO: 6863)

C5-2352 Target:
5'-CGGAGTTATTTTCCAGAAAGCTGGTTG-3' (SEQ ID NO: 9173)

5'-GGAGUUAUUUUCCAGAAAGCUGGUUGU-3' (SEQ ID NO: 13794)

3'-CCUCAAUAAAAGGUCUUUCGACCAACA-5' (SEQ ID NO: 6864)

C5-2353 Target:
5'-GGAGTTATTTTCCAGAAAGCTGGTTGT-3' (SEQ ID NO: 9174)

5'-GAGUUAUUUUCCAGAAAGCUGGUUGUG-3' (SEQ ID NO: 13795)

3'-CUCAAUAAAAGGUCUUUCGACCAACAC-5' (SEQ ID NO: 6865)

C5-2354 Target:
5'-GAGTTATTTTCCAGAAAGCTGGTTGTG-3' (SEQ ID NO: 9175)

5'-AGUUAUUUUCCAGAAAGCUGGUUGUGG-3' (SEQ ID NO: 13796)

3'-UCAAUAAAAGGUCUUUCGACCAACACC-5' (SEQ ID NO: 6866)

C5-2355 Target:
5'-AGTTATTTTCCAGAAAGCTGGTTGTGG-3' (SEQ ID NO: 9176)

5'-GUUAUUUUCCAGAAAGCUGGUUGUGGG-3' (SEQ ID NO: 13797)

3'-CAAUAAAAGGUCUUUCGACCAACACCC-5' (SEQ ID NO: 6867)

C5-2356 Target:
5'-GTTATTTTCCAGAAAGCTGGTTGTGGG-3' (SEQ ID NO: 9177)

5'-UUAUUUUCCAGAAAGCUGGUUGUGGGA-3' (SEQ ID NO: 13798)

3'-AAUAAAAGGUCUUUCGACCAACACCCU-5' (SEQ ID NO: 6868)

C5-2357 Target:
5'-TTATTTTCCAGAAAGCTGGTTGTGGGA-3' (SEQ ID NO: 9178)

5'-UGUGGGAAGUUCAUCUUGUUCCCAGAA-3' (SEQ ID NO: 13799)

3'-ACACCCUUCAAGUAGAACAAGGGUCUU-5' (SEQ ID NO: 6869)

C5-2377 Target:
5'-TGTGGGAAGTTCATCTTGTTCCCAGAA-3' (SEQ ID NO: 9179)

5'-GUGGGAAGUUCAUCUUGUUCCCAGAAG-3' (SEQ ID NO: 13800)

3'-CACCCUUCAAGUAGAACAAGGGUCUUC-5' (SEQ ID NO: 6870)

C5-2378 Target:
5'-GTGGGAAGTTCATCTTGTTCCCAGAAG-3' (SEQ ID NO: 9180)

5'-UGGGAAGUUCAUCUUGUUCCCAGAAGA-3' (SEQ ID NO: 13801)

3'-ACCCUUCAAGUAGAACAAGGGUCUUCU-5' (SEQ ID NO: 6871)

C5-2379 Target:
5'-TGGGAAGTTCATCTTGTTCCCAGAAGA-3' (SEQ ID NO: 9181)

5'-GGGAAGUUCAUCUUGUUCCCAGAAGAA-3' (SEQ ID NO: 13802)

3'-CCCUUCAAGUAGAACAAGGGUCUUCUU-5' (SEQ ID NO: 6872)

C5-2380 Target:
5'-GGGAAGTTCATCTTGTTCCCAGAAGAA-3' (SEQ ID NO: 9182)

5'-GGAAGUUCAUCUUGUUCCCAGAAGAAA-3' (SEQ ID NO: 13803)

3'-CCUUCAAGUAGAACAAGGGUCUUCUUU-5' (SEQ ID NO: 6873)

C5-2381 Target:
5'-GGAAGTTCATCTTGTTCCCAGAAGAAA-3' (SEQ ID NO: 9183)

5'-GAAGUUCAUCUUGUUCCCAGAAGAAAA-3' (SEQ ID NO: 13804)

3'-CUUCAAGUAGAACAAGGGUCUUCUUUU-5' (SEQ ID NO: 6874)

C5-2382 Target:
5'-GAAGTTCATCTTGTTCCCAGAAGAAAA-3' (SEQ ID NO: 9184)

5'-AAGUUCAUCUUGUUCCCAGAAGAAAAC-3' (SEQ ID NO: 13805)

3'-UUCAAGUAGAACAAGGGUCUUCUUUUG-5' (SEQ ID NO: 6875)

C5-2383 Target:
5'-AAGTTCATCTTGTTCCCAGAAGAAAAC-3' (SEQ ID NO: 9185)

5'-AGUUCAUCUUGUUCCCAGAAGAAAACA-3' (SEQ ID NO: 13806)

3'-UCAAGUAGAACAAGGGUCUUCUUUUGU-5' (SEQ ID NO: 6876)

C5-2384 Target:
5'-AGTTCATCTTGTTCCCAGAAGAAAACA-3' (SEQ ID NO: 9186)

5'-GUUCAUCUUGUUCCCAGAAGAAAACAG-3' (SEQ ID NO: 13807)

3'-CAAGUAGAACAAGGGUCUUCUUUUGUC-5' (SEQ ID NO: 6877)

C5-2385 Target:
5'-GTTCATCTTGTTCCCAGAAGAAAACAG-3' (SEQ ID NO: 9187)

5'-UUCAUCUUGUUCCCAGAAGAAAACAGU-3' (SEQ ID NO: 13808)

3'-AAGUAGAACAAGGGUCUUCUUUUGUCA-5' (SEQ ID NO: 6878)

C5-2386 Target:
5'-TTCATCTTGTTCCCAGAAGAAAACAGT-3' (SEQ ID NO: 9188)

5'-UCAUCUUGUUCCCAGAAGAAAACAGUU-3' (SEQ ID NO: 13809)

3'-AGUAGAACAAGGGUCUUCUUUUGUCAA-5' (SEQ ID NO: 6879)

C5-2387 Target:
5'-TCATCTTGTTCCCAGAAGAAAACAGTT-3' (SEQ ID NO: 9189)

5'-CAUCUUGUUCCCAGAAGAAAACAGUUG-3' (SEQ ID NO: 13810)

3'-GUAGAACAAGGGUCUUCUUUUGUCAAC-5' (SEQ ID NO: 6880)

C5-2388 Target:
5'-CATCTTGTTCCCAGAAGAAAACAGTTG-3' (SEQ ID NO: 9190)

5'-AUCUUGUUCCCAGAAGAAAACAGUUGC-3' (SEQ ID NO: 13811)

3'-UAGAACAAGGGUCUUCUUUUGUCAACG-5' (SEQ ID NO: 6881)

C5-2389 Target:
5'-ATCTTGTTCCCAGAAGAAAACAGTTGC-3' (SEQ ID NO: 9191)

5'-UCUUGUUCCCAGAAGAAAACAGUUGCA-3' (SEQ ID NO: 13812)

3'-AGAACAAGGGUCUUCUUUUGUCAACGU-5' (SEQ ID NO: 6882)

TABLE 9-continued

"Blunt/Blunt" DsiRNAs Corresponding to Human Anti-C5 DsiRNAs Predicted to have >50% Knockdown Efficacy C5-2390 Target:
5'-TCTTGTTCCCAGAAGAAAACAGTTGCA-3' (SEQ ID NO: 9192)

5'-CUUGUUCCCAGAAGAAAACAGUUGCAG-3' (SEQ ID NO: 13813)

3'-GAACAAGGGUCUUCUUUUGUCAACGUC-5' (SEQ ID NO: 6883)

C5-2391 Target:
5'-CTTGTTCCCAGAAGAAAACAGTTGCAG-3' (SEQ ID NO: 9193)

5'-UUGUUCCCAGAAGAAAACAGUUGCAGU-3' (SEQ ID NO: 13814)

3'-AACAAGGGUCUUCUUUUGUCAACGUCA-5' (SEQ ID NO: 6884)

C5-2392 Target:
5'-TTGTTCCCAGAAGAAAACAGTTGCAGT-3' (SEQ ID NO: 9194)

5'-UGUUCCCAGAAGAAAACAGUUGCAGUU-3' (SEQ ID NO: 13815)

3'-ACAAGGGUCUUCUUUUGUCAACGUCAA-5' (SEQ ID NO: 6885)

C5-2393 Target:
5'-TGTTCCCAGAAGAAAACAGTTGCAGTT-3' (SEQ ID NO: 9195)

5'-GUUCCCAGAAGAAAACAGUUGCAGUUU-3' (SEQ ID NO: 13816)

3'-CAAGGGUCUUCUUUUGUCAACGUCAAA-5' (SEQ ID NO: 6886)

C5-2394 Target:
5'-GTTCCCAGAAGAAAACAGTTGCAGTTT-3' (SEQ ID NO: 9196)

5'-UUCCCAGAAGAAAACAGUUGCAGUUUG-3' (SEQ ID NO: 13817)

3'-AAGGGUCUUCUUUUGUCAACGUCAAAC-5' (SEQ ID NO: 6887)

C5-2395 Target:
5'-TTCCCAGAAGAAAACAGTTGCAGTTTG-3' (SEQ ID NO: 9197)

5'-UCCCAGAAGAAAACAGUUGCAGUUUGC-3' (SEQ ID NO: 13818)

3'-AGGGUCUUCUUUUGUCAACGUCAAACG-5' (SEQ ID NO: 6888)

C5-2396 Target:
5'-TCCCAGAAGAAAACAGTTGCAGTTTGC-3' (SEQ ID NO: 9198)

5'-CCCAGAAGAAAACAGUUGCAGUUUGCC-3' (SEQ ID NO: 13819)

3'-GGGUCUUCUUUUGUCAACGUCAAACGG-5' (SEQ ID NO: 6889)

C5-2397 Target:
5'-CCCAGAAGAAAACAGTTGCAGTTTGCC-3' (SEQ ID NO: 9199)

5'-CCAGAAGAAAACAGUUGCAGUUUGCCC-3' (SEQ ID NO: 13820)

3'-GGUCUUCUUUUGUCAACGUCAAACGGG-5' (SEQ ID NO: 6890)

C5-2398 Target:
5'-CCAGAAGAAAACAGTTGCAGTTTGCCC-3' (SEQ ID NO: 9200)

5'-CAGAAGAAAACAGUUGCAGUUUGCCCU-3' (SEQ ID NO: 13821)

3'-GUCUUCUUUUGUCAACGUCAAACGGGA-5' (SEQ ID NO: 6891)

C5-2399 Target:
5'-CAGAAGAAAACAGTTGCAGTTTGCCCT-3' (SEQ ID NO: 9201)

5'-AGAAGAAAACAGUUGCAGUUUGCCCUA-3' (SEQ ID NO: 13822)

3'-UCUUCUUUUGUCAACGUCAAACGGGAU-5' (SEQ ID NO: 6892)

TABLE 9-continued

"Blunt/Blunt" DsiRNAs Corresponding to Human Anti-C5 DsiRNAs Predicted to have >50% Knockdown Efficacy C5-2400 Target:
5'-AGAAGAAAACAGTTGCAGTTTGCCCTA-3' (SEQ ID NO: 9202)

5'-GAAGAAAACAGUUGCAGUUUGCCCUAC-3' (SEQ ID NO: 13823)

3'-CUUCUUUUGUCAACGUCAAACGGGAUG-5' (SEQ ID NO: 6893)

C5-2401 Target:
5'-GAAGAAAACAGTTGCAGTTTGCCCTAC-3' (SEQ ID NO: 9203)

5'-AAGAAAACAGUUGCAGUUUGCCCUACC-3' (SEQ ID NO: 13824)

3'-UUCUUUUGUCAACGUCAAACGGGAUGG-5' (SEQ ID NO: 6894)

C5-2402 Target:
5'-AAGAAAACAGTTGCAGTTTGCCCTACC-3' (SEQ ID NO: 9204)

5'-AGAAAACAGUUGCAGUUUGCCCUACCU-3' (SEQ ID NO: 13825)

3'-UCUUUUGUCAACGUCAAACGGGAUGGA-5' (SEQ ID NO: 6895)

C5-2403 Target:
5'-AGAAAACAGTTGCAGTTTGCCCTACCT-3' (SEQ ID NO: 9205)

5'-GAAAACAGUUGCAGUUUGCCCUACCUG-3' (SEQ ID NO: 13826)

3'-CUUUUGUCAACGUCAAACGGGAUGGAC-5' (SEQ ID NO: 6896)

C5-2404 Target:
5'-GAAAACAGTTGCAGTTTGCCCTACCTG-3' (SEQ ID NO: 9206)

5'-AAAACAGUUGCAGUUUGCCCUACCUGA-3' (SEQ ID NO: 13827)

3'-UUUUGUCAACGUCAAACGGGAUGGACU-5' (SEQ ID NO: 6897)

C5-2405 Target:
5'-AAAACAGTTGCAGTTTGCCCTACCTGA-3' (SEQ ID NO: 9207)

5'-AAACAGUUGCAGUUUGCCCUACCUGAU-3' (SEQ ID NO: 13828)

3'-UUUGUCAACGUCAAACGGGAUGGACUA-5' (SEQ ID NO: 6898)

C5-2406 Target:
5'-AAACAGTTGCAGTTTGCCCTACCTGAT-3' (SEQ ID NO: 9208)

5'-AACAGUUGCAGUUUGCCCUACCUGAUU-3' (SEQ ID NO: 13829)

3'-UUGUCAACGUCAAACGGGAUGGACUAA-5' (SEQ ID NO: 6899)

C5-2407 Target:
5'-AACAGTTGCAGTTTGCCCTACCTGATT-3' (SEQ ID NO: 9209)

5'-ACAGUUGCAGUUUGCCCUACCUGAUUC-3' (SEQ ID NO: 13830)

3'-UGUCAACGUCAAACGGGAUGGACUAAG-5' (SEQ ID NO: 6900)

C5-2408 Target:
5'-ACAGTTGCAGTTTGCCCTACCTGATTC-3' (SEQ ID NO: 9210)

5'-CAGUUGCAGUUUGCCCUACCUGAUUCU-3' (SEQ ID NO: 13831)

3'-GUCAACGUCAAACGGGAUGGACUAAGA-5' (SEQ ID NO: 6901)

C5-2409 Target:
5'-CAGTTGCAGTTTGCCCTACCTGATTCT-3' (SEQ ID NO: 9211)

5'-AGUUGCAGUUUGCCCUACCUGAUUCUC-3' (SEQ ID NO: 13832)

3'-UCAACGUCAAACGGGAUGGACUAAGAG-5' (SEQ ID NO: 6902)

TABLE 9-continued

"Blunt/Blunt" DsiRNAs Corresponding to Human Anti-C5 DsiRNAs Predicted to have >50% Knockdown Efficacy C5-2410 Target:
5'-AGTTGCAGTTTGCCCTACCTGATTCTC-3' (SEQ ID NO: 9212)

5'-GUUGCAGUUUGCCCUACCUGAUUCUCU-3' (SEQ ID NO: 13833)

3'-CAACGUCAAACGGGAUGGACUAAGAGA-5' (SEQ ID NO: 6903)

C5-2411 Target:
5'-GTTGCAGTTTGCCCTACCTGATTCTCT-3' (SEQ ID NO: 9213)

5'-UUGCAGUUUGCCCUACCUGAUUCUCUA-3' (SEQ ID NO: 13834)

3'-AACGUCAAACGGGAUGGACUAAGAGAU-5' (SEQ ID NO: 6904)

C5-2412 Target:
5'-TTGCAGTTTGCCCTACCTGATTCTCTA-3' (SEQ ID NO: 9214)

5'-UGCAGUUUGCCCUACCUGAUUCUCUAA-3' (SEQ ID NO: 13835)

3'-ACGUCAAACGGGAUGGACUAAGAGAUU-5' (SEQ ID NO: 6905)

C5-2413 Target:
5'-TGCAGTTTGCCCTACCTGATTCTCTAA-3' (SEQ ID NO: 9215)

5'-GCAGUUUGCCCUACCUGAUUCUCUAAC-3' (SEQ ID NO: 13836)

3'-CGUCAAACGGGAUGGACUAAGAGAUUG-5' (SEQ ID NO: 6906)

C5-2414 Target:
5'-GCAGTTTGCCCTACCTGATTCTCTAAC-3' (SEQ ID NO: 9216)

5'-CAGUUUGCCCUACCUGAUUCUCUAACC-3' (SEQ ID NO: 13837)

3'-GUCAAACGGGAUGGACUAAGAGAUUGG-5' (SEQ ID NO: 6907)

C5-2415 Target:
5'-CAGTTTGCCCTACCTGATTCTCTAACC-3' (SEQ ID NO: 9217)

5'-AAGGCAAAGGUGUUCAAAGAUGUCUUC-3' (SEQ ID NO: 13838)

3'-UUCCGUUUCCACAAGUUUCUACAGAAG-5' (SEQ ID NO: 6908)

C5-2502 Target:
5'-AAGGCAAAGGTGTTCAAAGATGTCTTC-3' (SEQ ID NO: 9218)

5'-AGGCAAAGGUGUUCAAAGAUGUCUUCC-3' (SEQ ID NO: 13839)

3'-UCCGUUUCCACAAGUUUCUACAGAAGG-5' (SEQ ID NO: 6909)

C5-2503 Target:
5'-AGGCAAAGGTGTTCAAAGATGTCTTCC-3' (SEQ ID NO: 9219)

5'-GGCAAAGGUGUUCAAAGAUGUCUUCCU-3' (SEQ ID NO: 13840)

3'-CCGUUUCCACAAGUUUCUACAGAAGGA-5' (SEQ ID NO: 6910)

C5-2504 Target:
5'-GGCAAAGGTGTTCAAAGATGTCTTCCT-3' (SEQ ID NO: 9220)

5'-GCAAAGGUGUUCAAAGAUGUCUUCCUG-3' (SEQ ID NO: 13841)

3'-CGUUUCCACAAGUUUCUACAGAAGGAC-5' (SEQ ID NO: 6911)

C5-2505 Target:
5'-GCAAAGGTGTTCAAAGATGTCTTCCTG-3' (SEQ ID NO: 9221)

5'-CAAAGGUGUUCAAAGAUGUCUUCCUGG-3' (SEQ ID NO: 13842)

3'-GUUUCCACAAGUUUCUACAGAAGGACC-5' (SEQ ID NO: 6912)

C5-2506 Target:
5'-CAAAGGTGTTCAAAGATGTCTTCCTGG-3' (SEQ ID NO: 9222)

5'-AAAGGUGUUCAAAGAUGUCUUCCUGGA-3' (SEQ ID NO: 13843)

3'-UUUCCACAAGUUUCUACAGAAGGACCU-5' (SEQ ID NO: 6913)

C5-2507 Target:
5'-AAAGGTGTTCAAAGATGTCTTCCTGGA-3' (SEQ ID NO: 9223)

5'-AAGGUGUUCAAAGAUGUCUUCCUGGAA-3' (SEQ ID NO: 13844)

3'-UUCCACAAGUUUCUACAGAAGGACCUU-5' (SEQ ID NO: 6914)

C5-2508 Target:
5'-AAGGTGTTCAAAGATGTCTTCCTGGAA-3' (SEQ ID NO: 9224)

5'-AGGUGUUCAAAGAUGUCUUCCUGGAAA-3' (SEQ ID NO: 13845)

3'-UCCACAAGUUUCUACAGAAGGACCUUU-5' (SEQ ID NO: 6915)

C5-2509 Target:
5'-AGGTGTTCAAAGATGTCTTCCTGGAAA-3' (SEQ ID NO: 9225)

5'-GGUGUUCAAAGAUGUCUUCCUGGAAAU-3' (SEQ ID NO: 13846)

3'-CCACAAGUUUCUACAGAAGGACCUUUA-5' (SEQ ID NO: 6916)

C5-2510 Target:
5'-GGTGTTCAAAGATGTCTTCCTGGAAAT-3' (SEQ ID NO: 9226)

5'-GUGUUCAAAGAUGUCUUCCUGGAAAUG-3' (SEQ ID NO: 13847)

3'-CACAAGUUUCUACAGAAGGACCUUUAC-5' (SEQ ID NO: 6917)

C5-2511 Target:
5'-GTGTTCAAAGATGTCTTCCTGGAAATG-3' (SEQ ID NO: 9227)

5'-UGUUCAAAGAUGUCUUCCUGGAAAUGA-3' (SEQ ID NO: 13848)

3'-ACAAGUUUCUACAGAAGGACCUUUACU-5' (SEQ ID NO: 6918)

C5-2512 Target:
5'-TGTTCAAAGATGTCTTCCTGGAAATGA-3' (SEQ ID NO: 9228)

5'-GUUCAAAGAUGUCUUCCUGGAAAUGAA-3' (SEQ ID NO: 13849)

3'-CAAGUUUCUACAGAAGGACCUUUACUU-5' (SEQ ID NO: 6919)

C5-2513 Target:
5'-GTTCAAAGATGTCTTCCTGGAAATGAA-3' (SEQ ID NO: 9229)

5'-UUCAAAGAUGUCUUCCUGGAAAUGAAU-3' (SEQ ID NO: 13850)

3'-AAGUUUCUACAGAAGGACCUUUACUUA-5' (SEQ ID NO: 6920)

C5-2514 Target:
5'-TTCAAAGATGTCTTCCTGGAAATGAAT-3' (SEQ ID NO: 9230)

5'-UCAAAGAUGUCUUCCUGGAAAUGAAUA-3' (SEQ ID NO: 13851)

3'-AGUUUCUACAGAAGGACCUUUACUUAU-5' (SEQ ID NO: 6921)

C5-2515 Target:
5'-TCAAAGATGTCTTCCTGGAAATGAATA-3' (SEQ ID NO: 9231)

5'-CAAAGAUGUCUUCCUGGAAAUGAAUAU-3' (SEQ ID NO: 13852)

3'-GUUUCUACAGAAGGACCUUUACUUAUA-5' (SEQ ID NO: 6922)

TABLE 9-continued

"Blunt/Blunt" DsiRNAs Corresponding to Human Anti-C5
DsiRNAs Predicted to have >50% Knockdown Efficacy C5-2516 Target:
5'-CAAAGATGTCTTCCTGGAAATGAATAT-3' (SEQ ID NO: 9232)

5'-AAAGAUGUCUUCCUGGAAAUGAAUAUA-3' (SEQ ID NO: 13853)

3'-UUUCUACAGAAGGACCUUUACUUAUAU-5' (SEQ ID NO: 6923)

C5-2517 Target:
5'-AAAGATGTCTTCCTGGAAATGAATATA-3' (SEQ ID NO: 9233)

5'-AGAUGUCUUCCUGGAAAUGAAUAUACC-3' (SEQ ID NO: 13854)

3'-UCUACAGAAGGACCUUUACUUAUAUGG-5' (SEQ ID NO: 6924)

C5-2519 Target:
5'-AGATGTCTTCCTGGAAATGAATATACC-3' (SEQ ID NO: 9234)

5'-GAUGUCUUCCUGGAAAUGAAUAUACCA-3' (SEQ ID NO: 13855)

3'-CUACAGAAGGACCUUUACUUAUAUGGU-5' (SEQ ID NO: 6925)

C5-2520 Target:
5'-GATGTCTTCCTGGAAATGAATATACCA-3' (SEQ ID NO: 9235)

5'-AUGUCUUCCUGGAAAUGAAUAUACCAU-3' (SEQ ID NO: 13856)

3'-UACAGAAGGACCUUUACUUAUAUGGUA-5' (SEQ ID NO: 6926)

C5-2521 Target:
5'-ATGTCTTCCTGGAAATGAATATACCAT-3' (SEQ ID NO: 9236)

5'-UGUCUUCCUGGAAAUGAAUAUACCAUA-3' (SEQ ID NO: 13857)

3'-ACAGAAGGACCUUUACUUAUAUGGUAU-5' (SEQ ID NO: 6927)

C5-2522 Target:
5'-TGTCTTCCTGGAAATGAATATACCATA-3' (SEQ ID NO: 9237)

5'-GUCUUCCUGGAAAUGAAUAUACCAUAU-3' (SEQ ID NO: 13858)

3'-CAGAAGGACCUUUACUUAUAUGGUAUA-5' (SEQ ID NO: 6928)

C5-2523 Target:
5'-GTCTTCCTGGAAATGAATATACCATAT-3' (SEQ ID NO: 9238)

5'-UCUUCCUGGAAAUGAAUAUACCAUAUU-3' (SEQ ID NO: 13859)

3'-AGAAGGACCUUUACUUAUAUGGUAUAA-5' (SEQ ID NO: 6929)

C5-2524 Target:
5'-TCTTCCTGGAAATGAATATACCATATT-3' (SEQ ID NO: 9239)

5'-CUUCCUGGAAAUGAAUAUACCAUAUUC-3' (SEQ ID NO: 13860)

3'-GAAGGACCUUUACUUAUAUGGUAUAAG-5' (SEQ ID NO: 6930)

C5-2525 Target:
5'-CTTCCTGGAAATGAATATACCATATTC-3' (SEQ ID NO: 9240)

5'-UUCCUGGAAAUGAAUAUACCAUAUUCU-3' (SEQ ID NO: 13861)

3'-AAGGACCUUUACUUAUAUGGUAUAAGA-5' (SEQ ID NO: 6931)

C5-2526 Target:
5'-TTCCTGGAAATGAATATACCATATTCT-3' (SEQ ID NO: 9241)

5'-AAUAUACCAUAUUCUGUUGUACGAGGA-3' (SEQ ID NO: 13862)

3'-UUAUAUGGUAUAAGACAACAUGCUCCU-5' (SEQ ID NO: 6932)

C5-2538 Target:
5'-AATATACCATATTCTGTTGTACGAGGA-3' (SEQ ID NO: 9242)

5'-AUAUACCAUAUUCUGUUGUACGAGGAG-3' (SEQ ID NO: 13863)

3'-UAUAUGGUAUAAGACAACAUGCUCCUC-5' (SEQ ID NO: 6933)

C5-2539 Target:
5'-ATATACCATATTCTGTTGTACGAGGAG-3' (SEQ ID NO: 9243)

5'-UAUACCAUAUUCUGUUGUACGAGGAGA-3' (SEQ ID NO: 13864)

3'-AUAUGGUAUAAGACAACAUGCUCCUCU-5' (SEQ ID NO: 6934)

C5-2540 Target:
5'-TATACCATATTCTGTTGTACGAGGAGA-3' (SEQ ID NO: 9244)

5'-AUACCAUAUUCUGUUGUACGAGGAGAA-3' (SEQ ID NO: 13865)

3'-UAUGGUAUAAGACAACAUGCUCCUCUU-5' (SEQ ID NO: 6935)

C5-2541 Target:
5'-ATACCATATTCTGTTGTACGAGGAGAA-3' (SEQ ID NO: 9245)

5'-UACCAUAUUCUGUUGUACGAGGAGAAC-3' (SEQ ID NO: 13866)

3'-AUGGUAUAAGACAACAUGCUCCUCUUG-5' (SEQ ID NO: 6936)

C5-2542 Target:
5'-TACCATATTCTGTTGTACGAGGAGAAC-3' (SEQ ID NO: 9246)

5'-ACCAUAUUCUGUUGUACGAGGAGAACA-3' (SEQ ID NO: 13867)

3'-UGGUAUAAGACAACAUGCUCCUCUUGU-5' (SEQ ID NO: 6937)

C5-2543 Target:
5'-ACCATATTCTGTTGTACGAGGAGAACA-3' (SEQ ID NO: 9247)

5'-CCAUAUUCUGUUGUACGAGGAGAACAG-3' (SEQ ID NO: 13868)

3'-GGUAUAAGACAACAUGCUCCUCUUGUC-5' (SEQ ID NO: 6938)

C5-2544 Target:
5'-CCATATTCTGTTGTACGAGGAGAACAG-3' (SEQ ID NO: 9248)

5'-CAUAUUCUGUUGUACGAGGAGAACAGA-3' (SEQ ID NO: 13869)

3'-GUAUAAGACAACAUGCUCCUCUUGUCU-5' (SEQ ID NO: 6939)

C5-2545 Target:
5'-CATATTCTGTTGTACGAGGAGAACAGA-3' (SEQ ID NO: 9249)

5'-AUAUUCUGUUGUACGAGGAGAACAGAU-3' (SEQ ID NO: 13870)

3'-UAUAAGACAACAUGCUCCUCUUGUCUA-5' (SEQ ID NO: 6940)

C5-2546 Target:
5'-ATATTCTGTTGTACGAGGAGAACAGAT-3' (SEQ ID NO: 9250)

5'-UAUUCUGUUGUACGAGGAGAACAGAUC-3' (SEQ ID NO: 13871)

3'-AUAAGACAACAUGCUCCUCUUGUCUAG-5' (SEQ ID NO: 6941)

C5-2547 Target:
5'-TATTCTGTTGTACGAGGAGAACAGATC-3' (SEQ ID NO: 9251)

5'-AUUCUGUUGUACGAGGAGAACAGAUCC-3' (SEQ ID NO: 13872)

3'-UAAGACAACAUGCUCCUCUUGUCUAGG-5' (SEQ ID NO: 6942)

TABLE 9-continued

"Blunt/Blunt" DsiRNAs Corresponding to Human Anti-C5 DsiRNAs Predicted to have >50% Knockdown Efficacy C5-2548 Target:
5'-ATTCTGTTGTACGAGGAGAACAGATCC-3' (SEQ ID NO: 9252)

5'-UUCUGUUGUACGAGGAGAACAGAUCCA-3' (SEQ ID NO: 13873)

3'-AAGACAACAUGCUCCUCUUGUCUAGGU-5' (SEQ ID NO: 6943)

C5-2549 Target:
5'-TTCTGTTGTACGAGGAGAACAGATCCA-3' (SEQ ID NO: 9253)

5'-UCUGUUGUACGAGGAGAACAGAUCCAA-3' (SEQ ID NO: 13874)

3'-AGACAACAUGCUCCUCUUGUCUAGGUU-5' (SEQ ID NO: 6944)

C5-2550 Target:
5'-TCTGTTGTACGAGGAGAACAGATCCAA-3' (SEQ ID NO: 9254)

5'-AGGAACUGUUUACAACUAUAGGACUUC-3' (SEQ ID NO: 13875)

3'-UCCUUGACAAAUGUUGAUAUCCUGAAG-5' (SEQ ID NO: 6945)

C5-2582 Target:
5'-AGGAACTGTTTACAACTATAGGACTTC-3' (SEQ ID NO: 9255)

5'-GGAACUGUUUACAACUAUAGGACUUCU-3' (SEQ ID NO: 13876)

3'-CCUUGACAAAUGUUGAUAUCCUGAAGA-5' (SEQ ID NO: 6946)

C5-2583 Target:
5'-GGAACTGTTTACAACTATAGGACTTCT-3' (SEQ ID NO: 9256)

5'-GAACUGUUUACAACUAUAGGACUUCUG-3' (SEQ ID NO: 13877)

3'-CUUGACAAAUGUUGAUAUCCUGAAGAC-5' (SEQ ID NO: 6947)

C5-2584 Target:
5'-GAACTGTTTACAACTATAGGACTTCTG-3' (SEQ ID NO: 9257)

5'-AACUGUUUACAACUAUAGGACUUCUGG-3' (SEQ ID NO: 13878)

3'-UUGACAAAUGUUGAUAUCCUGAAGACC-5' (SEQ ID NO: 6948)

C5-2585 Target:
5'-AACTGTTTACAACTATAGGACTTCTGG-3' (SEQ ID NO: 9258)

5'-ACUGUUUACAACUAUAGGACUUCUGGG-3' (SEQ ID NO: 13879)

3'-UGACAAAUGUUGAUAUCCUGAAGACCC-5' (SEQ ID NO: 6949)

C5-2586 Target:
5'-ACTGTTTACAACTATAGGACTTCTGGG-3' (SEQ ID NO: 9259)

5'-CUGUUUACAACUAUAGGACUUCUGGGA-3' (SEQ ID NO: 13880)

3'-GACAAAUGUUGAUAUCCUGAAGACCCU-5' (SEQ ID NO: 6950)

C5-2587 Target:
5'-CTGTTTACAACTATAGGACTTCTGGGA-3' (SEQ ID NO: 9260)

5'-UGUUUACAACUAUAGGACUUCUGGGAU-3' (SEQ ID NO: 13881)

3'-ACAAAUGUUGAUAUCCUGAAGACCCUA-5' (SEQ ID NO: 6951)

C5-2588 Target:
5'-TGTTTACAACTATAGGACTTCTGGGAT-3' (SEQ ID NO: 9261)

5'-GUUUACAACUAUAGGACUUCUGGGAUG-3' (SEQ ID NO: 13882)

3'-CAAAUGUUGAUAUCCUGAAGACCCUAC-5' (SEQ ID NO: 6952)

C5-2589 Target:
5'-GTTTACAACTATAGGACTTCTGGGATG-3' (SEQ ID NO: 9262)

5'-UUUACAACUAUAGGACUUCUGGGAUGC-3' (SEQ ID NO: 13883)

3'-AAAUGUUGAUAUCCUGAAGACCCUACG-5' (SEQ ID NO: 6953)

C5-2590 Target:
5'-TTTACAACTATAGGACTTCTGGGATGC-3' (SEQ ID NO: 9263)

5'-UUACAACUAUAGGACUUCUGGGAUGCA-3' (SEQ ID NO: 13884)

3'-AAUGUUGAUAUCCUGAAGACCCUACGU-5' (SEQ ID NO: 6954)

C5-2591 Target:
5'-TTACAACTATAGGACTTCTGGGATGCA-3' (SEQ ID NO: 9264)

5'-UACAACUAUAGGACUUCUGGGAUGCAG-3' (SEQ ID NO: 13885)

3'-AUGUUGAUAUCCUGAAGACCCUACGUC-5' (SEQ ID NO: 6955)

C5-2592 Target:
5'-TACAACTATAGGACTTCTGGGATGCAG-3' (SEQ ID NO: 9265)

5'-ACAACUAUAGGACUUCUGGGAUGCAGU-3' (SEQ ID NO: 13886)

3'-UGUUGAUAUCCUGAAGACCCUACGUCA-5' (SEQ ID NO: 6956)

C5-2593 Target:
5'-ACAACTATAGGACTTCTGGGATGCAGT-3' (SEQ ID NO: 9266)

5'-CAACUAUAGGACUUCUGGGAUGCAGUU-3' (SEQ ID NO: 13887)

3'-GUUGAUAUCCUGAAGACCCUACGUCAA-5' (SEQ ID NO: 6957)

C5-2594 Target:
5'-CAACTATAGGACTTCTGGGATGCAGTT-3' (SEQ ID NO: 9267)

5'-AACUAUAGGACUUCUGGGAUGCAGUUC-3' (SEQ ID NO: 13888)

3'-UUGAUAUCCUGAAGACCCUACGUCAAG-5' (SEQ ID NO: 6958)

C5-2595 Target:
5'-AACTATAGGACTTCTGGGATGCAGTTC-3' (SEQ ID NO: 9268)

5'-ACUAUAGGACUUCUGGGAUGCAGUUCU-3' (SEQ ID NO: 13889)

3'-UGAUAUCCUGAAGACCCUACGUCAAGA-5' (SEQ ID NO: 6959)

C5-2596 Target:
5'-ACTATAGGACTTCTGGGATGCAGTTCT-3' (SEQ ID NO: 9269)

5'-CUAUAGGACUUCUGGGAUGCAGUUCUG-3' (SEQ ID NO: 13890)

3'-GAUAUCCUGAAGACCCUACGUCAAGAC-5' (SEQ ID NO: 6960)

C5-2597 Target:
5'-CTATAGGACTTCTGGGATGCAGTTCTG-3' (SEQ ID NO: 9270)

5'-UAUAGGACUUCUGGGAUGCAGUUCUGU-3' (SEQ ID NO: 13891)

3'-AUAUCCUGAAGACCCUACGUCAAGACA-5' (SEQ ID NO: 6961)

C5-2598 Target:
5'-TATAGGACTTCTGGGATGCAGTTCTGT-3' (SEQ ID NO: 9271)

5'-AUAGGACUUCUGGGAUGCAGUUCUGUG-3' (SEQ ID NO: 13892)

3'-UAUCCUGAAGACCCUACGUCAAGACAC-5' (SEQ ID NO: 6962)

TABLE 9-continued

"Blunt/Blunt" DsiRNAs Corresponding to Human Anti-C5 DsiRNAs Predicted to have >50% Knockdown Efficacy C5-2599 Target:
5'-ATAGGACTTCTGGGATGCAGTTCTGTG-3' (SEQ ID NO: 9272)

5'-AAAAUGUCUGCUGUGGAGGGAAUCUGC-3' (SEQ ID NO: 13893)

3'-UUUUACAGACGACACCUCCCUUAGACG-5' (SEQ ID NO: 6963)

C5-2628 Target:
5'-AAAATGTCTGCTGTGGAGGGAATCTGC-3' (SEQ ID NO: 9273)

5'-AAAUGUCUGCUGUGGAGGGAAUCUGCA-3' (SEQ ID NO: 13894)

3'-UUUACAGACGACACCUCCCUUAGACGU-5' (SEQ ID NO: 6964)

C5-2629 Target:
5'-AAATGTCTGCTGTGGAGGGAATCTGCA-3' (SEQ ID NO: 9274)

5'-AAUGUCUGCUGUGGAGGGAAUCUGCAC-3' (SEQ ID NO: 13895)

3'-UUACAGACGACACCUCCCUUAGACGUG-5' (SEQ ID NO: 6965)

C5-2630 Target:
5'-AATGTCTGCTGTGGAGGGAATCTGCAC-3' (SEQ ID NO: 9275)

5'-AUGUCUGCUGUGGAGGGAAUCUGCACU-3' (SEQ ID NO: 13896)

3'-UACAGACGACACCUCCCUUAGACGUGA-5' (SEQ ID NO: 6966)

C5-2631 Target:
5'-ATGTCTGCTGTGGAGGGAATCTGCACT-3' (SEQ ID NO: 9276)

5'-UGUCUGCUGUGGAGGGAAUCUGCACUU-3' (SEQ ID NO: 13897)

3'-ACAGACGACACCUCCCUUAGACGUGAA-5' (SEQ ID NO: 6967)

C5-2632 Target:
5'-TGTCTGCTGTGGAGGGAATCTGCACTT-3' (SEQ ID NO: 9277)

5'-GUCUGCUGUGGAGGGAAUCUGCACUUC-3' (SEQ ID NO: 13898)

3'-CAGACGACACCUCCCUUAGACGUGAAG-5' (SEQ ID NO: 6968)

C5-2633 Target:
5'-GTCTGCTGTGGAGGGAATCTGCACTTC-3' (SEQ ID NO: 9278)

5'-UCUGCUGUGGAGGGAAUCUGCACUUCG-3' (SEQ ID NO: 13899)

3'-AGACGACACCUCCCUUAGACGUGAAGC-5' (SEQ ID NO: 6969)

C5-2634 Target:
5'-TCTGCTGTGGAGGGAATCTGCACTTCG-3' (SEQ ID NO: 9279)

5'-CUGCUGUGGAGGGAAUCUGCACUUCGG-3' (SEQ ID NO: 13900)

3'-GACGACACCUCCCUUAGACGUGAAGCC-5' (SEQ ID NO: 6970)

C5-2635 Target:
5'-CTGCTGTGGAGGGAATCTGCACTTCGG-3' (SEQ ID NO: 9280)

5'-UGCUGUGGAGGGAAUCUGCACUUCGGA-3' (SEQ ID NO: 13901)

3'-ACGACACCUCCCUUAGACGUGAAGCCU-5' (SEQ ID NO: 6971)

C5-2636 Target:
5'-TGCTGTGGAGGGAATCTGCACTTCGGA-3' (SEQ ID NO: 9281)

5'-GCUGUGGAGGGAAUCUGCACUUCGGAA-3' (SEQ ID NO: 13902)

3'-CGACACCUCCCUUAGACGUGAAGCCUU-5' (SEQ ID NO: 6972)

C5-2637 Target:
5'-GCTGTGGAGGGAATCTGCACTTCGGAA-3' (SEQ ID NO: 9282)

5'-CUGUGGAGGGAAUCUGCACUUCGGAAA-3' (SEQ ID NO: 13903)

3'-GACACCUCCCUUAGACGUGAAGCCUUU-5' (SEQ ID NO: 6973)

C5-2638 Target:
5'-CTGTGGAGGGAATCTGCACTTCGGAAA-3' (SEQ ID NO: 9283)

5'-UGUGGAGGGAAUCUGCACUUCGGAAAG-3' (SEQ ID NO: 13904)

3'-ACACCUCCCUUAGACGUGAAGCCUUUC-5' (SEQ ID NO: 6974)

C5-2639 Target:
5'-TGTGGAGGGAATCTGCACTTCGGAAAG-3' (SEQ ID NO: 9284)

5'-CGGAAAGCCCAGUCAUUGAUCAUCAGG-3' (SEQ ID NO: 13905)

3'-GCCUUUCGGGUCAGUAACUAGUAGUCC-5' (SEQ ID NO: 6975)

C5-2659 Target:
5'-CGGAAAGCCCAGTCATTGATCATCAGG-3' (SEQ ID NO: 9285)

5'-GGAAAGCCCAGUCAUUGAUCAUCAGGG-3' (SEQ ID NO: 13906)

3'-CCUUUCGGGUCAGUAACUAGUAGUCCC-5' (SEQ ID NO: 6976)

C5-2660 Target:
5'-GGAAAGCCCAGTCATTGATCATCAGGG-3' (SEQ ID NO: 9286)

5'-GAAAGCCCAGUCAUUGAUCAUCAGGGC-3' (SEQ ID NO: 13907)

3'-CUUUCGGGUCAGUAACUAGUAGUCCCG-5' (SEQ ID NO: 6977)

C5-2661 Target:
5'-GAAAGCCCAGTCATTGATCATCAGGGC-3' (SEQ ID NO: 9287)

5'-AAAGCCCAGUCAUUGAUCAUCAGGGCA-3' (SEQ ID NO: 13908)

3'-UUUCGGGUCAGUAACUAGUAGUCCCGU-5' (SEQ ID NO: 6978)

C5-2662 Target:
5'-AAAGCCCAGTCATTGATCATCAGGGCA-3' (SEQ ID NO: 9288)

5'-AAGCCCAGUCAUUGAUCAUCAGGGCAC-3' (SEQ ID NO: 13909)

3'-UUCGGGUCAGUAACUAGUAGUCCCGUG-5' (SEQ ID NO: 6979)

C5-2663 Target:
5'-AAGCCCAGTCATTGATCATCAGGGCAC-3' (SEQ ID NO: 9289)

5'-AGCCCAGUCAUUGAUCAUCAGGGCACA-3' (SEQ ID NO: 13910)

3'-UCGGGUCAGUAACUAGUAGUCCCGUGU-5' (SEQ ID NO: 6980)

C5-2664 Target:
5'-AGCCCAGTCATTGATCATCAGGGCACA-3' (SEQ ID NO: 9290)

5'-GCCCAGUCAUUGAUCAUCAGGGCACAA-3' (SEQ ID NO: 13911)

3'-CGGGUCAGUAACUAGUAGUCCCGUGUU-5' (SEQ ID NO: 6981)

C5-2665 Target:
5'-GCCCAGTCATTGATCATCAGGGCACAA-3' (SEQ ID NO: 9291)

5'-CCCAGUCAUUGAUCAUCAGGGCACAAA-3' (SEQ ID NO: 13912)

3'-GGGUCAGUAACUAGUAGUCCCGUGUUU-5' (SEQ ID NO: 6982)

TABLE 9-continued

"Blunt/Blunt" DsiRNAs Corresponding to Human Anti-C5
DsiRNAs Predicted to have >50% Knockdown Efficacy C5-2666 Target:
5'-CCCAGTCATTGATCATCAGGGCACAAA-3' (SEQ ID NO: 9292)

5'-CCAGUCAUUGAUCAUCAGGGCACAAAG-3' (SEQ ID NO: 13913)

3'-GGUCAGUAACUAGUAGUCCCGUGUUUC-5' (SEQ ID NO: 6983)

C5-2667 Target:
5'-CCAGTCATTGATCATCAGGGCACAAAG-3' (SEQ ID NO: 9293)

5'-CAGUCAUUGAUCAUCAGGGCACAAAGU-3' (SEQ ID NO: 13914)

3'-GUCAGUAACUAGUAGUCCCGUGUUUCA-5' (SEQ ID NO: 6984)

C5-2668 Target:
5'-CAGTCATTGATCATCAGGGCACAAAGT-3' (SEQ ID NO: 9294)

5'-AGUCAUUGAUCAUCAGGGCACAAAGUC-3' (SEQ ID NO: 13915)

3'-UCAGUAACUAGUAGUCCCGUGUUUCAG-5' (SEQ ID NO: 6985)

C5-2669 Target:
5'-AGTCATTGATCATCAGGGCACAAAGTC-3' (SEQ ID NO: 9295)

5'-GUCAUUGAUCAUCAGGGCACAAAGUCC-3' (SEQ ID NO: 13916)

3'-CAGUAACUAGUAGUCCCGUGUUUCAGG-5' (SEQ ID NO: 6986)

C5-2670 Target:
5'-GTCATTGATCATCAGGGCACAAAGTCC-3' (SEQ ID NO: 9296)

5'-UCAUUGAUCAUCAGGGCACAAAGUCCU-3' (SEQ ID NO: 13917)

3'-AGUAACUAGUAGUCCCGUGUUUCAGGA-5' (SEQ ID NO: 6987)

C5-2671 Target:
5'-TCATTGATCATCAGGGCACAAAGTCCT-3' (SEQ ID NO: 9297)

5'-CAUUGAUCAUCAGGGCACAAAGUCCUC-3' (SEQ ID NO: 13918)

3'-GUAACUAGUAGUCCCGUGUUUCAGGAG-5' (SEQ ID NO: 6988)

C5-2672 Target:
5'-CATTGATCATCAGGGCACAAAGTCCTC-3' (SEQ ID NO: 9298)

5'-AUUGAUCAUCAGGGCACAAAGUCCUCC-3' (SEQ ID NO: 13919)

3'-UAACUAGUAGUCCCGUGUUUCAGGAGG-5' (SEQ ID NO: 6989)

C5-2673 Target:
5'-ATTGATCATCAGGGCACAAAGTCCTCC-3' (SEQ ID NO: 9299)

5'-UUGAUCAUCAGGGCACAAAGUCCUCCA-3' (SEQ ID NO: 13920)

3'-AACUAGUAGUCCCGUGUUUCAGGAGGU-5' (SEQ ID NO: 6990)

C5-2674 Target:
5'-TTGATCATCAGGGCACAAAGTCCTCCA-3' (SEQ ID NO: 9300)

5'-UGAUCAUCAGGGCACAAAGUCCUCCAA-3' (SEQ ID NO: 13921)

3'-ACUAGUAGUCCCGUGUUUCAGGAGGUU-5' (SEQ ID NO: 6991)

C5-2675 Target:
5'-TGATCATCAGGGCACAAAGTCCTCCAA-3' (SEQ ID NO: 9301)

5'-GAUCAUCAGGGCACAAAGUCCUCCAAA-3' (SEQ ID NO: 13922)

3'-CUAGUAGUCCCGUGUUUCAGGAGGUUU-5' (SEQ ID NO: 6992)

C5-2676 Target:
5'-GATCATCAGGGCACAAAGTCCTCCAAA-3' (SEQ ID NO: 9302)

5'-AUCAUCAGGGCACAAAGUCCUCCAAAU-3' (SEQ ID NO: 13923)

3'-UAGUAGUCCCGUGUUUCAGGAGGUUUA-5' (SEQ ID NO: 6993)

C5-2677 Target:
5'-ATCATCAGGGCACAAAGTCCTCCAAAT-3' (SEQ ID NO: 9303)

5'-UCAUCAGGGCACAAAGUCCUCCAAAUG-3' (SEQ ID NO: 13924)

3'-AGUAGUCCCGUGUUUCAGGAGGUUUAC-5' (SEQ ID NO: 6994)

C5-2678 Target:
5'-TCATCAGGGCACAAAGTCCTCCAAATG-3' (SEQ ID NO: 9304)

5'-CAUCAGGGCACAAAGUCCUCCAAAUGU-3' (SEQ ID NO: 13925)

3'-GUAGUCCCGUGUUUCAGGAGGUUUACA-5' (SEQ ID NO: 6995)

C5-2679 Target:
5'-CATCAGGGCACAAAGTCCTCCAAATGT-3' (SEQ ID NO: 9305)

5'-AUCAGGGCACAAAGUCCUCCAAAUGUG-3' (SEQ ID NO: 13926)

3'-UAGUCCCGUGUUUCAGGAGGUUUACAC-5' (SEQ ID NO: 6996)

C5-2680 Target:
5'-ATCAGGGCACAAAGTCCTCCAAATGTG-3' (SEQ ID NO: 9306)

5'-CCAGAAAGUAGAGGGCUCCUCCAGUCA-3' (SEQ ID NO: 13927)

3'-GGUCUUUCAUCUCCCGAGGAGGUCAGU-5' (SEQ ID NO: 6997)

C5-2711 Target:
5'-CCAGAAAGTAGAGGGCTCCTCCAGTCA-3' (SEQ ID NO: 9307)

5'-UCACUGUGCUUCCUCUGGAAAUUGGCC-3' (SEQ ID NO: 13928)

3'-AGUGACACGAAGGAGACCUUUAACCGG-5' (SEQ ID NO: 6998)

C5-2749 Target:
5'-TCACTGTGCTTCCTCTGGAAATTGGCC-3' (SEQ ID NO: 9308)

5'-CACUGUGCUUCCUCUGGAAAUUGGCCU-3' (SEQ ID NO: 13929)

3'-GUGACACGAAGGAGACCUUUAACCGGA-5' (SEQ ID NO: 6999)

C5-2750 Target:
5'-CACTGTGCTTCCTCTGGAAATTGGCCT-3' (SEQ ID NO: 9309)

5'-ACUGUGCUUCCUCUGGAAAUUGGCCUU-3' (SEQ ID NO: 13930)

3'-UGACACGAAGGAGACCUUUAACCGGAA-5' (SEQ ID NO: 7000)

C5-2751 Target:
5'-ACTGTGCTTCCTCTGGAAATTGGCCTT-3' (SEQ ID NO: 9310)

5'-CUGUGCUUCCUCUGGAAAUUGGCCUUC-3' (SEQ ID NO: 13931)

3'-GACACGAAGGAGACCUUUAACCGGAAG-5' (SEQ ID NO: 7001)

C5-2752 Target:
5'-CTGTGCTTCCTCTGGAAATTGGCCTTC-3' (SEQ ID NO: 9311)

5'-UGGUUUGGAAAAGAAAUCUUAGUAAAA-3' (SEQ ID NO: 13932)

3'-ACCAAACCUUUUCUUUAGAAUCAUUUU-5' (SEQ ID NO: 7002)

TABLE 9-continued

"Blunt/Blunt" DsiRNAs Corresponding to Human Anti-C5 DsiRNAs Predicted to have >50% Knockdown Efficacy C5-2805 Target:
5'-TGGTTTGGAAAAGAAATCTTAGTAAAA-3' (SEQ ID NO: 9312)

5'-GGUUUGGAAAAGAAAUCUUAGUAAAAA-3' (SEQ ID NO: 13933)

3'-CCAAACCUUUUCUUUAGAAUCAUUUUU-5' (SEQ ID NO: 7003)

C5-2806 Target:
5'-GGTTTGGAAAAGAAATCTTAGTAAAAA-3' (SEQ ID NO: 9313)

5'-GUUUGGAAAAGAAAUCUUAGUAAAAAC-3' (SEQ ID NO: 13934)

3'-CAAACCUUUUCUUUAGAAUCAUUUUUG-5' (SEQ ID NO: 7004)

C5-2807 Target:
5'-GTTTGGAAAAGAAATCTTAGTAAAAAC-3' (SEQ ID NO: 9314)

5'-UUUGGAAAAGAAAUCUUAGUAAAAACA-3' (SEQ ID NO: 13935)

3'-AAACCUUUUCUUUAGAAUCAUUUUUGU-5' (SEQ ID NO: 7005)

C5-2808 Target:
5'-TTTGGAAAAGAAATCTTAGTAAAAACA-3' (SEQ ID NO: 9315)

5'-UUGGAAAAGAAAUCUUAGUAAAAACAU-3' (SEQ ID NO: 13936)

3'-AACCUUUUCUUUAGAAUCAUUUUUGUA-5' (SEQ ID NO: 7006)

C5-2809 Target:
5'-TTGGAAAAGAAATCTTAGTAAAAACAT-3' (SEQ ID NO: 9316)

5'-UGGAAAAGAAAUCUUAGUAAAAACAUU-3' (SEQ ID NO: 13937)

3'-ACCUUUUCUUUAGAAUCAUUUUUGUAA-5' (SEQ ID NO: 7007)

C5-2810 Target:
5'-TGGAAAAGAAATCTTAGTAAAAACATT-3' (SEQ ID NO: 9317)

5'-GGAAAAGAAAUCUUAGUAAAAACAUUA-3' (SEQ ID NO: 13938)

3'-CCUUUUCUUUAGAAUCAUUUUUGUAAU-5' (SEQ ID NO: 7008)

C5-2811 Target:
5'-GGAAAAGAAATCTTAGTAAAAACATTA-3' (SEQ ID NO: 9318)

5'-CAUUACGAGUGGUGCCAGAAGGUGUCA-3' (SEQ ID NO: 13939)

3'-GUAAUGCUCACCACGGUCUUCCACAGU-5' (SEQ ID NO: 7009)

C5-2833 Target:
5'-CATTACGAGTGGTGCCAGAAGGTGTCA-3' (SEQ ID NO: 9319)

5'-AUUACGAGUGGUGCCAGAAGGUGUCAA-3' (SEQ ID NO: 13940)

3'-UAAUGCUCACCACGGUCUUCCACAGUU-5' (SEQ ID NO: 7010)

C5-2834 Target:
5'-ATTACGAGTGGTGCCAGAAGGTGTCAA-3' (SEQ ID NO: 9320)

5'-UUACGAGUGGUGCCAGAAGGUGUCAAA-3' (SEQ ID NO: 13941)

3'-AAUGCUCACCACGGUCUUCCACAGUUU-5' (SEQ ID NO: 7011)

C5-2835 Target:
5'-TTACGAGTGGTGCCAGAAGGTGTCAAA-3' (SEQ ID NO: 9321)

5'-UACGAGUGGUGCCAGAAGGUGUCAAAA-3' (SEQ ID NO: 13942)

3'-AUGCUCACCACGGUCUUCCACAGUUUU-5' (SEQ ID NO: 7012)

C5-2836 Target:
5'-TACGAGTGGTGCCAGAAGGTGTCAAAA-3' (SEQ ID NO: 9322)

5'-ACGAGUGGUGCCAGAAGGUGUCAAAAG-3' (SEQ ID NO: 13943)

3'-UGCUCACCACGGUCUUCCACAGUUUUC-5' (SEQ ID NO: 7013)

C5-2837 Target:
5'-ACGAGTGGTGCCAGAAGGTGTCAAAAG-3' (SEQ ID NO: 9323)

5'-CGAGUGGUGCCAGAAGGUGUCAAAAGG-3' (SEQ ID NO: 13944)

3'-GCUCACCACGGUCUUCCACAGUUUUCC-5' (SEQ ID NO: 7014)

C5-2838 Target:
5'-CGAGTGGTGCCAGAAGGTGTCAAAAGG-3' (SEQ ID NO: 9324)

5'-GAGUGGUGCCAGAAGGUGUCAAAAGGG-3' (SEQ ID NO: 13945)

3'-CUCACCACGGUCUUCCACAGUUUUCCC-5' (SEQ ID NO: 7015)

C5-2839 Target:
5'-GAGTGGTGCCAGAAGGTGTCAAAAGGG-3' (SEQ ID NO: 9325)

5'-AGUGGUGCCAGAAGGUGUCAAAAGGGA-3' (SEQ ID NO: 13946)

3'-UCACCACGGUCUUCCACAGUUUUCCCU-5' (SEQ ID NO: 7016)

C5-2840 Target:
5'-AGTGGTGCCAGAAGGTGTCAAAAGGGA-3' (SEQ ID NO: 9326)

5'-GUGGUGCCAGAAGGUGUCAAAAGGGAA-3' (SEQ ID NO: 13947)

3'-CACCACGGUCUUCCACAGUUUUCCCUU-5' (SEQ ID NO: 7017)

C5-2841 Target:
5'-GTGGTGCCAGAAGGTGTCAAAAGGGAA-3' (SEQ ID NO: 9327)

5'-UGGUGCCAGAAGGUGUCAAAAGGGAAA-3' (SEQ ID NO: 13948)

3'-ACCACGGUCUUCCACAGUUUUCCCUUU-5' (SEQ ID NO: 7018)

C5-2842 Target:
5'-TGGTGCCAGAAGGTGTCAAAAGGGAAA-3' (SEQ ID NO: 9328)

5'-GGUGCCAGAAGGUGUCAAAAGGGAAAG-3' (SEQ ID NO: 13949)

3'-CCACGGUCUUCCACAGUUUUCCCUUUC-5' (SEQ ID NO: 7019)

C5-2843 Target:
5'-GGTGCCAGAAGGTGTCAAAAGGGAAAG-3' (SEQ ID NO: 9329)

5'-GUGCCAGAAGGUGUCAAAAGGGAAAGC-3' (SEQ ID NO: 13950)

3'-CACGGUCUUCCACAGUUUUCCCUUUCG-5' (SEQ ID NO: 7020)

C5-2844 Target:
5'-GTGCCAGAAGGTGTCAAAAGGGAAAGC-3' (SEQ ID NO: 9330)

5'-UGCCAGAAGGUGUCAAAAGGGAAAGCU-3' (SEQ ID NO: 13951)

3'-ACGGUCUUCCACAGUUUUCCCUUUCGA-5' (SEQ ID NO: 7021)

C5-2845 Target:
5'-TGCCAGAAGGTGTCAAAAGGGAAAGCT-3' (SEQ ID NO: 9331)

5'-GCCAGAAGGUGUCAAAAGGGAAAGCUA-3' (SEQ ID NO: 13952)

3'-CGGUCUUCCACAGUUUUCCCUUUCGAU-5' (SEQ ID NO: 7022)

TABLE 9-continued

"Blunt/Blunt" DsiRNAs Corresponding to Human Anti-C5 DsiRNAs Predicted to have >50% Knockdown Efficacy C5-2846 Target:
5'-GCCAGAAGGTGTCAAAAGGGAAAGCTA-3' (SEQ ID NO: 9332)

5'-CCAGAAGGUGUCAAAAGGGAAAGCUAU-3' (SEQ ID NO: 13953)

3'-GGUCUUCCACAGUUUUCCCUUUCGAUA-5' (SEQ ID NO: 7023)

C5-2847 Target:
5'-CCAGAAGGTGTCAAAAGGGAAAGCTAT-3' (SEQ ID NO: 9333)

5'-CAGAAGGUGUCAAAAGGGAAAGCUAUU-3' (SEQ ID NO: 13954)

3'-GUCUUCCACAGUUUUCCCUUUCGAUAA-5' (SEQ ID NO: 7024)

C5-2848 Target:
5'-CAGAAGGTGTCAAAAGGGAAAGCTATT-3' (SEQ ID NO: 9334)

5'-AGAAGGUGUCAAAAGGGAAAGCUAUUC-3' (SEQ ID NO: 13955)

3'-UCUUCCACAGUUUUCCCUUUCGAUAAG-5' (SEQ ID NO: 7025)

C5-2849 Target:
5'-AGAAGGTGTCAAAAGGGAAAGCTATTC-3' (SEQ ID NO: 9335)

5'-GAAGGUGUCAAAAGGGAAAGCUAUUCU-3' (SEQ ID NO: 13956)

3'-CUUCCACAGUUUUCCCUUUCGAUAAGA-5' (SEQ ID NO: 7026)

C5-2850 Target:
5'-GAAGGTGTCAAAAGGGAAAGCTATTCT-3' (SEQ ID NO: 9336)

5'-AAGGUGUCAAAAGGGAAAGCUAUUCUG-3' (SEQ ID NO: 13957)

3'-UUCCACAGUUUUCCCUUUCGAUAAGAC-5' (SEQ ID NO: 7027)

C5-2851 Target:
5'-AAGGTGTCAAAAGGGAAAGCTATTCTG-3' (SEQ ID NO: 9337)

5'-AGGUGUCAAAAGGGAAAGCUAUUCUGG-3' (SEQ ID NO: 13958)

3'-UCCACAGUUUUCCCUUUCGAUAAGACC-5' (SEQ ID NO: 7028)

C5-2852 Target:
5'-AGGTGTCAAAAGGGAAAGCTATTCTGG-3' (SEQ ID NO: 9338)

5'-GGUGUCAAAAGGGAAAGCUAUUCUGGU-3' (SEQ ID NO: 13959)

3'-CCACAGUUUUCCCUUUCGAUAAGACCA-5' (SEQ ID NO: 7029)

C5-2853 Target:
5'-GGTGTCAAAAGGGAAAGCTATTCTGGT-3' (SEQ ID NO: 9339)

5'-GUGUCAAAAGGGAAAGCUAUUCUGGUG-3' (SEQ ID NO: 13960)

3'-CACAGUUUUCCCUUUCGAUAAGACCAC-5' (SEQ ID NO: 7030)

C5-2854 Target:
5'-GTGTCAAAAGGGAAAGCTATTCTGGTG-3' (SEQ ID NO: 9340)

5'-UGUCAAAAGGGAAAGCUAUUCUGGUGU-3' (SEQ ID NO: 13961)

3'-ACAGUUUUCCCUUUCGAUAAGACCACA-5' (SEQ ID NO: 7031)

C5-2855 Target:
5'-TGTCAAAAGGGAAAGCTATTCTGGTGT-3' (SEQ ID NO: 9341)

5'-GUCAAAAGGGAAAGCUAUUCUGGUGUU-3' (SEQ ID NO: 13962)

3'-CAGUUUUCCCUUUCGAUAAGACCACAA-5' (SEQ ID NO: 7032)

C5-2856 Target:
5'-GTCAAAAGGGAAAGCTATTCTGGTGTT-3' (SEQ ID NO: 9342)

5'-UCAAAAGGGAAAGCUAUUCUGGUGUUA-3' (SEQ ID NO: 13963)

3'-AGUUUUCCCUUUCGAUAAGACCACAAU-5' (SEQ ID NO: 7033)

C5-2857 Target:
5'-TCAAAAGGGAAAGCTATTCTGGTGTTA-3' (SEQ ID NO: 9343)

5'-CAAAAGGGAAAGCUAUUCUGGUGUUAC-3' (SEQ ID NO: 13964)

3'-GUUUUCCCUUUCGAUAAGACCACAAUG-5' (SEQ ID NO: 7034)

C5-2858 Target:
5'-CAAAAGGGAAAGCTATTCTGGTGTTAC-3' (SEQ ID NO: 9344)

5'-AAAAGGGAAAGCUAUUCUGGUGUUACU-3' (SEQ ID NO: 13965)

3'-UUUUCCCUUUCGAUAAGACCACAAUGA-5' (SEQ ID NO: 7035)

C5-2859 Target:
5'-AAAAGGGAAAGCTATTCTGGTGTTACT-3' (SEQ ID NO: 9345)

5'-UGUUACUUUGGAUCCUAGGGGUAUUUA-3' (SEQ ID NO: 13966)

3'-ACAAUGAAACCUAGGAUCCCCAUAAAU-5' (SEQ ID NO: 7036)

C5-2879 Target:
5'-TGTTACTTTGGATCCTAGGGGTATTTA-3' (SEQ ID NO: 9346)

5'-GUUACUUUGGAUCCUAGGGGUAUUUAU-3' (SEQ ID NO: 13967)

3'-CAAUGAAACCUAGGAUCCCCAUAAAUA-5' (SEQ ID NO: 7037)

C5-2880 Target:
5'-GTTACTTTGGATCCTAGGGGTATTTAT-3' (SEQ ID NO: 9347)

5'-UUACUUUGGAUCCUAGGGGUAUUUAUG-3' (SEQ ID NO: 13968)

3'-AAUGAAACCUAGGAUCCCCAUAAAUAC-5' (SEQ ID NO: 7038)

C5-2881 Target:
5'-TTACTTTGGATCCTAGGGGTATTTATG-3' (SEQ ID NO: 9348)

5'-UACUUUGGAUCCUAGGGGUAUUUAUGG-3' (SEQ ID NO: 13969)

3'-AUGAAACCUAGGAUCCCCAUAAAUACC-5' (SEQ ID NO: 7039)

C5-2882 Target:
5'-TACTTTGGATCCTAGGGGTATTTATGG-3' (SEQ ID NO: 9349)

5'-ACUUUGGAUCCUAGGGGUAUUUAUGGU-3' (SEQ ID NO: 13970)

3'-UGAAACCUAGGAUCCCCAUAAAUACCA-5' (SEQ ID NO: 7040)

C5-2883 Target:
5'-ACTTTGGATCCTAGGGGTATTTATGGT-3' (SEQ ID NO: 9350)

5'-CUUUGGAUCCUAGGGGUAUUUAUGGUA-3' (SEQ ID NO: 13971)

3'-GAAACCUAGGAUCCCCAUAAAUACCAU-5' (SEQ ID NO: 7041)

C5-2884 Target:
5'-CTTTGGATCCTAGGGGTATTTATGGTA-3' (SEQ ID NO: 9351)

5'-UUUGGAUCCUAGGGGUAUUUAUGGUAC-3' (SEQ ID NO: 13972)

3'-AAACCUAGGAUCCCCAUAAAUACCAUG-5' (SEQ ID NO: 7042)

TABLE 9-continued

"Blunt/Blunt" DsiRNAs Corresponding to Human Anti-C5 DsiRNAs Predicted to have >50% Knockdown Efficacy C5-2885 Target:
5'-TTTGGATCCTAGGGGTATTTATGGTAC-3' (SEQ ID NO: 9352)

5'-UUGGAUCCUAGGGGUAUUUAUGGUACC-3' (SEQ ID NO: 13973)

3'-AACCUAGGAUCCCCAUAAAUACCAUGG-5' (SEQ ID NO: 7043)

C5-2886 Target:
5'-TTGGATCCTAGGGGTATTTATGGTACC-3' (SEQ ID NO: 9353)

5'-UGGAUCCUAGGGGUAUUUAUGGUACCA-3' (SEQ ID NO: 13974)

3'-ACCUAGGAUCCCCAUAAAUACCAUGGU-5' (SEQ ID NO: 7044)

C5-2887 Target:
5'-TGGATCCTAGGGGTATTTATGGTACCA-3' (SEQ ID NO: 9354)

5'-GACGAAAGGAGUUCCCAUACAGGAUAC-3' (SEQ ID NO: 13975)

3'-CUGCUUUCCUCAAGGGUAUGUCCUAUG-5' (SEQ ID NO: 7045)

C5-2920 Target:
5'-GACGAAAGGAGTTCCCATACAGGATAC-3' (SEQ ID NO: 9355)

5'-ACGAAAGGAGUUCCCAUACAGGAUACC-3' (SEQ ID NO: 13976)

3'-UGCUUUCCUCAAGGGUAUGUCCUAUGG-5' (SEQ ID NO: 7046)

C5-2921 Target:
5'-ACGAAAGGAGTTCCCATACAGGATACC-3' (SEQ ID NO: 9356)

5'-CGAAAGGAGUUCCCAUACAGGAUACCC-3' (SEQ ID NO: 13977)

3'-GCUUUCCUCAAGGGUAUGUCCUAUGGG-5' (SEQ ID NO: 7047)

C5-2922 Target:
5'-CGAAAGGAGTTCCCATACAGGATACCC-3' (SEQ ID NO: 9357)

5'-GAAAGGAGUUCCCAUACAGGAUACCCU-3' (SEQ ID NO: 13978)

3'-CUUUCCUCAAGGGUAUGUCCUAUGGGA-5' (SEQ ID NO: 7048)

C5-2923 Target:
5'-GAAAGGAGTTCCCATACAGGATACCCT-3' (SEQ ID NO: 9358)

5'-AAAGGAGUUCCCAUACAGGAUACCCUU-3' (SEQ ID NO: 13979)

3'-UUUCCUCAAGGGUAUGUCCUAUGGGAA-5' (SEQ ID NO: 7049)

C5-2924 Target:
5'-AAAGGAGTTCCCATACAGGATACCCTT-3' (SEQ ID NO: 9359)

5'-AAGGAGUUCCCAUACAGGAUACCCUUA-3' (SEQ ID NO: 13980)

3'-UUCCUCAAGGGUAUGUCCUAUGGGAAU-5' (SEQ ID NO: 7050)

C5-2925 Target:
5'-AAGGAGTTCCCATACAGGATACCCTTA-3' (SEQ ID NO: 9360)

5'-AGGAGUUCCCAUACAGGAUACCCUUAG-3' (SEQ ID NO: 13981)

3'-UCCUCAAGGGUAUGUCCUAUGGGAAUC-5' (SEQ ID NO: 7051)

C5-2926 Target:
5'-AGGAGTTCCCATACAGGATACCCTTAG-3' (SEQ ID NO: 9361)

5'-GGAGUUCCCAUACAGGAUACCCUUAGA-3' (SEQ ID NO: 13982)

3'-CCUCAAGGGUAUGUCCUAUGGGAAUCU-5' (SEQ ID NO: 7052)

C5-2927 Target:
5'-GGAGTTCCCATACAGGATACCCTTAGA-3' (SEQ ID NO: 9362)

5'-CCUUAGAUUUGGUCCCCAAAACAGAAA-3' (SEQ ID NO: 13983)

3'-GGAAUCUAAACCAGGGGUUUUGUCUUU-5' (SEQ ID NO: 7053)

C5-2947 Target:
5'-CCTTAGATTTGGTCCCCAAAACAGAAA-3' (SEQ ID NO: 9363)

5'-CUUAGAUUUGGUCCCCAAAACAGAAAU-3' (SEQ ID NO: 13984)

3'-GAAUCUAAACCAGGGGUUUUGUCUUUA-5' (SEQ ID NO: 7054)

C5-2948 Target:
5'-CTTAGATTTGGTCCCCAAAACAGAAAT-3' (SEQ ID NO: 9364)

5'-UUAGAUUUGGUCCCCAAAACAGAAAUC-3' (SEQ ID NO: 13985)

3'-AAUCUAAACCAGGGGUUUUGUCUUUAG-5' (SEQ ID NO: 7055)

C5-2949 Target:
5'-TTAGATTTGGTCCCCAAAACAGAAATC-3' (SEQ ID NO: 9365)

5'-UAGAUUUGGUCCCCAAAACAGAAAUCA-3' (SEQ ID NO: 13986)

3'-AUCUAAACCAGGGGUUUUGUCUUUAGU-5' (SEQ ID NO: 7056)

C5-2950 Target:
5'-TAGATTTGGTCCCCAAAACAGAAATCA-3' (SEQ ID NO: 9366)

5'-AGAUUUGGUCCCCAAAACAGAAAUCAA-3' (SEQ ID NO: 13987)

3'-UCUAAACCAGGGGUUUUGUCUUUAGUU-5' (SEQ ID NO: 7057)

C5-2951 Target:
5'-AGATTTGGTCCCCAAAACAGAAATCAA-3' (SEQ ID NO: 9367)

5'-GAUUUGGUCCCCAAAACAGAAAUCAAA-3' (SEQ ID NO: 13988)

3'-CUAAACCAGGGGUUUUGUCUUUAGUUU-5' (SEQ ID NO: 7058)

C5-2952 Target:
5'-GATTTGGTCCCCAAAACAGAAATCAAA-3' (SEQ ID NO: 9368)

5'-AUUUGGUCCCCAAAACAGAAAUCAAAA-3' (SEQ ID NO: 13989)

3'-UAAACCAGGGGUUUUGUCUUUAGUUUU-5' (SEQ ID NO: 7059)

C5-2953 Target:
5'-ATTTGGTCCCCAAAACAGAAATCAAAA-3' (SEQ ID NO: 9369)

5'-UUUGGUCCCCAAAACAGAAAUCAAAAG-3' (SEQ ID NO: 13990)

3'-AAACCAGGGGUUUUGUCUUUAGUUUUC-5' (SEQ ID NO: 7060)

C5-2954 Target:
5'-TTTGGTCCCCAAAACAGAAATCAAAAG-3' (SEQ ID NO: 9370)

5'-UUGGUCCCCAAAACAGAAAUCAAAAGG-3' (SEQ ID NO: 13991)

3'-AACCAGGGGUUUUGUCUUUAGUUUUCC-5' (SEQ ID NO: 7061)

C5-2955 Target:
5'-TTGGTCCCCAAAACAGAAATCAAAAGG-3' (SEQ ID NO: 9371)

5'-UGGUCCCCAAAACAGAAAUCAAAAGGA-3' (SEQ ID NO: 13992)

3'-ACCAGGGGUUUUGUCUUUAGUUUUCCU-5' (SEQ ID NO: 7062)

TABLE 9-continued

"Blunt/Blunt" DsiRNAs Corresponding to Human Anti-C5 DsiRNAs Predicted to have >50% Knockdown Efficacy C5-2956 Target:
5'-TGGTCCCCAAAACAGAAATCAAAAGGA-3' (SEQ ID NO: 9372)

5'-GGUCCCCAAAACAGAAAUCAAAAGGAU-3' (SEQ ID NO: 13993)

3'-CCAGGGGUUUUGUCUUUAGUUUUCCUA-5' (SEQ ID NO: 7063)

C5-2957 Target:
5'-GGTCCCCAAAACAGAAATCAAAAGGAT-3' (SEQ ID NO: 9373)

5'-GUCCCCAAAACAGAAAUCAAAAGGAUU-3' (SEQ ID NO: 13994)

3'-CAGGGGUUUUGUCUUUAGUUUUCCUAA-5' (SEQ ID NO: 7064)

C5-2958 Target:
5'-GTCCCCAAAACAGAAATCAAAAGGATT-3' (SEQ ID NO: 9374)

5'-UCCCCAAAACAGAAAUCAAAAGGAUUU-3' (SEQ ID NO: 13995)

3'-AGGGGUUUUGUCUUUAGUUUUCCUAAA-5' (SEQ ID NO: 7065)

C5-2959 Target:
5'-TCCCCAAAACAGAAATCAAAAGGATTT-3' (SEQ ID NO: 9375)

5'-CCCCAAAACAGAAAUCAAAAGGAUUUU-3' (SEQ ID NO: 13996)

3'-GGGGUUUUGUCUUUAGUUUUCCUAAAA-5' (SEQ ID NO: 7066)

C5-2960 Target:
5'-CCCCAAAACAGAAATCAAAAGGATTTT-3' (SEQ ID NO: 9376)

5'-CCCAAAACAGAAAUCAAAAGGAUUUUG-3' (SEQ ID NO: 13997)

3'-GGGUUUUGUCUUUAGUUUUCCUAAAAC-5' (SEQ ID NO: 7067)

C5-2961 Target:
5'-CCCAAAACAGAAATCAAAAGGATTTTG-3' (SEQ ID NO: 9377)

5'-CCAAAACAGAAAUCAAAAGGAUUUUGA-3' (SEQ ID NO: 13998)

3'-GGUUUUGUCUUUAGUUUUCCUAAAACU-5' (SEQ ID NO: 7068)

C5-2962 Target:
5'-CCAAAACAGAAATCAAAAGGATTTTGA-3' (SEQ ID NO: 9378)

5'-CAAAACAGAAAUCAAAAGGAUUUUGAG-3' (SEQ ID NO: 13999)

3'-GUUUUGUCUUUAGUUUUCCUAAAACUC-5' (SEQ ID NO: 7069)

C5-2963 Target:
5'-CAAAACAGAAATCAAAAGGATTTTGAG-3' (SEQ ID NO: 9379)

5'-AAAACAGAAAUCAAAAGGAUUUUGAGU-3' (SEQ ID NO: 14000)

3'-UUUUGUCUUUAGUUUUCCUAAAACUCA-5' (SEQ ID NO: 7070)

C5-2964 Target:
5'-AAAACAGAAATCAAAAGGATTTTGAGT-3' (SEQ ID NO: 9380)

5'-AAACAGAAAUCAAAAGGAUUUUGAGUG-3' (SEQ ID NO: 14001)

3'-UUUGUCUUUAGUUUUCCUAAAACUCAC-5' (SEQ ID NO: 7071)

C5-2965 Target:
5'-AAACAGAAATCAAAAGGATTTTGAGTG-3' (SEQ ID NO: 9381)

5'-AACAGAAAUCAAAAGGAUUUUGAGUGU-3' (SEQ ID NO: 14002)

3'-UUGUCUUUAGUUUUCCUAAAACUCACA-5' (SEQ ID NO: 7072)

C5-2966 Target:
5'-AACAGAAATCAAAAGGATTTTGAGTGT-3' (SEQ ID NO: 9382)

5'-AGAAAUCAAAAGGAUUUUGAGUGUAAA-3' (SEQ ID NO: 14003)

3'-UCUUUAGUUUUCCUAAAACUCACAUUU-5' (SEQ ID NO: 7073)

C5-2969 Target:
5'-AGAAATCAAAAGGATTTTGAGTGTAAA-3' (SEQ ID NO: 9383)

5'-GAAAUCAAAAGGAUUUUGAGUGUAAAA-3' (SEQ ID NO: 14004)

3'-CUUUAGUUUUCCUAAAACUCACAUUUU-5' (SEQ ID NO: 7074)

C5-2970 Target:
5'-GAAATCAAAAGGATTTTGAGTGTAAAA-3' (SEQ ID NO: 9384)

5'-AAAUCAAAAGGAUUUUGAGUGUAAAAG-3' (SEQ ID NO: 14005)

3'-UUUAGUUUUCCUAAAACUCACAUUUUC-5' (SEQ ID NO: 7075)

C5-2971 Target:
5'-AAATCAAAAGGATTTTGAGTGTAAAAG-3' (SEQ ID NO: 9385)

5'-AAUCAAAAGGAUUUUGAGUGUAAAAGG-3' (SEQ ID NO: 14006)

3'-UUAGUUUUCCUAAAACUCACAUUUUCC-5' (SEQ ID NO: 7076)

C5-2972 Target:
5'-AATCAAAAGGATTTTGAGTGTAAAAGG-3' (SEQ ID NO: 9386)

5'-UCAAAAGGAUUUUGAGUGUAAAAGGAC-3' (SEQ ID NO: 14007)

3'-AGUUUUCCUAAAACUCACAUUUUCCUG-5' (SEQ ID NO: 7077)

C5-2974 Target:
5'-TCAAAAGGATTTTGAGTGTAAAAGGAC-3' (SEQ ID NO: 9387)

5'-CAAAAGGAUUUUGAGUGUAAAAGGACU-3' (SEQ ID NO: 14008)

3'-GUUUUCCUAAAACUCACAUUUUCCUGA-5' (SEQ ID NO: 7078)

C5-2975 Target:
5'-CAAAAGGATTTTGAGTGTAAAAGGACT-3' (SEQ ID NO: 9388)

5'-AAAAGGAUUUUGAGUGUAAAAGGACUG-3' (SEQ ID NO: 14009)

3'-UUUUCCUAAAACUCACAUUUUCCUGAC-5' (SEQ ID NO: 7079)

C5-2976 Target:
5'-AAAAGGATTTTGAGTGTAAAAGGACTG-3' (SEQ ID NO: 9389)

5'-AAAGGAUUUUGAGUGUAAAAGGACUGC-3' (SEQ ID NO: 14010)

3'-UUUCCUAAAACUCACAUUUUCCUGACG-5' (SEQ ID NO: 7080)

C5-2977 Target:
5'-AAAGGATTTTGAGTGTAAAAGGACTGC-3' (SEQ ID NO: 9390)

5'-AAGGAUUUUGAGUGUAAAAGGACUGCU-3' (SEQ ID NO: 14011)

3'-UUCCUAAAACUCACAUUUUCCUGACGA-5' (SEQ ID NO: 7081)

C5-2978 Target:
5'-AAGGATTTTGAGTGTAAAAGGACTGCT-3' (SEQ ID NO: 9391)

5'-AGGAUUUUGAGUGUAAAAGGACUGCUU-3' (SEQ ID NO: 14012)

3'-UCCUAAAACUCACAUUUUCCUGACGAA-5' (SEQ ID NO: 7082)

TABLE 9-continued

"Blunt/Blunt" DsiRNAs Corresponding to Human Anti-C5 DsiRNAs Predicted to have >50% Knockdown Efficacy C5-2979 Target:
5'-AGGATTTTGAGTGTAAAAGGACTGCTT-3' (SEQ ID NO: 9392)

5'-GGAUUUUGAGUGUAAAAGGACUGCUUG-3' (SEQ ID NO: 14013)

3'-CCUAAAACUCACAUUUUCCUGACGAAC-5' (SEQ ID NO: 7083)

C5-2980 Target:
5'-GGATTTTGAGTGTAAAAGGACTGCTTG-3' (SEQ ID NO: 9393)

5'-GAUUUUGAGUGUAAAAGGACUGCUUGU-3' (SEQ ID NO: 14014)

3'-CUAAAACUCACAUUUUCCUGACGAACA-5' (SEQ ID NO: 7084)

C5-2981 Target:
5'-GATTTTGAGTGTAAAAGGACTGCTTGT-3' (SEQ ID NO: 9394)

5'-AUUUUGAGUGUAAAAGGACUGCUUGUA-3' (SEQ ID NO: 14015)

3'-UAAAACUCACAUUUUCCUGACGAACAU-5' (SEQ ID NO: 7085)

C5-2982 Target:
5'-ATTTTGAGTGTAAAAGGACTGCTTGTA-3' (SEQ ID NO: 9395)

5'-UUUUGAGUGUAAAAGGACUGCUUGUAG-3' (SEQ ID NO: 14016)

3'-AAAACUCACAUUUUCCUGACGAACAUC-5' (SEQ ID NO: 7086)

C5-2983 Target:
5'-TTTTGAGTGTAAAAGGACTGCTTGTAG-3' (SEQ ID NO: 9396)

5'-UUUGAGUGUAAAAGGACUGCUUGUAGG-3' (SEQ ID NO: 14017)

3'-AAACUCACAUUUUCCUGACGAACAUCC-5' (SEQ ID NO: 7087)

C5-2984 Target:
5'-TTTGAGTGTAAAAGGACTGCTTGTAGG-3' (SEQ ID NO: 9397)

5'-UUGAGUGUAAAAGGACUGCUUGUAGGU-3' (SEQ ID NO: 14018)

3'-AACUCACAUUUUCCUGACGAACAUCCA-5' (SEQ ID NO: 7088)

C5-2985 Target:
5'-TTGAGTGTAAAAGGACTGCTTGTAGGT-3' (SEQ ID NO: 9398)

5'-UGAGUGUAAAAGGACUGCUUGUAGGUG-3' (SEQ ID NO: 14019)

3'-ACUCACAUUUUCCUGACGAACAUCCAC-5' (SEQ ID NO: 7089)

C5-2986 Target:
5'-TGAGTGTAAAAGGACTGCTTGTAGGTG-3' (SEQ ID NO: 9399)

5'-GAGUGUAAAAGGACUGCUUGUAGGUGA-3' (SEQ ID NO: 14020)

3'-CUCACAUUUUCCUGACGAACAUCCACU-5' (SEQ ID NO: 7090)

C5-2987 Target:
5'-GAGTGTAAAAGGACTGCTTGTAGGTGA-3' (SEQ ID NO: 9400)

5'-AGUGUAAAAGGACUGCUUGUAGGUGAG-3' (SEQ ID NO: 14021)

3'-UCACAUUUUCCUGACGAACAUCCACUC-5' (SEQ ID NO: 7091)

C5-2988 Target:
5'-AGTGTAAAAGGACTGCTTGTAGGTGAG-3' (SEQ ID NO: 9401)

5'-GUGUAAAAGGACUGCUUGUAGGUGAGA-3' (SEQ ID NO: 14022)

3'-CACAUUUUCCUGACGAACAUCCACUCU-5' (SEQ ID NO: 7092)

C5-2989 Target:
5'-GTGTAAAAGGACTGCTTGTAGGTGAGA-3' (SEQ ID NO: 9402)

5'-UGUAAAAGGACUGCUUGUAGGUGAGAU-3' (SEQ ID NO: 14023)

3'-ACAUUUUCCUGACGAACAUCCACUCUA-5' (SEQ ID NO: 7093)

C5-2990 Target:
5'-TGTAAAAGGACTGCTTGTAGGTGAGAT-3' (SEQ ID NO: 9403)

5'-GUAAAAGGACUGCUUGUAGGUGAGAUC-3' (SEQ ID NO: 14024)

3'-CAUUUUCCUGACGAACAUCCACUCUAG-5' (SEQ ID NO: 7094)

C5-2991 Target:
5'-GTAAAAGGACTGCTTGTAGGTGAGATC-3' (SEQ ID NO: 9404)

5'-UAAAAGGACUGCUUGUAGGUGAGAUCU-3' (SEQ ID NO: 14025)

3'-AUUUUCCUGACGAACAUCCACUCUAGA-5' (SEQ ID NO: 7095)

C5-2992 Target:
5'-TAAAAGGACTGCTTGTAGGTGAGATCT-3' (SEQ ID NO: 9405)

5'-AAAAGGACUGCUUGUAGGUGAGAUCUU-3' (SEQ ID NO: 14026)

3'-UUUUCCUGACGAACAUCCACUCUAGAA-5' (SEQ ID NO: 7096)

C5-2993 Target:
5'-AAAAGGACTGCTTGTAGGTGAGATCTT-3' (SEQ ID NO: 9406)

5'-AAAGGACUGCUUGUAGGUGAGAUCUUG-3' (SEQ ID NO: 14027)

3'-UUUCCUGACGAACAUCCACUCUAGAAC-5' (SEQ ID NO: 7097)

C5-2994 Target:
5'-AAAGGACTGCTTGTAGGTGAGATCTTG-3' (SEQ ID NO: 9407)

5'-AAGGACUGCUUGUAGGUGAGAUCUUGU-3' (SEQ ID NO: 14028)

3'-UUCCUGACGAACAUCCACUCUAGAACA-5' (SEQ ID NO: 7098)

C5-2995 Target:
5'-AAGGACTGCTTGTAGGTGAGATCTTGT-3' (SEQ ID NO: 9408)

5'-AGGACUGCUUGUAGGUGAGAUCUUGUC-3' (SEQ ID NO: 14029)

3'-UCCUGACGAACAUCCACUCUAGAACAG-5' (SEQ ID NO: 7099)

C5-2996 Target:
5'-AGGACTGCTTGTAGGTGAGATCTTGTC-3' (SEQ ID NO: 9409)

5'-GGACUGCUUGUAGGUGAGAUCUUGUCU-3' (SEQ ID NO: 14030)

3'-CCUGACGAACAUCCACUCUAGAACAGA-5' (SEQ ID NO: 7100)

C5-2997 Target:
5'-GGACTGCTTGTAGGTGAGATCTTGTCT-3' (SEQ ID NO: 9410)

5'-GACUGCUUGUAGGUGAGAUCUUGUCUG-3' (SEQ ID NO: 14031)

3'-CUGACGAACAUCCACUCUAGAACAGAC-5' (SEQ ID NO: 7101)

C5-2998 Target:
5'-GACTGCTTGTAGGTGAGATCTTGTCTG-3' (SEQ ID NO: 9411)

5'-ACUGCUUGUAGGUGAGAUCUUGUCUGC-3' (SEQ ID NO: 14032)

3'-UGACGAACAUCCACUCUAGAACAGACG-5' (SEQ ID NO: 7102)

TABLE 9-continued

"Blunt/Blunt" DsiRNAs Corresponding to Human Anti-C5 DsiRNAs Predicted to have >50% Knockdown Efficacy C5-2999 Target:
5'-ACTGCTTGTAGGTGAGATCTTGTCTGC-3' (SEQ ID NO: 9412)

5'-CUGCUUGUAGGUGAGAUCUUGUCUGCA-3' (SEQ ID NO: 14033)

3'-GACGAACAUCCACUCUAGAACAGACGU-5' (SEQ ID NO: 7103)

C5-3000 Target:
5'-CTGCTTGTAGGTGAGATCTTGTCTGCA-3' (SEQ ID NO: 9413)

5'-UGCUUGUAGGUGAGAUCUUGUCUGCAG-3' (SEQ ID NO: 14034)

3'-ACGAACAUCCACUCUAGAACAGACGUC-5' (SEQ ID NO: 7104)

C5-3001 Target:
5'-TGCTTGTAGGTGAGATCTTGTCTGCAG-3' (SEQ ID NO: 9414)

5'-GCUUGUAGGUGAGAUCUUGUCUGCAGU-3' (SEQ ID NO: 14035)

3'-CGAACAUCCACUCUAGAACAGACGUCA-5' (SEQ ID NO: 7105)

C5-3002 Target:
5'-GCTTGTAGGTGAGATCTTGTCTGCAGT-3' (SEQ ID NO: 9415)

5'-CUUGUAGGUGAGAUCUUGUCUGCAGUU-3' (SEQ ID NO: 14036)

3'-GAACAUCCACUCUAGAACAGACGUCAA-5' (SEQ ID NO: 7106)

C5-3003 Target:
5'-CTTGTAGGTGAGATCTTGTCTGCAGTT-3' (SEQ ID NO: 9416)

5'-UUGUAGGUGAGAUCUUGUCUGCAGUUC-3' (SEQ ID NO: 14037)

3'-AACAUCCACUCUAGAACAGACGUCAAG-5' (SEQ ID NO: 7107)

C5-3004 Target:
5'-TTGTAGGTGAGATCTTGTCTGCAGTTC-3' (SEQ ID NO: 9417)

5'-UGUAGGUGAGAUCUUGUCUGCAGUUCU-3' (SEQ ID NO: 14038)

3'-ACAUCCACUCUAGAACAGACGUCAAGA-5' (SEQ ID NO: 7108)

C5-3005 Target:
5'-TGTAGGTGAGATCTTGTCTGCAGTTCT-3' (SEQ ID NO: 9418)

5'-GUAGGUGAGAUCUUGUCUGCAGUUCUA-3' (SEQ ID NO: 14039)

3'-CAUCCACUCUAGAACAGACGUCAAGAU-5' (SEQ ID NO: 7109)

C5-3006 Target:
5'-GTAGGTGAGATCTTGTCTGCAGTTCTA-3' (SEQ ID NO: 9419)

5'-UAGGUGAGAUCUUGUCUGCAGUUCUAA-3' (SEQ ID NO: 14040)

3'-AUCCACUCUAGAACAGACGUCAAGAUU-5' (SEQ ID NO: 7110)

C5-3007 Target:
5'-TAGGTGAGATCTTGTCTGCAGTTCTAA-3' (SEQ ID NO: 9420)

5'-AGGUGAGAUCUUGUCUGCAGUUCUAAG-3' (SEQ ID NO: 14041)

3'-UCCACUCUAGAACAGACGUCAAGAUUC-5' (SEQ ID NO: 7111)

C5-3008 Target:
5'-AGGTGAGATCTTGTCTGCAGTTCTAAG-3' (SEQ ID NO: 9421)

5'-GGUGAGAUCUUGUCUGCAGUUCUAAGU-3' (SEQ ID NO: 14042)

3'-CCACUCUAGAACAGACGUCAAGAUUCA-5' (SEQ ID NO: 7112)

C5-3009 Target:
5'-GGTGAGATCTTGTCTGCAGTTCTAAGT-3' (SEQ ID NO: 9422)

5'-GUGAGAUCUUGUCUGCAGUUCUAAGUC-3' (SEQ ID NO: 14043)

3'-CACUCUAGAACAGACGUCAAGAUUCAG-5' (SEQ ID NO: 7113)

C5-3010 Target:
5'-GTGAGATCTTGTCTGCAGTTCTAAGTC-3' (SEQ ID NO: 9423)

5'-UGAGAUCUUGUCUGCAGUUCUAAGUCA-3' (SEQ ID NO: 14044)

3'-ACUCUAGAACAGACGUCAAGAUUCAGU-5' (SEQ ID NO: 7114)

C5-3011 Target:
5'-TGAGATCTTGTCTGCAGTTCTAAGTCA-3' (SEQ ID NO: 9424)

5'-GAGAUCUUGUCUGCAGUUCUAAGUCAG-3' (SEQ ID NO: 14045)

3'-CUCUAGAACAGACGUCAAGAUUCAGUC-5' (SEQ ID NO: 7115)

C5-3012 Target:
5'-GAGATCTTGTCTGCAGTTCTAAGTCAG-3' (SEQ ID NO: 9425)

5'-AGAUCUUGUCUGCAGUUCUAAGUCAGG-3' (SEQ ID NO: 14046)

3'-UCUAGAACAGACGUCAAGAUUCAGUCC-5' (SEQ ID NO: 7116)

C5-3013 Target:
5'-AGATCTTGTCTGCAGTTCTAAGTCAGG-3' (SEQ ID NO: 9426)

5'-GAUCUUGUCUGCAGUUCUAAGUCAGGA-3' (SEQ ID NO: 14047)

3'-CUAGAACAGACGUCAAGAUUCAGUCCU-5' (SEQ ID NO: 7117)

C5-3014 Target:
5'-GATCTTGTCTGCAGTTCTAAGTCAGGA-3' (SEQ ID NO: 9427)

5'-AUCUUGUCUGCAGUUCUAAGUCAGGAA-3' (SEQ ID NO: 14048)

3'-UAGAACAGACGUCAAGAUUCAGUCCUU-5' (SEQ ID NO: 7118)

C5-3015 Target:
5'-ATCTTGTCTGCAGTTCTAAGTCAGGAA-3' (SEQ ID NO: 9428)

5'-UCUUGUCUGCAGUUCUAAGUCAGGAAG-3' (SEQ ID NO: 14049)

3'-AGAACAGACGUCAAGAUUCAGUCCUUC-5' (SEQ ID NO: 7119)

C5-3016 Target:
5'-TCTTGTCTGCAGTTCTAAGTCAGGAAG-3' (SEQ ID NO: 9429)

5'-CAGGAAGGCAUCAAUAUCCUAACCCAC-3' (SEQ ID NO: 14050)

3'-GUCCUUCCGUAGUUAUAGGAUUGGGUG-5' (SEQ ID NO: 7120)

C5-3036 Target:
5'-CAGGAAGGCATCAATATCCTAACCCAC-3' (SEQ ID NO: 9430)

5'-AGGAAGGCAUCAAUAUCCUAACCCACC-3' (SEQ ID NO: 14051)

3'-UCCUUCCGUAGUUAUAGGAUUGGGUGG-5' (SEQ ID NO: 7121)

C5-3037 Target:
5'-AGGAAGGCATCAATATCCTAACCCACC-3' (SEQ ID NO: 9431)

5'-GGAAGGCAUCAAUAUCCUAACCCACCU-3' (SEQ ID NO: 14052)

3'-CCUUCCGUAGUUAUAGGAUUGGGUGGA-5' (SEQ ID NO: 7122)

TABLE 9-continued

"Blunt/Blunt" DsiRNAs Corresponding to Human Anti-C5 DsiRNAs Predicted to have >50% Knockdown Efficacy C5-3038 Target:
5'-GGAAGGCATCAATATCCTAACCCACCT-3' (SEQ ID NO: 9432)

5'-GAAGGCAUCAAUAUCCUAACCCACCUC-3' (SEQ ID NO: 14053)

3'-CUUCCGUAGUUAUAGGAUUGGGUGGAG-5' (SEQ ID NO: 7123)

C5-3039 Target:
5'-GAAGGCATCAATATCCTAACCCACCTC-3' (SEQ ID NO: 9433)

5'-AAGGCAUCAAUAUCCUAACCCACCUCC-3' (SEQ ID NO: 14054)

3'-UUCCGUAGUUAUAGGAUUGGGUGGAGG-5' (SEQ ID NO: 7124)

C5-3040 Target:
5'-AAGGCATCAATATCCTAACCCACCTCC-3' (SEQ ID NO: 9434)

5'-AGGCAUCAAUAUCCUAACCCACCUCCC-3' (SEQ ID NO: 14055)

3'-UCCGUAGUUAUAGGAUUGGGUGGAGGG-5' (SEQ ID NO: 7125)

C5-3041 Target:
5'-AGGCATCAATATCCTAACCCACCTCCC-3' (SEQ ID NO: 9435)

5'-GGCAUCAAUAUCCUAACCCACCUCCCC-3' (SEQ ID NO: 14056)

3'-CCGUAGUUAUAGGAUUGGGUGGAGGGG-5' (SEQ ID NO: 7126)

C5-3042 Target:
5'-GGCATCAATATCCTAACCCACCTCCCC-3' (SEQ ID NO: 9436)

5'-GCAUCAAUAUCCUAACCCACCUCCCCA-3' (SEQ ID NO: 14057)

3'-CGUAGUUAUAGGAUUGGGUGGAGGGGU-5' (SEQ ID NO: 7127)

C5-3043 Target:
5'-GCATCAATATCCTAACCCACCTCCCCA-3' (SEQ ID NO: 9437)

5'-CAUCAAUAUCCUAACCCACCUCCCCAA-3' (SEQ ID NO: 14058)

3'-GUAGUUAUAGGAUUGGGUGGAGGGGUU-5' (SEQ ID NO: 7128)

C5-3044 Target:
5'-CATCAATATCCTAACCCACCTCCCCAA-3' (SEQ ID NO: 9438)

5'-AUCAAUAUCCUAACCCACCUCCCCAAA-3' (SEQ ID NO: 14059)

3'-UAGUUAUAGGAUUGGGUGGAGGGGUUU-5' (SEQ ID NO: 7129)

C5-3045 Target:
5'-ATCAATATCCTAACCCACCTCCCCAAA-3' (SEQ ID NO: 9439)

5'-UCAAUAUCCUAACCCACCUCCCCAAAG-3' (SEQ ID NO: 14060)

3'-AGUUAUAGGAUUGGGUGGAGGGGUUUC-5' (SEQ ID NO: 7130)

C5-3046 Target:
5'-TCAATATCCTAACCCACCTCCCCAAAG-3' (SEQ ID NO: 9440)

5'-CAAUAUCCUAACCCACCUCCCCAAAGG-3' (SEQ ID NO: 14061)

3'-GUUAUAGGAUUGGGUGGAGGGGUUUCC-5' (SEQ ID NO: 7131)

C5-3047 Target:
5'-CAATATCCTAACCCACCTCCCCAAAGG-3' (SEQ ID NO: 9441)

5'-AAUAUCCUAACCCACCUCCCCAAAGGG-3' (SEQ ID NO: 14062)

3'-UUAUAGGAUUGGGUGGAGGGGUUUCCC-5' (SEQ ID NO: 7132)

C5-3048 Target:
5'-AATATCCTAACCCACCTCCCCAAAGGG-3' (SEQ ID NO: 9442)

5'-CUAACCCACCUCCCCAAAGGGAGUGCA-3' (SEQ ID NO: 14063)

3'-GAUUGGGUGGAGGGGUUUCCCUCACGU-5' (SEQ ID NO: 7133)

C5-3054 Target:
5'-CTAACCCACCTCCCCAAAGGGAGTGCA-3' (SEQ ID NO: 9443)

5'-UAACCCACCUCCCCAAAGGGAGUGCAG-3' (SEQ ID NO: 14064)

3'-AUUGGGUGGAGGGGUUUCCCUCACGUC-5' (SEQ ID NO: 7134)

C5-3055 Target:
5'-TAACCCACCTCCCCAAAGGGAGTGCAG-3' (SEQ ID NO: 9444)

5'-AACCCACCUCCCCAAAGGGAGUGCAGA-3' (SEQ ID NO: 14065)

3'-UUGGGUGGAGGGGUUUCCCUCACGUCU-5' (SEQ ID NO: 7135)

C5-3056 Target:
5'-AACCCACCTCCCCAAAGGGAGTGCAGA-3' (SEQ ID NO: 9445)

5'-CAGAGGCGGAGCUGAUGAGCGUUGUCC-3' (SEQ ID NO: 14066)

3'-GUCUCCGCCUCGACUACUCGCAACAGG-5' (SEQ ID NO: 7136)

C5-3079 Target:
5'-CAGAGGCGGAGCTGATGAGCGTTGTCC-3' (SEQ ID NO: 9446)

5'-AGGCGGAGCUGAUGAGCGUUGUCCCAG-3' (SEQ ID NO: 14067)

3'-UCCGCCUCGACUACUCGCAACAGGGUC-5' (SEQ ID NO: 7137)

C5-3082 Target:
5'-AGGCGGAGCTGATGAGCGTTGTCCCAG-3' (SEQ ID NO: 9447)

5'-GGCGGAGCUGAUGAGCGUUGUCCCAGU-3' (SEQ ID NO: 14068)

3'-CCGCCUCGACUACUCGCAACAGGGUCA-5' (SEQ ID NO: 7138)

C5-3083 Target:
5'-GGCGGAGCTGATGAGCGTTGTCCCAGT-3' (SEQ ID NO: 9448)

5'-GCGGAGCUGAUGAGCGUUGUCCCAGUA-3' (SEQ ID NO: 14069)

3'-CGCCUCGACUACUCGCAACAGGGUCAU-5' (SEQ ID NO: 7139)

C5-3084 Target:
5'-GCGGAGCTGATGAGCGTTGTCCCAGTA-3' (SEQ ID NO: 9449)

5'-CGGAGCUGAUGAGCGUUGUCCCAGUAU-3' (SEQ ID NO: 14070)

3'-GCCUCGACUACUCGCAACAGGGUCAUA-5' (SEQ ID NO: 7140)

C5-3085 Target:
5'-CGGAGCTGATGAGCGTTGTCCCAGTAT-3' (SEQ ID NO: 9450)

5'-GGAGCUGAUGAGCGUUGUCCCAGUAUU-3' (SEQ ID NO: 14071)

3'-CCUCGACUACUCGCAACAGGGUCAUAA-5' (SEQ ID NO: 7141)

C5-3086 Target:
5'-GGAGCTGATGAGCGTTGTCCCAGTATT-3' (SEQ ID NO: 9451)

5'-GAGCUGAUGAGCGUUGUCCCAGUAUUC-3' (SEQ ID NO: 14072)

3'-CUCGACUACUCGCAACAGGGUCAUAAG-5' (SEQ ID NO: 7142)

TABLE 9-continued

"Blunt/Blunt" DsiRNAs Corresponding to Human Anti-C5 DsiRNAs Predicted to have >50% Knockdown Efficacy C5-3087 Target:
5'-GAGCTGATGAGCGTTGTCCCAGTATTC-3' (SEQ ID NO: 9452)

5'-AGCUGAUGAGCGUUGUCCCAGUAUUCU-3' (SEQ ID NO: 14073)

3'-UCGACUACUCGCAACAGGGUCAUAAGA-5' (SEQ ID NO: 7143)

C5-3088 Target:
5'-AGCTGATGAGCGTTGTCCCAGTATTCT-3' (SEQ ID NO: 9453)

5'-GCUGAUGAGCGUUGUCCCAGUAUUCUA-3' (SEQ ID NO: 14074)

3'-CGACUACUCGCAACAGGGUCAUAAGAU-5' (SEQ ID NO: 7144)

C5-3089 Target:
5'-GCTGATGAGCGTTGTCCCAGTATTCTA-3' (SEQ ID NO: 9454)

5'-CUGAUGAGCGUUGUCCCAGUAUUCUAU-3' (SEQ ID NO: 14075)

3'-GACUACUCGCAACAGGGUCAUAAGAUA-5' (SEQ ID NO: 7145)

C5-3090 Target:
5'-CTGATGAGCGTTGTCCCAGTATTCTAT-3' (SEQ ID NO: 9455)

5'-UGAUGAGCGUUGUCCCAGUAUUCUAUG-3' (SEQ ID NO: 14076)

3'-ACUACUCGCAACAGGGUCAUAAGAUAC-5' (SEQ ID NO: 7146)

C5-3091 Target:
5'-TGATGAGCGTTGTCCCAGTATTCTATG-3' (SEQ ID NO: 9456)

5'-GAUGAGCGUUGUCCCAGUAUUCUAUGU-3' (SEQ ID NO: 14077)

3'-CUACUCGCAACAGGGUCAUAAGAUACA-5' (SEQ ID NO: 7147)

C5-3092 Target:
5'-GATGAGCGTTGTCCCAGTATTCTATGT-3' (SEQ ID NO: 9457)

5'-AUGAGCGUUGUCCCAGUAUUCUAUGUU-3' (SEQ ID NO: 14078)

3'-UACUCGCAACAGGGUCAUAAGAUACAA-5' (SEQ ID NO: 7148)

C5-3093 Target:
5'-ATGAGCGTTGTCCCAGTATTCTATGTT-3' (SEQ ID NO: 9458)

5'-UGAGCGUUGUCCCAGUAUUCUAUGUUU-3' (SEQ ID NO: 14079)

3'-ACUCGCAACAGGGUCAUAAGAUACAAA-5' (SEQ ID NO: 7149)

C5-3094 Target:
5'-TGAGCGTTGTCCCAGTATTCTATGTTT-3' (SEQ ID NO: 9459)

5'-GAGCGUUGUCCCAGUAUUCUAUGUUUU-3' (SEQ ID NO: 14080)

3'-CUCGCAACAGGGUCAUAAGAUACAAAA-5' (SEQ ID NO: 7150)

C5-3095 Target:
5'-GAGCGTTGTCCCAGTATTCTATGTTTT-3' (SEQ ID NO: 9460)

5'-AGCGUUGUCCCAGUAUUCUAUGUUUUU-3' (SEQ ID NO: 14081)

3'-UCGCAACAGGGUCAUAAGAUACAAAAA-5' (SEQ ID NO: 7151)

C5-3096 Target:
5'-AGCGTTGTCCCAGTATTCTATGTTTTT-3' (SEQ ID NO: 9461)

5'-GCGUUGUCCCAGUAUUCUAUGUUUUUC-3' (SEQ ID NO: 14082)

3'-CGCAACAGGGUCAUAAGAUACAAAAAG-5' (SEQ ID NO: 7152)

C5-3097 Target:
5'-GCGTTGTCCCAGTATTCTATGTTTTTC-3' (SEQ ID NO: 9462)

5'-CGUUGUCCCAGUAUUCUAUGUUUUUCA-3' (SEQ ID NO: 14083)

3'-GCAACAGGGUCAUAAGAUACAAAAAGU-5' (SEQ ID NO: 7153)

C5-3098 Target:
5'-CGTTGTCCCAGTATTCTATGTTTTTCA-3' (SEQ ID NO: 9463)

5'-GUUGUCCCAGUAUUCUAUGUUUUUCAC-3' (SEQ ID NO: 14084)

3'-CAACAGGGUCAUAAGAUACAAAAAGUG-5' (SEQ ID NO: 7154)

C5-3099 Target:
5'-GTTGTCCCAGTATTCTATGTTTTTCAC-3' (SEQ ID NO: 9464)

5'-UUGUCCCAGUAUUCUAUGUUUUUCACU-3' (SEQ ID NO: 14085)

3'-AACAGGGUCAUAAGAUACAAAAAGUGA-5' (SEQ ID NO: 7155)

C5-3100 Target:
5'-TTGTCCCAGTATTCTATGTTTTTCACT-3' (SEQ ID NO: 9465)

5'-UGUCCCAGUAUUCUAUGUUUUUCACUA-3' (SEQ ID NO: 14086)

3'-ACAGGGUCAUAAGAUACAAAAAGUGAU-5' (SEQ ID NO: 7156)

C5-3101 Target:
5'-TGTCCCAGTATTCTATGTTTTTCACTA-3' (SEQ ID NO: 9466)

5'-GUCCCAGUAUUCUAUGUUUUUCACUAC-3' (SEQ ID NO: 14087)

3'-CAGGGUCAUAAGAUACAAAAAGUGAUG-5' (SEQ ID NO: 7157)

C5-3102 Target:
5'-GTCCCAGTATTCTATGTTTTTCACTAC-3' (SEQ ID NO: 9467)

5'-CCCAGUAUUCUAUGUUUUUCACUACCU-3' (SEQ ID NO: 14088)

3'-GGGUCAUAAGAUACAAAAAGUGAUGGA-5' (SEQ ID NO: 7158)

C5-3104 Target:
5'-CCCAGTATTCTATGTTTTTCACTACCT-3' (SEQ ID NO: 9468)

5'-CCAGUAUUCUAUGUUUUUCACUACCUG-3' (SEQ ID NO: 14089)

3'-GGUCAUAAGAUACAAAAAGUGAUGGAC-5' (SEQ ID NO: 7159)

C5-3105 Target:
5'-CCAGTATTCTATGTTTTTCACTACCTG-3' (SEQ ID NO: 9469)

5'-CAGUAUUCUAUGUUUUUCACUACCUGG-3' (SEQ ID NO: 14090)

3'-GUCAUAAGAUACAAAAAGUGAUGGACC-5' (SEQ ID NO: 7160)

C5-3106 Target:
5'-CAGTATTCTATGTTTTTCACTACCTGG-3' (SEQ ID NO: 9470)

5'-AGUAUUCUAUGUUUUUCACUACCUGGA-3' (SEQ ID NO: 14091)

3'-UCAUAAGAUACAAAAAGUGAUGGACCU-5' (SEQ ID NO: 7161)

C5-3107 Target:
5'-AGTATTCTATGTTTTTCACTACCTGGA-3' (SEQ ID NO: 9471)

5'-GUAUUCUAUGUUUUUCACUACCUGGAA-3' (SEQ ID NO: 14092)

3'-CAUAAGAUACAAAAAGUGAUGGACCUU-5' (SEQ ID NO: 7162)

TABLE 9-continued

"Blunt/Blunt" DsiRNAs Corresponding to Human Anti-C5 DsiRNAs Predicted to have >50% Knockdown Efficacy C5-3108 Target:
5'-GTATTCTATGTTTTTCACTACCTGGAA-3' (SEQ ID NO: 9472)

5'-UAUUCUAUGUUUUUCACUACCUGGAAA-3' (SEQ ID NO: 14093)

3'-AUAAGAUACAAAAAGUGAUGGACCUUU-5' (SEQ ID NO: 7163)

C5-3109 Target:
5'-TATTCTATGTTTTTCACTACCTGGAAA-3' (SEQ ID NO: 9473)

5'-AUUCUAUGUUUUUCACUACCUGGAAAC-3' (SEQ ID NO: 14094)

3'-UAAGAUACAAAAAGUGAUGGACCUUUG-5' (SEQ ID NO: 7164)

C5-3110 Target:
5'-ATTCTATGTTTTTCACTACCTGGAAAC-3' (SEQ ID NO: 9474)

5'-UUCUAUGUUUUUCACUACCUGGAAACA-3' (SEQ ID NO: 14095)

3'-AAGAUACAAAAAGUGAUGGACCUUUGU-5' (SEQ ID NO: 7165)

C5-3111 Target:
5'-TTCTATGTTTTTCACTACCTGGAAACA-3' (SEQ ID NO: 9475)

5'-UCUAUGUUUUUCACUACCUGGAAACAG-3' (SEQ ID NO: 14096)

3'-AGAUACAAAAAGUGAUGGACCUUUGUC-5' (SEQ ID NO: 7166)

C5-3112 Target:
5'-TCTATGTTTTTCACTACCTGGAAACAG-3' (SEQ ID NO: 9476)

5'-CUAUGUUUUUCACUACCUGGAAACAGG-3' (SEQ ID NO: 14097)

3'-GAUACAAAAAGUGAUGGACCUUUGUCC-5' (SEQ ID NO: 7167)

C5-3113 Target:
5'-CTATGTTTTTCACTACCTGGAAACAGG-3' (SEQ ID NO: 9477)

5'-UAUGUUUUUCACUACCUGGAAACAGGA-3' (SEQ ID NO: 14098)

3'-AUACAAAAAGUGAUGGACCUUUGUCCU-5' (SEQ ID NO: 7168)

C5-3114 Target:
5'-TATGTTTTTCACTACCTGGAAACAGGA-3' (SEQ ID NO: 9478)

5'-AUGUUUUUCACUACCUGGAAACAGGAA-3' (SEQ ID NO: 14099)

3'-UACAAAAAGUGAUGGACCUUUGUCCUU-5' (SEQ ID NO: 7169)

C5-3115 Target:
5'-ATGTTTTTCACTACCTGGAAACAGGAA-3' (SEQ ID NO: 9479)

5'-UGUUUUUCACUACCUGGAAACAGGAAA-3' (SEQ ID NO: 14100)

3'-ACAAAAAGUGAUGGACCUUUGUCCUUU-5' (SEQ ID NO: 7170)

C5-3116 Target:
5'-TGTTTTTCACTACCTGGAAACAGGAAA-3' (SEQ ID NO: 9480)

5'-GUUUUUCACUACCUGGAAACAGGAAAU-3' (SEQ ID NO: 14101)

3'-CAAAAAGUGAUGGACCUUUGUCCUUUA-5' (SEQ ID NO: 7171)

C5-3117 Target:
5'-GTTTTTCACTACCTGGAAACAGGAAAT-3' (SEQ ID NO: 9481)

5'-UUUUUCACUACCUGGAAACAGGAAAUC-3' (SEQ ID NO: 14102)

3'-AAAAAGUGAUGGACCUUUGUCCUUUAG-5' (SEQ ID NO: 7172)

C5-3118 Target:
5'-TTTTTCACTACCTGGAAACAGGAAATC-3' (SEQ ID NO: 9482)

5'-UUUUCACUACCUGGAAACAGGAAAUCA-3' (SEQ ID NO: 14103)

3'-AAAAGUGAUGGACCUUUGUCCUUUAGU-5' (SEQ ID NO: 7173)

C5-3119 Target:
5'-TTTTCACTACCTGGAAACAGGAAATCA-3' (SEQ ID NO: 9483)

5'-UUUCACUACCUGGAAACAGGAAAUCAU-3' (SEQ ID NO: 14104)

3'-AAAGUGAUGGACCUUUGUCCUUUAGUA-5' (SEQ ID NO: 7174)

C5-3120 Target:
5'-TTTCACTACCTGGAAACAGGAAATCAT-3' (SEQ ID NO: 9484)

5'-UUCACUACCUGGAAACAGGAAAUCAUU-3' (SEQ ID NO: 14105)

3'-AAGUGAUGGACCUUUGUCCUUUAGUAA-5' (SEQ ID NO: 7175)

C5-3121 Target:
5'-TTCACTACCTGGAAACAGGAAATCATT-3' (SEQ ID NO: 9485)

5'-UCACUACCUGGAAACAGGAAAUCAUUG-3' (SEQ ID NO: 14106)

3'-AGUGAUGGACCUUUGUCCUUUAGUAAC-5' (SEQ ID NO: 7176)

C5-3122 Target:
5'-TCACTACCTGGAAACAGGAAATCATTG-3' (SEQ ID NO: 9486)

5'-CACUACCUGGAAACAGGAAAUCAUUGG-3' (SEQ ID NO: 14107)

3'-GUGAUGGACCUUUGUCCUUUAGUAACC-5' (SEQ ID NO: 7177)

C5-3123 Target:
5'-CACTACCTGGAAACAGGAAATCATTGG-3' (SEQ ID NO: 9487)

5'-ACUACCUGGAAACAGGAAAUCAUUGGA-3' (SEQ ID NO: 14108)

3'-UGAUGGACCUUUGUCCUUUAGUAACCU-5' (SEQ ID NO: 7178)

C5-3124 Target:
5'-ACTACCTGGAAACAGGAAATCATTGGA-3' (SEQ ID NO: 9488)

5'-CUACCUGGAAACAGGAAAUCAUUGGAA-3' (SEQ ID NO: 14109)

3'-GAUGGACCUUUGUCCUUUAGUAACCUU-5' (SEQ ID NO: 7179)

C5-3125 Target:
5'-CTACCTGGAAACAGGAAATCATTGGAA-3' (SEQ ID NO: 9489)

5'-UACCUGGAAACAGGAAAUCAUUGGAAC-3' (SEQ ID NO: 14110)

3'-AUGGACCUUUGUCCUUUAGUAACCUUG-5' (SEQ ID NO: 7180)

C5-3126 Target:
5'-TACCTGGAAACAGGAAATCATTGGAAC-3' (SEQ ID NO: 9490)

5'-ACCUGGAAACAGGAAAUCAUUGGAACA-3' (SEQ ID NO: 14111)

3'-UGGACCUUUGUCCUUUAGUAACCUUGU-5' (SEQ ID NO: 7181)

C5-3127 Target:
5'-ACCTGGAAACAGGAAATCATTGGAACA-3' (SEQ ID NO: 9491)

5'-CCUGGAAACAGGAAAUCAUUGGAACAU-3' (SEQ ID NO: 14112)

3'-GGACCUUUGUCCUUUAGUAACCUUGUA-5' (SEQ ID NO: 7182)

TABLE 9-continued

"Blunt/Blunt" DsiRNAs Corresponding to Human Anti-C5 DsiRNAs Predicted to have >50% Knockdown Efficacy C5-3128 Target:
5'-CCTGGAAACAGGAAATCATTGGAACAT-3' (SEQ ID NO: 9492)

5'-CUGGAAACAGGAAAUCAUUGGAACAUU-3' (SEQ ID NO: 14113)

3'-GACCUUUGUCCUUUAGUAACCUUGUAA-5' (SEQ ID NO: 7183)

C5-3129 Target:
5'-CTGGAAACAGGAAATCATTGGAACATT-3' (SEQ ID NO: 9493)

5'-UGGAAACAGGAAAUCAUUGGAACAUUU-3' (SEQ ID NO: 14114)

3'-ACCUUUGUCCUUUAGUAACCUUGUAAA-5' (SEQ ID NO: 7184)

C5-3130 Target:
5'-TGGAAACAGGAAATCATTGGAACATTT-3' (SEQ ID NO: 9494)

5'-GGAAACAGGAAAUCAUUGGAACAUUUU-3' (SEQ ID NO: 14115)

3'-CCUUUGUCCUUUAGUAACCUUGUAAAA-5' (SEQ ID NO: 7185)

C5-3131 Target:
5'-GGAAACAGGAAATCATTGGAACATTTT-3' (SEQ ID NO: 9495)

5'-GAAACAGGAAAUCAUUGGAACAUUUUU-3' (SEQ ID NO: 14116)

3'-CUUUGUCCUUUAGUAACCUUGUAAAAA-5' (SEQ ID NO: 7186)

C5-3132 Target:
5'-GAAACAGGAAATCATTGGAACATTTTT-3' (SEQ ID NO: 9496)

5'-AAACAGGAAAUCAUUGGAACAUUUUUC-3' (SEQ ID NO: 14117)

3'-UUUGUCCUUUAGUAACCUUGUAAAAAG-5' (SEQ ID NO: 7187)

C5-3133 Target:
5'-AAACAGGAAATCATTGGAACATTTTTC-3' (SEQ ID NO: 9497)

5'-AACAGGAAAUCAUUGGAACAUUUUUCA-3' (SEQ ID NO: 14118)

3'-UUGUCCUUUAGUAACCUUGUAAAAAGU-5' (SEQ ID NO: 7188)

C5-3134 Target:
5'-AACAGGAAATCATTGGAACATTTTTCA-3' (SEQ ID NO: 9498)

5'-AGGAAAUCAUUGGAACAUUUUUCAUUC-3' (SEQ ID NO: 14119)

3'-UCCUUUAGUAACCUUGUAAAAAGUAAG-5' (SEQ ID NO: 7189)

C5-3137 Target:
5'-AGGAAATCATTGGAACATTTTTCATTC-3' (SEQ ID NO: 9499)

5'-GGAAAUCAUUGGAACAUUUUUCAUUCU-3' (SEQ ID NO: 14120)

3'-CCUUUAGUAACCUUGUAAAAAGUAAGA-5' (SEQ ID NO: 7190)

C5-3138 Target:
5'-GGAAATCATTGGAACATTTTTCATTCT-3' (SEQ ID NO: 9500)

5'-GAAAUCAUUGGAACAUUUUUCAUUCUG-3' (SEQ ID NO: 14121)

3'-CUUUAGUAACCUUGUAAAAAGUAAGAC-5' (SEQ ID NO: 7191)

C5-3139 Target:
5'-GAAATCATTGGAACATTTTTCATTCTG-3' (SEQ ID NO: 9501)

5'-AAAUCAUUGGAACAUUUUUCAUUCUGA-3' (SEQ ID NO: 14122)

3'-UUUAGUAACCUUGUAAAAAGUAAGACU-5' (SEQ ID NO: 7192)

C5-3140 Target:
5'-AAATCATTGGAACATTTTTCATTCTGA-3' (SEQ ID NO: 9502)

5'-AAUCAUUGGAACAUUUUUCAUUCUGAC-3' (SEQ ID NO: 14123)

3'-UUAGUAACCUUGUAAAAAGUAAGACUG-5' (SEQ ID NO: 7193)

C5-3141 Target:
5'-AATCATTGGAACATTTTTCATTCTGAC-3' (SEQ ID NO: 9503)

5'-AUCAUUGGAACAUUUUUCAUUCUGACC-3' (SEQ ID NO: 14124)

3'-UAGUAACCUUGUAAAAAGUAAGACUGG-5' (SEQ ID NO: 7194)

C5-3142 Target:
5'-ATCATTGGAACATTTTTCATTCTGACC-3' (SEQ ID NO: 9504)

5'-UCAUUGGAACAUUUUUCAUUCUGACCC-3' (SEQ ID NO: 14125)

3'-AGUAACCUUGUAAAAAGUAAGACUGGG-5' (SEQ ID NO: 7195)

C5-3143 Target:
5'-TCATTGGAACATTTTTCATTCTGACCC-3' (SEQ ID NO: 9505)

5'-CUGACCCAUUAAUUGAAAAGCAGAAAC-3' (SEQ ID NO: 14126)

3'-GACUGGGUAAUUAACUUUUCGUCUUUG-5' (SEQ ID NO: 7196)

C5-3163 Target:
5'-CTGACCCATTAATTGAAAAGCAGAAAC-3' (SEQ ID NO: 9506)

5'-GAAGAAAAAAUUAAAAGAAGGGAUGUU-3' (SEQ ID NO: 14127)

3'-CUUCUUUUUUAAUUUUCUUCCCUACAA-5' (SEQ ID NO: 7197)

C5-3191 Target:
5'-GAAGAAAAAATTAAAGAAGGGATGTT-3' (SEQ ID NO: 9507)

5'-AAGAAAAAAUUAAAGAAGGGAUGUUG-3' (SEQ ID NO: 14128)

3'-UUCUUUUUUAAUUUUCUUCCCUACAAC-5' (SEQ ID NO: 7198)

C5-3192 Target:
5'-AAGAAAAAATTAAAGAAGGGATGTTG-3' (SEQ ID NO: 9508)

5'-AGAAAAAAUUAAAGAAGGGAUGUUGA-3' (SEQ ID NO: 14129)

3'-UCUUUUUUAAUUUUCUUCCCUACAACU-5' (SEQ ID NO: 7199)

C5-3193 Target:
5'-AGAAAAAATTAAAGAAGGGATGTTGA-3' (SEQ ID NO: 9509)

5'-GAAAAAAUUAAAGAAGGGAUGUUGAG-3' (SEQ ID NO: 14130)

3'-CUUUUUUAAUUUUCUUCCCUACAACUC-5' (SEQ ID NO: 7200)

C5-3194 Target:
5'-GAAAAAATTAAAGAAGGGATGTTGAG-3' (SEQ ID NO: 9510)

5'-AAAAAAUUAAAGAAGGGAUGUUGAGC-3' (SEQ ID NO: 14131)

3'-UUUUUUAAUUUUCUUCCCUACAACUCG-5' (SEQ ID NO: 7201)

C5-3195 Target:
5'-AAAAAATTAAAGAAGGGATGTTGAGC-3' (SEQ ID NO: 9511)

5'-GUUGAGCAUUAUGUCCUACAGAAAUGC-3' (SEQ ID NO: 14132)

3'-CAACUCGUAAUACAGGAUGUCUUUACG-5' (SEQ ID NO: 7202)

TABLE 9-continued

"Blunt/Blunt" DsiRNAs Corresponding to Human Anti-C5 DsiRNAs Predicted to have >50% Knockdown Efficacy C5-3215 Target:
5'-GTTGAGCATTATGTCCTACAGAAATGC-3' (SEQ ID NO: 9512)

5'-UGAGCAUUAUGUCCUACAGAAAUGCUG-3' (SEQ ID NO: 14133)

3'-ACUCGUAAUACAGGAUGUCUUUACGAC-5' (SEQ ID NO: 7203)

C5-3217 Target:
5'-TGAGCATTATGTCCTACAGAAATGCTG-3' (SEQ ID NO: 9513)

5'-GAGCAUUAUGUCCUACAGAAAUGCUGA-3' (SEQ ID NO: 14134)

3'-CUCGUAAUACAGGAUGUCUUUACGACU-5' (SEQ ID NO: 7204)

C5-3218 Target:
5'-GAGCATTATGTCCTACAGAAATGCTGA-3' (SEQ ID NO: 9514)

5'-AGCAUUAUGUCCUACAGAAAUGCUGAC-3' (SEQ ID NO: 14135)

3'-UCGUAAUACAGGAUGUCUUUACGACUG-5' (SEQ ID NO: 7205)

C5-3219 Target:
5'-AGCATTATGTCCTACAGAAATGCTGAC-3' (SEQ ID NO: 9515)

5'-GCAUUAUGUCCUACAGAAAUGCUGACU-3' (SEQ ID NO: 14136)

3'-CGUAAUACAGGAUGUCUUUACGACUGA-5' (SEQ ID NO: 7206)

C5-3220 Target:
5'-GCATTATGTCCTACAGAAATGCTGACT-3' (SEQ ID NO: 9516)

5'-CAUUAUGUCCUACAGAAAUGCUGACUA-3' (SEQ ID NO: 14137)

3'-GUAAUACAGGAUGUCUUUACGACUGAU-5' (SEQ ID NO: 7207)

C5-3221 Target:
5'-CATTATGTCCTACAGAAATGCTGACTA-3' (SEQ ID NO: 9517)

5'-AUUAUGUCCUACAGAAAUGCUGACUAC-3' (SEQ ID NO: 14138)

3'-UAAUACAGGAUGUCUUUACGACUGAUG-5' (SEQ ID NO: 7208)

C5-3222 Target:
5'-ATTATGTCCTACAGAAATGCTGACTAC-3' (SEQ ID NO: 9518)

5'-UUAUGUCCUACAGAAAUGCUGACUACU-3' (SEQ ID NO: 14139)

3'-AAUACAGGAUGUCUUUACGACUGAUGA-5' (SEQ ID NO: 7209)

C5-3223 Target:
5'-TTATGTCCTACAGAAATGCTGACTACT-3' (SEQ ID NO: 9519)

5'-UAUGUCCUACAGAAAUGCUGACUACUC-3' (SEQ ID NO: 14140)

3'-AUACAGGAUGUCUUUACGACUGAUGAG-5' (SEQ ID NO: 7210)

C5-3224 Target:
5'-TATGTCCTACAGAAATGCTGACTACTC-3' (SEQ ID NO: 9520)

5'-AUGUCCUACAGAAAUGCUGACUACUCU-3' (SEQ ID NO: 14141)

3'-UACAGGAUGUCUUUACGACUGAUGAGA-5' (SEQ ID NO: 7211)

C5-3225 Target:
5'-ATGTCCTACAGAAATGCTGACTACTCT-3' (SEQ ID NO: 9521)

5'-UGUCCUACAGAAAUGCUGACUACUCUU-3' (SEQ ID NO: 14142)

3'-ACAGGAUGUCUUUACGACUGAUGAGAA-5' (SEQ ID NO: 7212)

C5-3226 Target:
5'-TGTCCTACAGAAATGCTGACTACTCTT-3' (SEQ ID NO: 9522)

5'-GUCCUACAGAAAUGCUGACUACUCUUA-3' (SEQ ID NO: 14143)

3'-CAGGAUGUCUUUACGACUGAUGAGAAU-5' (SEQ ID NO: 7213)

C5-3227 Target:
5'-GTCCTACAGAAATGCTGACTACTCTTA-3' (SEQ ID NO: 9523)

5'-GAAGUGCUAGCACUUGGUUAACAGCUU-3' (SEQ ID NO: 14144)

3'-CUUCACGAUCGUGAACCAAUUGUCGAA-5' (SEQ ID NO: 7214)

C5-3271 Target:
5'-GAAGTGCTAGCACTTGGTTAACAGCTT-3' (SEQ ID NO: 9524)

5'-AAGUGCUAGCACUUGGUUAACAGCUUU-3' (SEQ ID NO: 14145)

3'-UUCACGAUCGUGAACCAAUUGUCGAAA-5' (SEQ ID NO: 7215)

C5-3272 Target:
5'-AAGTGCTAGCACTTGGTTAACAGCTTT-3' (SEQ ID NO: 9525)

5'-AGUGCUAGCACUUGGUUAACAGCUUUU-3' (SEQ ID NO: 14146)

3'-UCACGAUCGUGAACCAAUUGUCGAAAA-5' (SEQ ID NO: 7216)

C5-3273 Target:
5'-AGTGCTAGCACTTGGTTAACAGCTTTT-3' (SEQ ID NO: 9526)

5'-GUGCUAGCACUUGGUUAACAGCUUUUG-3' (SEQ ID NO: 14147)

3'-CACGAUCGUGAACCAAUUGUCGAAAAC-5' (SEQ ID NO: 7217)

C5-3274 Target:
5'-GTGCTAGCACTTGGTTAACAGCTTTTG-3' (SEQ ID NO: 9527)

5'-UGCUAGCACUUGGUUAACAGCUUUUGC-3' (SEQ ID NO: 14148)

3'-ACGAUCGUGAACCAAUUGUCGAAAACG-5' (SEQ ID NO: 7218)

C5-3275 Target:
5'-TGCTAGCACTTGGTTAACAGCTTTTGC-3' (SEQ ID NO: 9528)

5'-GCUAGCACUUGGUUAACAGCUUUUGCU-3' (SEQ ID NO: 14149)

3'-CGAUCGUGAACCAAUUGUCGAAAACGA-5' (SEQ ID NO: 7219)

C5-3276 Target:
5'-GCTAGCACTTGGTTAACAGCTTTTGCT-3' (SEQ ID NO: 9529)

5'-CUAGCACUUGGUUAACAGCUUUUGCUU-3' (SEQ ID NO: 14150)

3'-GAUCGUGAACCAAUUGUCGAAAACGAA-5' (SEQ ID NO: 7220)

C5-3277 Target:
5'-CTAGCACTTGGTTAACAGCTTTTGCTT-3' (SEQ ID NO: 9530)

5'-UAGCACUUGGUUAACAGCUUUUGCUUU-3' (SEQ ID NO: 14151)

3'-AUCGUGAACCAAUUGUCGAAAACGAAA-5' (SEQ ID NO: 7221)

C5-3278 Target:
5'-TAGCACTTGGTTAACAGCTTTTGCTTT-3' (SEQ ID NO: 9531)

5'-AGCACUUGGUUAACAGCUUUUGCUUUA-3' (SEQ ID NO: 14152)

3'-UCGUGAACCAAUUGUCGAAAACGAAAU-5' (SEQ ID NO: 7222)

TABLE 9-continued

"Blunt/Blunt" DsiRNAs Corresponding to Human Anti-C5 DsiRNAs Predicted to have >50% Knockdown Efficacy C5-3279 Target:
5'-AGCACTTGGTTAACAGCTTTTGCTTTA-3' (SEQ ID NO: 9532)

5'-GCACUUGGUUAACAGCUUUUGCUUUAA-3' (SEQ ID NO: 14153)

3'-CGUGAACCAAUUGUCGAAAACGAAAUU-5' (SEQ ID NO: 7223)

C5-3280 Target:
5'-GCACTTGGTTAACAGCTTTTGCTTTAA-3' (SEQ ID NO: 9533)

5'-ACUUGGUUAACAGCUUUUGCUUUAAGA-3' (SEQ ID NO: 14154)

3'-UGAACCAAUUGUCGAAAACGAAAUUCU-5' (SEQ ID NO: 7224)

C5-3282 Target:
5'-ACTTGGTTAACAGCTTTTGCTTTAAGA-3' (SEQ ID NO: 9534)

5'-CUUGGUUAACAGCUUUUGCUUUAAGAG-3' (SEQ ID NO: 14155)

3'-GAACCAAUUGUCGAAAACGAAAUUCUC-5' (SEQ ID NO: 7225)

C5-3283 Target:
5'-CTTGGTTAACAGCTTTTGCTTTAAGAG-3' (SEQ ID NO: 9535)

5'-GGUUAACAGCUUUUGCUUUAAGAGUAC-3' (SEQ ID NO: 14156)

3'-CCAAUUGUCGAAAACGAAAUUCUCAUG-5' (SEQ ID NO: 7226)

C5-3286 Target:
5'-GGTTAACAGCTTTTGCTTTAAGAGTAC-3' (SEQ ID NO: 9536)

5'-GUUAACAGCUUUUGCUUUAAGAGUACU-3' (SEQ ID NO: 14157)

3'-CAAUUGUCGAAAACGAAAUUCUCAUGA-5' (SEQ ID NO: 7227)

C5-3287 Target:
5'-GTTAACAGCTTTTGCTTTAAGAGTACT-3' (SEQ ID NO: 9537)

5'-UUAACAGCUUUUGCUUUAAGAGUACUU-3' (SEQ ID NO: 14158)

3'-AAUUGUCGAAAACGAAAUUCUCAUGAA-5' (SEQ ID NO: 7228)

C5-3288 Target:
5'-TTAACAGCTTTTGCTTTAAGAGTACTT-3' (SEQ ID NO: 9538)

5'-UAACAGCUUUUGCUUUAAGAGUACUUG-3' (SEQ ID NO: 14159)

3'-AUUGUCGAAAACGAAAUUCUCAUGAAC-5' (SEQ ID NO: 7229)

C5-3289 Target:
5'-TAACAGCTTTTGCTTTAAGAGTACTTG-3' (SEQ ID NO: 9539)

5'-AACAGCUUUUGCUUUAAGAGUACUUGG-3' (SEQ ID NO: 14160)

3'-UUGUCGAAAACGAAAUUCUCAUGAACC-5' (SEQ ID NO: 7230)

C5-3290 Target:
5'-AACAGCTTTTGCTTTAAGAGTACTTGG-3' (SEQ ID NO: 9540)

5'-ACAGCUUUUGCUUUAAGAGUACUUGGA-3' (SEQ ID NO: 14161)

3'-UGUCGAAAACGAAAUUCUCAUGAACCU-5' (SEQ ID NO: 7231)

C5-3291 Target:
5'-ACAGCTTTTGCTTTAAGAGTACTTGGA-3' (SEQ ID NO: 9541)

5'-CAGCUUUUGCUUUAAGAGUACUUGGAC-3' (SEQ ID NO: 14162)

3'-GUCGAAAACGAAAUUCUCAUGAACCUG-5' (SEQ ID NO: 7232)

C5-3292 Target:
5'-CAGCTTTTGCTTTAAGAGTACTTGGAC-3' (SEQ ID NO: 9542)

5'-AGCUUUUGCUUUAAGAGUACUUGGACA-3' (SEQ ID NO: 14163)

3'-UCGAAAACGAAAUUCUCAUGAACCUGU-5' (SEQ ID NO: 7233)

C5-3293 Target:
5'-AGCTTTTGCTTTAAGAGTACTTGGACA-3' (SEQ ID NO: 9543)

5'-GCUUUUGCUUUAAGAGUACUUGGACAA-3' (SEQ ID NO: 14164)

3'-CGAAAACGAAAUUCUCAUGAACCUGUU-5' (SEQ ID NO: 7234)

C5-3294 Target:
5'-GCTTTTGCTTTAAGAGTACTTGGACAA-3' (SEQ ID NO: 9544)

5'-CUUUUGCUUUAAGAGUACUUGGACAAG-3' (SEQ ID NO: 14165)

3'-GAAAACGAAAUUCUCAUGAACCUGUUC-5' (SEQ ID NO: 7235)

C5-3295 Target:
5'-CTTTTGCTTTAAGAGTACTTGGACAAG-3' (SEQ ID NO: 9545)

5'-UUUUGCUUUAAGAGUACUUGGACAAGU-3' (SEQ ID NO: 14166)

3'-AAAACGAAAUUCUCAUGAACCUGUUCA-5' (SEQ ID NO: 7236)

C5-3296 Target:
5'-TTTTGCTTTAAGAGTACTTGGACAAGT-3' (SEQ ID NO: 9546)

5'-UUUGCUUUAAGAGUACUUGGACAAGUA-3' (SEQ ID NO: 14167)

3'-AAACGAAAUUCUCAUGAACCUGUUCAU-5' (SEQ ID NO: 7237)

C5-3297 Target:
5'-TTTGCTTTAAGAGTACTTGGACAAGTA-3' (SEQ ID NO: 9547)

5'-GCUUUAAGAGUACUUGGACAAGUAAAU-3' (SEQ ID NO: 14168)

3'-CGAAAUUCUCAUGAACCUGUUCAUUUA-5' (SEQ ID NO: 7238)

C5-3300 Target:
5'-GCTTTAAGAGTACTTGGACAAGTAAAT-3' (SEQ ID NO: 9548)

5'-CUUUAAGAGUACUUGGACAAGUAAAUA-3' (SEQ ID NO: 14169)

3'-GAAAUUCUCAUGAACCUGUUCAUUUAU-5' (SEQ ID NO: 7239)

C5-3301 Target:
5'-CTTTAAGAGTACTTGGACAAGTAAATA-3' (SEQ ID NO: 9549)

5'-ACGUAGAGCAGAACCAAAAUUCAAUUU-3' (SEQ ID NO: 14170)

3'-UGCAUCUCGUCUUGGUUUUAAGUUAAA-5' (SEQ ID NO: 7240)

C5-3331 Target:
5'-ACGTAGAGCAGAACCAAAATTCAATTT-3' (SEQ ID NO: 9550)

5'-UUUGUAAUUCUUUAUUGUGGCUAGUUG-3' (SEQ ID NO: 14171)

3'-AAACAUUAAGAAAUAACACCGAUCAAC-5' (SEQ ID NO: 7241)

C5-3355 Target:
5'-TTTGTAATTCTTTATTGTGGCTAGTTG-3' (SEQ ID NO: 9551)

5'-UUGUAAUUCUUUAUUGUGGCUAGUUGA-3' (SEQ ID NO: 14172)

3'-AACAUUAAGAAAUAACACCGAUCAACU-5' (SEQ ID NO: 7242)

TABLE 9-continued

"Blunt/Blunt" DsiRNAs Corresponding to Human Anti-C5 DsiRNAs Predicted to have >50% Knockdown Efficacy C5-3356 Target:
5'-TTGTAATTCTTTATTGTGGCTAGTTGA-3' (SEQ ID NO: 9552)

5'-CUUUCAAGGAAAAUUCACAGUAUCAAC-3' (SEQ ID NO: 14173)

3'-GAAAGUUCCUUUUAAGUGUCAUAGUUG-5' (SEQ ID NO: 7243)

C5-3406 Target:
5'-CTTTCAAGGAAAATTCACAGTATCAAC-3' (SEQ ID NO: 9553)

5'-UUUCAAGGAAAAUUCACAGUAUCAACC-3' (SEQ ID NO: 14174)

3'-AAAGUUCCUUUUAAGUGUCAUAGUUGG-5' (SEQ ID NO: 7244)

C5-3407 Target:
5'-TTTCAAGGAAAATTCACAGTATCAACC-3' (SEQ ID NO: 9554)

5'-UUCAAGGAAAAUUCACAGUAUCAACCA-3' (SEQ ID NO: 14175)

3'-AAGUUCCUUUUAAGUGUCAUAGUUGGU-5' (SEQ ID NO: 7245)

C5-3408 Target:
5'-TTCAAGGAAAATTCACAGTATCAACCA-3' (SEQ ID NO: 9555)

5'-UCAAGGAAAAUUCACAGUAUCAACCAA-3' (SEQ ID NO: 14176)

3'-AGUUCCUUUUAAGUGUCAUAGUUGGUU-5' (SEQ ID NO: 7246)

C5-3409 Target:
5'-TCAAGGAAAATTCACAGTATCAACCAA-3' (SEQ ID NO: 9556)

5'-CAAGGAAAAUUCACAGUAUCAACCAAU-3' (SEQ ID NO: 14177)

3'-GUUCCUUUUAAGUGUCAUAGUUGGUUA-5' (SEQ ID NO: 7247)

C5-3410 Target:
5'-CAAGGAAAATTCACAGTATCAACCAAT-3' (SEQ ID NO: 9557)

5'-AAGGAAAAUUCACAGUAUCAACCAAUA-3' (SEQ ID NO: 14178)

3'-UUCCUUUUAAGUGUCAUAGUUGGUUAU-5' (SEQ ID NO: 7248)

C5-3411 Target:
5'-AAGGAAAATTCACAGTATCAACCAATA-3' (SEQ ID NO: 9558)

5'-AGGAAAAUUCACAGUAUCAACCAAUAA-3' (SEQ ID NO: 14179)

3'-UCCUUUUAAGUGUCAUAGUUGGUUAUU-5' (SEQ ID NO: 7249)

C5-3412 Target:
5'-AGGAAAATTCACAGTATCAACCAATAA-3' (SEQ ID NO: 9559)

5'-GGAAAAUUCACAGUAUCAACCAAUAAA-3' (SEQ ID NO: 14180)

3'-CCUUUUAAGUGUCAUAGUUGGUUAUUU-5' (SEQ ID NO: 7250)

C5-3413 Target:
5'-GGAAAATTCACAGTATCAACCAATAAA-3' (SEQ ID NO: 9560)

5'-GAAAAUUCACAGUAUCAACCAAUAAAA-3' (SEQ ID NO: 14181)

3'-CUUUUAAGUGUCAUAGUUGGUUAUUUU-5' (SEQ ID NO: 7251)

C5-3414 Target:
5'-GAAAATTCACAGTATCAACCAATAAAA-3' (SEQ ID NO: 9561)

5'-AAAAUUCACAGUAUCAACCAAUAAAAU-3' (SEQ ID NO: 14182)

3'-UUUUAAGUGUCAUAGUUGGUUAUUUUA-5' (SEQ ID NO: 7252)

C5-3415 Target:
5'-AAAATTCACAGTATCAACCAATAAAAT-3' (SEQ ID NO: 9562)

5'-AAAUUCACAGUAUCAACCAAUAAAAUU-3' (SEQ ID NO: 14183)

3'-UUUAAGUGUCAUAGUUGGUUAUUUUAA-5' (SEQ ID NO: 7253)

C5-3416 Target:
5'-AAATTCACAGTATCAACCAATAAAATT-3' (SEQ ID NO: 9563)

5'-AAUUCACAGUAUCAACCAAUAAAAUUA-3' (SEQ ID NO: 14184)

3'-UUAAGUGUCAUAGUUGGUUAUUUUAAU-5' (SEQ ID NO: 7254)

C5-3417 Target:
5'-AATTCACAGTATCAACCAATAAAATTA-3' (SEQ ID NO: 9564)

5'-AUUCACAGUAUCAACCAAUAAAAUUAC-3' (SEQ ID NO: 14185)

3'-UAAGUGUCAUAGUUGGUUAUUUUAAUG-5' (SEQ ID NO: 7255)

C5-3418 Target:
5'-ATTCACAGTATCAACCAATAAAATTAC-3' (SEQ ID NO: 9565)

5'-UCACAGUAUCAACCAAUAAAAUUACAG-3' (SEQ ID NO: 14186)

3'-AGUGUCAUAGUUGGUUAUUUUAAUGUC-5' (SEQ ID NO: 7256)

C5-3420 Target:
5'-TCACAGTATCAACCAATAAAATTACAG-3' (SEQ ID NO: 9566)

5'-CACAGUAUCAACCAAUAAAAUUACAGG-3' (SEQ ID NO: 14187)

3'-GUGUCAUAGUUGGUUAUUUUAAUGUCC-5' (SEQ ID NO: 7257)

C5-3421 Target:
5'-CACAGTATCAACCAATAAAATTACAGG-3' (SEQ ID NO: 9567)

5'-ACAGUAUCAACCAAUAAAAUUACAGGG-3' (SEQ ID NO: 14188)

3'-UGUCAUAGUUGGUUAUUUUAAUGUCCC-5' (SEQ ID NO: 7258)

C5-3422 Target:
5'-ACAGTATCAACCAATAAAATTACAGGG-3' (SEQ ID NO: 9568)

5'-CAGUAUCAACCAAUAAAAUUACAGGGU-3' (SEQ ID NO: 14189)

3'-GUCAUAGUUGGUUAUUUUAAUGUCCCA-5' (SEQ ID NO: 7259)

C5-3423 Target:
5'-CAGTATCAACCAATAAAATTACAGGGT-3' (SEQ ID NO: 9569)

5'-AGUAUCAACCAAUAAAAUUACAGGGUA-3' (SEQ ID NO: 14190)

3'-UCAUAGUUGGUUAUUUUAAUGUCCCAU-5' (SEQ ID NO: 7260)

C5-3424 Target:
5'-AGTATCAACCAATAAAATTACAGGGTA-3' (SEQ ID NO: 9570)

5'-GUAUCAACCAAUAAAAUUACAGGGUAC-3' (SEQ ID NO: 14191)

3'-CAUAGUUGGUUAUUUUAAUGUCCCAUG-5' (SEQ ID NO: 7261)

C5-3425 Target:
5'-GTATCAACCAATAAAATTACAGGGTAC-3' (SEQ ID NO: 9571)

5'-UAUCAACCAAUAAAAUUACAGGGUACC-3' (SEQ ID NO: 14192)

3'-AUAGUUGGUUAUUUUAAUGUCCCAUGG-5' (SEQ ID NO: 7262)

TABLE 9-continued

"Blunt/Blunt" DsiRNAs Corresponding to Human Anti-C5 DsiRNAs Predicted to have >50% Knockdown Efficacy C5-3426 Target:
5'-TATCAACCAATAAAATTACAGGGTACC-3' (SEQ ID NO: 9572)

5'-CACAGCUCUAAUUAAAGCUGACAACUU-3' (SEQ ID NO: 14193)

3'-GUGUCGAGAUUAAUUUCGACUGUUGAA-5' (SEQ ID NO: 7263)

C5-3551 Target:
5'-CACAGCTCTAATTAAAGCTGACAACTT-3' (SEQ ID NO: 9573)

5'-ACAGCUCUAAUUAAAGCUGACAACUUU-3' (SEQ ID NO: 14194)

3'-UGUCGAGAUUAAUUUCGACUGUUGAAA-5' (SEQ ID NO: 7264)

C5-3552 Target:
5'-ACAGCTCTAATTAAAGCTGACAACTTT-3' (SEQ ID NO: 9574)

5'-CAGCUCUAAUUAAAGCUGACAACUUUC-3' (SEQ ID NO: 14195)

3'-GUCGAGAUUAAUUUCGACUGUUGAAAG-5' (SEQ ID NO: 7265)

C5-3553 Target:
5'-CAGCTCTAATTAAAGCTGACAACTTTC-3' (SEQ ID NO: 9575)

5'-AACUUUCUGCUUGAAAAUACACUGCCA-3' (SEQ ID NO: 14196)

3'-UUGAAAGACGAACUUUUAUGUGACGGU-5' (SEQ ID NO: 7266)

C5-3573 Target:
5'-AACTTTCTGCTTGAAAATACACTGCCA-3' (SEQ ID NO: 9576)

5'-ACUUUCUGCUUGAAAAUACACUGCCAG-3' (SEQ ID NO: 14197)

3'-UGAAAGACGAACUUUUAUGUGACGGUC-5' (SEQ ID NO: 7267)

C5-3574 Target:
5'-ACTTTCTGCTTGAAAATACACTGCCAG-3' (SEQ ID NO: 9577)

5'-CUUUCUGCUUGAAAAUACACUGCCAGC-3' (SEQ ID NO: 14198)

3'-GAAAGACGAACUUUUAUGUGACGGUCG-5' (SEQ ID NO: 7268)

C5-3575 Target:
5'-CTTTCTGCTTGAAAATACACTGCCAGC-3' (SEQ ID NO: 9578)

5'-UUUCUGCUUGAAAAUACACUGCCAGCC-3' (SEQ ID NO: 14199)

3'-AAAGACGAACUUUUAUGUGACGGUCGG-5' (SEQ ID NO: 7269)

C5-3576 Target:
5'-TTTCTGCTTGAAAATACACTGCCAGCC-3' (SEQ ID NO: 9579)

5'-UUCUGCUUGAAAAUACACUGCCAGCCC-3' (SEQ ID NO: 14200)

3'-AAGACGAACUUUUAUGUGACGGUCGGG-5' (SEQ ID NO: 7270)

C5-3577 Target:
5'-TTCTGCTTGAAAATACACTGCCAGCCC-3' (SEQ ID NO: 9580)

5'-UCUGCUUGAAAAUACACUGCCAGCCCA-3' (SEQ ID NO: 14201)

3'-AGACGAACUUUUAUGUGACGGUCGGGU-5' (SEQ ID NO: 7271)

C5-3578 Target:
5'-TCTGCTTGAAAATACACTGCCAGCCCA-3' (SEQ ID NO: 9581)

5'-CUGCUUGAAAAUACACUGCCAGCCCAG-3' (SEQ ID NO: 14202)

3'-GACGAACUUUUAUGUGACGGUCGGGUC-5' (SEQ ID NO: 7272)

C5-3579 Target:
5'-CTGCTTGAAAATACACTGCCAGCCCAG-3' (SEQ ID NO: 9582)

5'-UGCUUGAAAAUACACUGCCAGCCCAGA-3' (SEQ ID NO: 14203)

3'-ACGAACUUUUAUGUGACGGUCGGGUCU-5' (SEQ ID NO: 7273)

C5-3580 Target:
5'-TGCTTGAAAATACACTGCCAGCCCAGA-3' (SEQ ID NO: 9583)

5'-GCUUGAAAAUACACUGCCAGCCCAGAG-3' (SEQ ID NO: 14204)

3'-CGAACUUUUAUGUGACGGUCGGGUCUC-5' (SEQ ID NO: 7274)

C5-3581 Target:
5'-GCTTGAAAATACACTGCCAGCCCAGAG-3' (SEQ ID NO: 9584)

5'-CUUGAAAAUACACUGCCAGCCCAGAGC-3' (SEQ ID NO: 14205)

3'-GAACUUUUAUGUGACGGUCGGGUCUCG-5' (SEQ ID NO: 7275)

C5-3582 Target:
5'-CTTGAAAATACACTGCCAGCCCAGAGC-3' (SEQ ID NO: 9585)

5'-UUGAAAAUACACUGCCAGCCCAGAGCA-3' (SEQ ID NO: 14206)

3'-AACUUUUAUGUGACGGUCGGGUCUCGU-5' (SEQ ID NO: 7276)

C5-3583 Target:
5'-TTGAAAATACACTGCCAGCCCAGAGCA-3' (SEQ ID NO: 9586)

5'-UGAAAAUACACUGCCAGCCCAGAGCAC-3' (SEQ ID NO: 14207)

3'-ACUUUUAUGUGACGGUCGGGUCUCGUG-5' (SEQ ID NO: 7277)

C5-3584 Target:
5'-TGAAAATACACTGCCAGCCCAGAGCAC-3' (SEQ ID NO: 9587)

5'-GAAAAUACACUGCCAGCCCAGAGCACC-3' (SEQ ID NO: 14208)

3'-CUUUUAUGUGACGGUCGGGUCUCGUGG-5' (SEQ ID NO: 7278)

C5-3585 Target:
5'-GAAAATACACTGCCAGCCCAGAGCACC-3' (SEQ ID NO: 9588)

5'-AAAAUACACUGCCAGCCCAGAGCACCU-3' (SEQ ID NO: 14209)

3'-UUUUAUGUGACGGUCGGGUCUCGUGGA-5' (SEQ ID NO: 7279)

C5-3586 Target:
5'-AAAATACACTGCCAGCCCAGAGCACCT-3' (SEQ ID NO: 9589)

5'-AAAUACACUGCCAGCCCAGAGCACCUU-3' (SEQ ID NO: 14210)

3'-UUUAUGUGACGGUCGGGUCUCGUGGAA-5' (SEQ ID NO: 7280)

C5-3587 Target:
5'-AAATACACTGCCAGCCCAGAGCACCTT-3' (SEQ ID NO: 9590)

5'-AAUACACUGCCAGCCCAGAGCACCUUU-3' (SEQ ID NO: 14211)

3'-UUAUGUGACGGUCGGGUCUCGUGGAAA-5' (SEQ ID NO: 7281)

C5-3588 Target:
5'-AATACACTGCCAGCCCAGAGCACCTTT-3' (SEQ ID NO: 9591)

5'-AUACACUGCCAGCCCAGAGCACCUUUA-3' (SEQ ID NO: 14212)

3'-UAUGUGACGGUCGGGUCUCGUGGAAAU-5' (SEQ ID NO: 7282)

TABLE 9-continued

"Blunt/Blunt" DsiRNAs Corresponding to Human Anti-C5 DsiRNAs Predicted to have >50% Knockdown Efficacy C5-3589 Target:
5'-ATACACTGCCAGCCCAGAGCACCTTTA-3' (SEQ ID NO: 9592)

5'-UACACUGCCAGCCCAGAGCACCUUUAC-3' (SEQ ID NO: 14213)

3'-AUGUGACGGUCGGGUCUCGUGGAAAUG-5' (SEQ ID NO: 7283)

C5-3590 Target:
5'-TACACTGCCAGCCCAGAGCACCTTTAC-3' (SEQ ID NO: 9593)

5'-ACACUGCCAGCCCAGAGCACCUUUACA-3' (SEQ ID NO: 14214)

3'-UGUGACGGUCGGGUCUCGUGGAAAUGU-5' (SEQ ID NO: 7284)

C5-3591 Target:
5'-ACACTGCCAGCCCAGAGCACCTTTACA-3' (SEQ ID NO: 9594)

5'-CACUGCCAGCCCAGAGCACCUUUACAU-3' (SEQ ID NO: 14215)

3'-GUGACGGUCGGGUCUCGUGGAAAUGUA-5' (SEQ ID NO: 7285)

C5-3592 Target:
5'-CACTGCCAGCCCAGAGCACCTTTACAT-3' (SEQ ID NO: 9595)

5'-ACUGCCAGCCCAGAGCACCUUUACAUU-3' (SEQ ID NO: 14216)

3'-UGACGGUCGGGUCUCGUGGAAAUGUAA-5' (SEQ ID NO: 7286)

C5-3593 Target:
5'-ACTGCCAGCCCAGAGCACCTTTACATT-3' (SEQ ID NO: 9596)

5'-CUGCCAGCCCAGAGCACCUUUACAUUG-3' (SEQ ID NO: 14217)

3'-GACGGUCGGGUCUCGUGGAAAUGUAAC-5' (SEQ ID NO: 7287)

C5-3594 Target:
5'-CTGCCAGCCCAGAGCACCTTTACATTG-3' (SEQ ID NO: 9597)

5'-UGCCAGCCCAGAGCACCUUUACAUUGG-3' (SEQ ID NO: 14218)

3'-ACGGUCGGGUCUCGUGGAAAUGUAACC-5' (SEQ ID NO: 7288)

C5-3595 Target:
5'-TGCCAGCCCAGAGCACCTTTACATTGG-3' (SEQ ID NO: 9598)

5'-GCCAGCCCAGAGCACCUUUACAUUGGC-3' (SEQ ID NO: 14219)

3'-CGGUCGGGUCUCGUGGAAAUGUAACCG-5' (SEQ ID NO: 7289)

C5-3596 Target:
5'-GCCAGCCCAGAGCACCTTTACATTGGC-3' (SEQ ID NO: 9599)

5'-CCAGCCCAGAGCACCUUUACAUUGGCC-3' (SEQ ID NO: 14220)

3'-GGUCGGGUCUCGUGGAAAUGUAACCGG-5' (SEQ ID NO: 7290)

C5-3597 Target:
5'-CCAGCCCAGAGCACCTTTACATTGGCC-3' (SEQ ID NO: 9600)

5'-CAGCCCAGAGCACCUUUACAUUGGCCA-3' (SEQ ID NO: 14221)

3'-GUCGGGUCUCGUGGAAAUGUAACCGGU-5' (SEQ ID NO: 7291)

C5-3598 Target:
5'-CAGCCCAGAGCACCTTTACATTGGCCA-3' (SEQ ID NO: 9601)

5'-AGCCCAGAGCACCUUUACAUUGGCCAU-3' (SEQ ID NO: 14222)

3'-UCGGGUCUCGUGGAAAUGUAACCGGUA-5' (SEQ ID NO: 7292)

C5-3599 Target:
5'-AGCCCAGAGCACCTTTACATTGGCCAT-3' (SEQ ID NO: 9602)

5'-GCCCAGAGCACCUUUACAUUGGCCAUU-3' (SEQ ID NO: 14223)

3'-CGGGUCUCGUGGAAAUGUAACCGGUAA-5' (SEQ ID NO: 7293)

C5-3600 Target:
5'-GCCCAGAGCACCTTTACATTGGCCATT-3' (SEQ ID NO: 9603)

5'-CCCAGAGCACCUUUACAUUGGCCAUUU-3' (SEQ ID NO: 14224)

3'-GGGUCUCGUGGAAAUGUAACCGGUAAA-5' (SEQ ID NO: 7294)

C5-3601 Target:
5'-CCCAGAGCACCTTTACATTGGCCATTT-3' (SEQ ID NO: 9604)

5'-CCAGAGCACCUUUACAUUGGCCAUUUC-3' (SEQ ID NO: 14225)

3'-GGUCUCGUGGAAAUGUAACCGGUAAAG-5' (SEQ ID NO: 7295)

C5-3602 Target:
5'-CCAGAGCACCTTTACATTGGCCATTTC-3' (SEQ ID NO: 9605)

5'-CAGAGCACCUUUACAUUGGCCAUUUCU-3' (SEQ ID NO: 14226)

3'-GUCUCGUGGAAAUGUAACCGGUAAAGA-5' (SEQ ID NO: 7296)

C5-3603 Target:
5'-CAGAGCACCTTTACATTGGCCATTTCT-3' (SEQ ID NO: 9606)

5'-AGAGCACCUUUACAUUGGCCAUUUCUG-3' (SEQ ID NO: 14227)

3'-UCUCGUGGAAAUGUAACCGGUAAAGAC-5' (SEQ ID NO: 7297)

C5-3604 Target:
5'-AGAGCACCTTTACATTGGCCATTTCTG-3' (SEQ ID NO: 9607)

5'-GAGCACCUUUACAUUGGCCAUUUCUGC-3' (SEQ ID NO: 14228)

3'-CUCGUGGAAAUGUAACCGGUAAAGACG-5' (SEQ ID NO: 7298)

C5-3605 Target:
5'-GAGCACCTTTACATTGGCCATTTCTGC-3' (SEQ ID NO: 9608)

5'-AGCACCUUUACAUUGGCCAUUUCUGCG-3' (SEQ ID NO: 14229)

3'-UCGUGGAAAUGUAACCGGUAAAGACGC-5' (SEQ ID NO: 7299)

C5-3606 Target:
5'-AGCACCTTTACATTGGCCATTTCTGCG-3' (SEQ ID NO: 9609)

5'-GCACCUUUACAUUGGCCAUUUCUGCGU-3' (SEQ ID NO: 14230)

3'-CGUGGAAAUGUAACCGGUAAAGACGCA-5' (SEQ ID NO: 7300)

C5-3607 Target:
5'-GCACCTTTACATTGGCCATTTCTGCGT-3' (SEQ ID NO: 9610)

5'-CACCUUUACAUUGGCCAUUUCUGCGUA-3' (SEQ ID NO: 14231)

3'-GUGGAAAUGUAACCGGUAAAGACGCAU-5' (SEQ ID NO: 7301)

C5-3608 Target:
5'-CACCTTTACATTGGCCATTTCTGCGTA-3' (SEQ ID NO: 9611)

5'-ACCUUUACAUUGGCCAUUUCUGCGUAU-3' (SEQ ID NO: 14232)

3'-UGGAAAUGUAACCGGUAAAGACGCAUA-5' (SEQ ID NO: 7302)

TABLE 9-continued

"Blunt/Blunt" DsiRNAs Corresponding to Human Anti-C5 DsiRNAs Predicted to have >50% Knockdown Efficacy C5-3609 Target:
5'-ACCTTTACATTGGCCATTTCTGCGTAT-3' (SEQ ID NO: 9612)

5'-CCUUUACAUUGGCCAUUUCUGCGUAUG-3' (SEQ ID NO: 14233)

3'-GGAAAUGUAACCGGUAAAGACGCAUAC-5' (SEQ ID NO: 7303)

C5-3610 Target:
5'-CCTTTACATTGGCCATTTCTGCGTATG-3' (SEQ ID NO: 9613)

5'-CUUUACAUUGGCCAUUUCUGCGUAUGC-3' (SEQ ID NO: 14234)

3'-GAAAUGUAACCGGUAAAGACGCAUACG-5' (SEQ ID NO: 7304)

C5-3611 Target:
5'-CTTTACATTGGCCATTTCTGCGTATGC-3' (SEQ ID NO: 9614)

5'-CGUAUGCUCUUUCCCUGGGAGAUAAAA-3' (SEQ ID NO: 14235)

3'-GCAUACGAGAAAGGGACCCUCUAUUUU-5' (SEQ ID NO: 7305)

C5-3631 Target:
5'-CGTATGCTCTTTCCCTGGGAGATAAAA-3' (SEQ ID NO: 9615)

5'-GUAUGCUCUUUCCCUGGGAGAUAAAAC-3' (SEQ ID NO: 14236)

3'-CAUACGAGAAAGGGACCCUCUAUUUUG-5' (SEQ ID NO: 7306)

C5-3632 Target:
5'-GTATGCTCTTTCCCTGGGAGATAAAAC-3' (SEQ ID NO: 9616)

5'-UAUGCUCUUUCCCUGGGAGAUAAAACU-3' (SEQ ID NO: 14237)

3'-AUACGAGAAAGGGACCCUCUAUUUUGA-5' (SEQ ID NO: 7307)

C5-3633 Target:
5'-TATGCTCTTTCCCTGGGAGATAAAACT-3' (SEQ ID NO: 9617)

5'-AUGCUCUUUCCCUGGGAGAUAAAACUC-3' (SEQ ID NO: 14238)

3'-UACGAGAAAGGGACCCUCUAUUUUGAG-5' (SEQ ID NO: 7308)

C5-3634 Target:
5'-ATGCTCTTTCCCTGGGAGATAAAACTC-3' (SEQ ID NO: 9618)

5'-UGCUCUUUCCCUGGGAGAUAAAACUCA-3' (SEQ ID NO: 14239)

3'-ACGAGAAAGGGACCCUCUAUUUUGAGU-5' (SEQ ID NO: 7309)

C5-3635 Target:
5'-TGCTCTTTCCCTGGGAGATAAAACTCA-3' (SEQ ID NO: 9619)

5'-GCUCUUUCCCUGGGAGAUAAAACUCAC-3' (SEQ ID NO: 14240)

3'-CGAGAAAGGGACCCUCUAUUUUGAGUG-5' (SEQ ID NO: 7310)

C5-3636 Target:
5'-GCTCTTTCCCTGGGAGATAAAACTCAC-3' (SEQ ID NO: 9620)

5'-CUCUUUCCCUGGGAGAUAAAACUCACC-3' (SEQ ID NO: 14241)

3'-GAGAAAGGGACCCUCUAUUUUGAGUGG-5' (SEQ ID NO: 7311)

C5-3637 Target:
5'-CTCTTTCCCTGGGAGATAAAACTCACC-3' (SEQ ID NO: 9621)

5'-UCUUUCCCUGGGAGAUAAAACUCACCC-3' (SEQ ID NO: 14242)

3'-AGAAAGGGACCCUCUAUUUUGAGUGGG-5' (SEQ ID NO: 7312)

C5-3638 Target:
5'-TCTTTCCCTGGGAGATAAAACTCACCC-3' (SEQ ID NO: 9622)

5'-CUUUCCCUGGGAGAUAAAACUCACCCA-3' (SEQ ID NO: 14243)

3'-GAAAGGGACCCUCUAUUUUGAGUGGGU-5' (SEQ ID NO: 7313)

C5-3639 Target:
5'-CTTTCCCTGGGAGATAAAACTCACCCA-3' (SEQ ID NO: 9623)

5'-UUUCCCUGGGAGAUAAAACUCACCCAC-3' (SEQ ID NO: 14244)

3'-AAAGGGACCCUCUAUUUUGAGUGGGUG-5' (SEQ ID NO: 7314)

C5-3640 Target:
5'-TTTCCCTGGGAGATAAAACTCACCCAC-3' (SEQ ID NO: 9624)

5'-UUCCCUGGGAGAUAAAACUCACCCACA-3' (SEQ ID NO: 14245)

3'-AAGGGACCCUCUAUUUUGAGUGGGUGU-5' (SEQ ID NO: 7315)

C5-3641 Target:
5'-TTCCCTGGGAGATAAAACTCACCCACA-3' (SEQ ID NO: 9625)

5'-UCCCUGGGAGAUAAAACUCACCCACAG-3' (SEQ ID NO: 14246)

3'-AGGGACCCUCUAUUUUGAGUGGGUGUC-5' (SEQ ID NO: 7316)

C5-3642 Target:
5'-TCCCTGGGAGATAAAACTCACCCACAG-3' (SEQ ID NO: 9626)

5'-CCCUGGGAGAUAAAACUCACCCACAGU-3' (SEQ ID NO: 14247)

3'-GGGACCCUCUAUUUUGAGUGGGUGUCA-5' (SEQ ID NO: 7317)

C5-3643 Target:
5'-CCCTGGGAGATAAAACTCACCCACAGT-3' (SEQ ID NO: 9627)

5'-CCUGGGAGAUAAAACUCACCCACAGUU-3' (SEQ ID NO: 14248)

3'-GGACCCUCUAUUUUGAGUGGGUGUCAA-5' (SEQ ID NO: 7318)

C5-3644 Target:
5'-CCTGGGAGATAAAACTCACCCACAGTT-3' (SEQ ID NO: 9628)

5'-CUGGGAGAUAAAACUCACCCACAGUUU-3' (SEQ ID NO: 14249)

3'-GACCCUCUAUUUUGAGUGGGUGUCAAA-5' (SEQ ID NO: 7319)

C5-3645 Target:
5'-CTGGGAGATAAAACTCACCCACAGTTT-3' (SEQ ID NO: 9629)

5'-UGGGAGAUAAAACUCACCCACAGUUUC-3' (SEQ ID NO: 14250)

3'-ACCCUCUAUUUUGAGUGGGUGUCAAAG-5' (SEQ ID NO: 7320)

C5-3646 Target:
5'-TGGGAGATAAAACTCACCCACAGTTTC-3' (SEQ ID NO: 9630)

5'-GGGAGAUAAAACUCACCCACAGUUUCG-3' (SEQ ID NO: 14251)

3'-CCCUCUAUUUUGAGUGGGUGUCAAAGC-5' (SEQ ID NO: 7321)

C5-3647 Target:
5'-GGGAGATAAAACTCACCCACAGTTTCG-3' (SEQ ID NO: 9631)

5'-GGAGAUAAAACUCACCCACAGUUUCGU-3' (SEQ ID NO: 14252)

3'-CCUCUAUUUUGAGUGGGUGUCAAAGCA-5' (SEQ ID NO: 7322)

TABLE 9-continued

"Blunt/Blunt" DsiRNAs Corresponding to Human Anti-C5 DsiRNAs Predicted to have >50% Knockdown Efficacy C5-3648 Target:
5'-GGAGATAAAACTCACCCACAGTTTCGT-3' (SEQ ID NO: 9632)

5'-GAGAUAAAACUCACCCACAGUUUCGUU-3' (SEQ ID NO: 14253)

3'-CUCUAUUUUGAGUGGGUGUCAAAGCAA-5' (SEQ ID NO: 7323)

C5-3649 Target:
5'-GAGATAAAACTCACCCACAGTTTCGTT-3' (SEQ ID NO: 9633)

5'-AGAUAAAACUCACCCACAGUUUCGUUC-3' (SEQ ID NO: 14254)

3'-UCUAUUUUGAGUGGGUGUCAAAGCAAG-5' (SEQ ID NO: 7324)

C5-3650 Target:
5'-AGATAAAACTCACCCACAGTTTCGTTC-3' (SEQ ID NO: 9634)

5'-GAUAAAACUCACCCACAGUUUCGUUCA-3' (SEQ ID NO: 14255)

3'-CUAUUUUGAGUGGGUGUCAAAGCAAGU-5' (SEQ ID NO: 7325)

C5-3651 Target:
5'-GATAAAACTCACCCACAGTTTCGTTCA-3' (SEQ ID NO: 9635)

5'-UCGUUCAAUUGUUUCAGCUUUGAAGAG-3' (SEQ ID NO: 14256)

3'-AGCAAGUUAACAAAGUCGAAACUUCUC-5' (SEQ ID NO: 7326)

C5-3671 Target:
5'-TCGTTCAATTGTTTCAGCTTTGAAGAG-3' (SEQ ID NO: 9636)

5'-GUUCAAUUGUUUCAGCUUUGAAGAGAG-3' (SEQ ID NO: 14257)

3'-CAAGUUAACAAAGUCGAAACUUCUCUC-5' (SEQ ID NO: 7327)

C5-3673 Target:
5'-GTTCAATTGTTTCAGCTTTGAAGAGAG-3' (SEQ ID NO: 9637)

5'-UUCAAUUGUUUCAGCUUUGAAGAGAGA-3' (SEQ ID NO: 14258)

3'-AAGUUAACAAAGUCGAAACUUCUCUCU-5' (SEQ ID NO: 7328)

C5-3674 Target:
5'-TTCAATTGTTTCAGCTTTGAAGAGAGA-3' (SEQ ID NO: 9638)

5'-UCAAUUGUUUCAGCUUUGAAGAGAGAA-3' (SEQ ID NO: 14259)

3'-AGUUAACAAAGUCGAAACUUCUCUCUU-5' (SEQ ID NO: 7329)

C5-3675 Target:
5'-TCAATTGTTTCAGCTTTGAAGAGAGAA-3' (SEQ ID NO: 9639)

5'-CAAUUGUUUCAGCUUUGAAGAGAGAAG-3' (SEQ ID NO: 14260)

3'-GUUAACAAAGUCGAAACUUCUCUCUUC-5' (SEQ ID NO: 7330)

C5-3676 Target:
5'-CAATTGTTTCAGCTTTGAAGAGAGAAG-3' (SEQ ID NO: 9640)

5'-AAUUGUUUCAGCUUUGAAGAGAGAAGC-3' (SEQ ID NO: 14261)

3'-UUAACAAAGUCGAAACUUCUCUCUUCG-5' (SEQ ID NO: 7331)

C5-3677 Target:
5'-AATTGTTTCAGCTTTGAAGAGAGAAGC-3' (SEQ ID NO: 9641)

5'-AUUGUUUCAGCUUUGAAGAGAGAAGCU-3' (SEQ ID NO: 14262)

3'-UAACAAAGUCGAAACUUCUCUCUUCGA-5' (SEQ ID NO: 7332)

C5-3678 Target:
5'-ATTGTTTCAGCTTTGAAGAGAGAAGCT-3' (SEQ ID NO: 9642)

5'-UUGUUUCAGCUUUGAAGAGAGAAGCUU-3' (SEQ ID NO: 14263)

3'-AACAAAGUCGAAACUUCUCUCUUCGAA-5' (SEQ ID NO: 7333)

C5-3679 Target:
5'-TTGTTTCAGCTTTGAAGAGAGAAGCTT-3' (SEQ ID NO: 9643)

5'-UGUUUCAGCUUUGAAGAGAGAAGCUUU-3' (SEQ ID NO: 14264)

3'-ACAAAGUCGAAACUUCUCUCUUCGAAA-5' (SEQ ID NO: 7334)

C5-3680 Target:
5'-TGTTTCAGCTTTGAAGAGAGAAGCTTT-3' (SEQ ID NO: 9644)

5'-GUUUCAGCUUUGAAGAGAGAAGCUUUG-3' (SEQ ID NO: 14265)

3'-CAAAGUCGAAACUUCUCUCUUCGAAAC-5' (SEQ ID NO: 7335)

C5-3681 Target:
5'-GTTTCAGCTTTGAAGAGAGAAGCTTTG-3' (SEQ ID NO: 9645)

5'-UUUCAGCUUUGAAGAGAGAAGCUUUGG-3' (SEQ ID NO: 14266)

3'-AAAGUCGAAACUUCUCUCUUCGAAACC-5' (SEQ ID NO: 7336)

C5-3682 Target:
5'-TTTCAGCTTTGAAGAGAGAAGCTTTGG-3' (SEQ ID NO: 9646)

5'-UUCAGCUUUGAAGAGAGAAGCUUUGGU-3' (SEQ ID NO: 14267)

3'-AAGUCGAAACUUCUCUCUUCGAAACCA-5' (SEQ ID NO: 7337)

C5-3683 Target:
5'-TTCAGCTTTGAAGAGAGAAGCTTTGGT-3' (SEQ ID NO: 9647)

5'-UCAGCUUUGAAGAGAGAAGCUUUGGUU-3' (SEQ ID NO: 14268)

3'-AGUCGAAACUUCUCUCUUCGAAACCAA-5' (SEQ ID NO: 7338)

C5-3684 Target:
5'-TCAGCTTTGAAGAGAGAAGCTTTGGTT-3' (SEQ ID NO: 9648)

5'-CAGCUUUGAAGAGAGAAGCUUUGGUUA-3' (SEQ ID NO: 14269)

3'-GUCGAAACUUCUCUCUUCGAAACCAAU-5' (SEQ ID NO: 7339)

C5-3685 Target:
5'-CAGCTTTGAAGAGAGAAGCTTTGGTTA-3' (SEQ ID NO: 9649)

5'-AGCUUUGAAGAGAGAAGCUUUGGUUAA-3' (SEQ ID NO: 14270)

3'-UCGAAACUUCUCUCUUCGAAACCAAUU-5' (SEQ ID NO: 7340)

C5-3686 Target:
5'-AGCTTTGAAGAGAGAAGCTTTGGTTAA-3' (SEQ ID NO: 9650)

5'-GCUUUGAAGAGAGAAGCUUUGGUUAAA-3' (SEQ ID NO: 14271)

3'-CGAAACUUCUCUCUUCGAAACCAAUUU-5' (SEQ ID NO: 7341)

C5-3687 Target:
5'-GCTTTGAAGAGAGAAGCTTTGGTTAAA-3' (SEQ ID NO: 9651)

5'-CUUUGAAGAGAGAAGCUUUGGUUAAAG-3' (SEQ ID NO: 14272)

3'-GAAACUUCUCUCUUCGAAACCAAUUUC-5' (SEQ ID NO: 7342)

TABLE 9-continued

"Blunt/Blunt" DsiRNAs Corresponding to Human Anti-C5 DsiRNAs Predicted to have >50% Knockdown Efficacy C5-3688 Target:
5'-CTTTGAAGAGAGAAGCTTTGGTTAAAG-3' (SEQ ID NO: 9652)

5'-UUUGAAGAGAGAAGCUUUGGUUAAAGG-3' (SEQ ID NO: 14273)

3'-AAACUUCUCUCUUCGAAACCAAUUUCC-5' (SEQ ID NO: 7343)

C5-3689 Target:
5'-TTTGAAGAGAGAAGCTTTGGTTAAAGG-3' (SEQ ID NO: 9653)

5'-AAGAGAGAAGCUUUGGUUAAAGGUAAU-3' (SEQ ID NO: 14274)

3'-UUCUCUCUUCGAAACCAAUUUCCAUUA-5' (SEQ ID NO: 7344)

C5-3693 Target:
5'-AAGAGAGAAGCTTTGGTTAAAGGTAAT-3' (SEQ ID NO: 9654)

5'-AGAGAGAAGCUUUGGUUAAAGGUAAUC-3' (SEQ ID NO: 14275)

3'-UCUCUCUUCGAAACCAAUUUCCAUUAG-5' (SEQ ID NO: 7345)

C5-3694 Target:
5'-AGAGAGAAGCTTTGGTTAAAGGTAATC-3' (SEQ ID NO: 9655)

5'-GAGAGAAGCUUUGGUUAAAGGUAAUCC-3' (SEQ ID NO: 14276)

3'-CUCUCUUCGAAACCAAUUUCCAUUAGG-5' (SEQ ID NO: 7346)

C5-3695 Target:
5'-GAGAGAAGCTTTGGTTAAAGGTAATCC-3' (SEQ ID NO: 9656)

5'-AGAAGCUUUGGUUAAAGGUAAUCCACC-3' (SEQ ID NO: 14277)

3'-UCUUCGAAACCAAUUUCCAUUAGGUGG-5' (SEQ ID NO: 7347)

C5-3698 Target:
5'-AGAAGCTTTGGTTAAAGGTAATCCACC-3' (SEQ ID NO: 9657)

5'-GAAGCUUUGGUUAAAGGUAAUCCACCC-3' (SEQ ID NO: 14278)

3'-CUUCGAAACCAAUUUCCAUUAGGUGGG-5' (SEQ ID NO: 7348)

C5-3699 Target:
5'-GAAGCTTTGGTTAAAGGTAATCCACCC-3' (SEQ ID NO: 9658)

5'-AAGCUUUGGUUAAAGGUAAUCCACCCA-3' (SEQ ID NO: 14279)

3'-UUCGAAACCAAUUUCCAUUAGGUGGGU-5' (SEQ ID NO: 7349)

C5-3700 Target:
5'-AAGCTTTGGTTAAAGGTAATCCACCCA-3' (SEQ ID NO: 9659)

5'-AGCUUUGGUUAAAGGUAAUCCACCCAU-3' (SEQ ID NO: 14280)

3'-UCGAAACCAAUUUCCAUUAGGUGGGUA-5' (SEQ ID NO: 7350)

C5-3701 Target:
5'-AGCTTTGGTTAAAGGTAATCCACCCAT-3' (SEQ ID NO: 9660)

5'-GCUUUGGUUAAAGGUAAUCCACCCAUU-3' (SEQ ID NO: 14281)

3'-CGAAACCAAUUUCCAUUAGGUGGGUAA-5' (SEQ ID NO: 7351)

C5-3702 Target:
5'-GCTTTGGTTAAAGGTAATCCACCCATT-3' (SEQ ID NO: 9661)

5'-CUUUGGUUAAAGGUAAUCCACCCAUUU-3' (SEQ ID NO: 14282)

3'-GAAACCAAUUUCCAUUAGGUGGGUAAA-5' (SEQ ID NO: 7352)

C5-3703 Target:
5'-CTTTGGTTAAAGGTAATCCACCCATTT-3' (SEQ ID NO: 9662)

5'-UUUGGUUAAAGGUAAUCCACCCAUUUA-3' (SEQ ID NO: 14283)

3'-AAACCAAUUUCCAUUAGGUGGGUAAAU-5' (SEQ ID NO: 7353)

C5-3704 Target:
5'-TTTGGTTAAAGGTAATCCACCCATTTA-3' (SEQ ID NO: 9663)

5'-UUGGUUAAAGGUAAUCCACCCAUUUAU-3' (SEQ ID NO: 14284)

3'-AACCAAUUUCCAUUAGGUGGGUAAAUA-5' (SEQ ID NO: 7354)

C5-3705 Target:
5'-TTGGTTAAAGGTAATCCACCCATTTAT-3' (SEQ ID NO: 9664)

5'-UGGUUAAAGGUAAUCCACCCAUUUAUC-3' (SEQ ID NO: 14285)

3'-ACCAAUUUCCAUUAGGUGGGUAAAUAG-5' (SEQ ID NO: 7355)

C5-3706 Target:
5'-TGGTTAAAGGTAATCCACCCATTTATC-3' (SEQ ID NO: 9665)

5'-GGUUAAAGGUAAUCCACCCAUUUAUCG-3' (SEQ ID NO: 14286)

3'-CCAAUUUCCAUUAGGUGGGUAAAUAGC-5' (SEQ ID NO: 7356)

C5-3707 Target:
5'-GGTTAAAGGTAATCCACCCATTTATCG-3' (SEQ ID NO: 9666)

5'-GUUAAAGGUAAUCCACCCAUUUAUCGU-3' (SEQ ID NO: 14287)

3'-CAAUUUCCAUUAGGUGGGUAAAUAGCA-5' (SEQ ID NO: 7357)

C5-3708 Target:
5'-GTTAAAGGTAATCCACCCATTTATCGT-3' (SEQ ID NO: 9667)

5'-UUAAAGGUAAUCCACCCAUUUAUCGUU-3' (SEQ ID NO: 14288)

3'-AAUUUCCAUUAGGUGGGUAAAUAGCAA-5' (SEQ ID NO: 7358)

C5-3709 Target:
5'-TTAAAGGTAATCCACCCATTTATCGTT-3' (SEQ ID NO: 9668)

5'-UAAAGGUAAUCCACCCAUUUAUCGUUU-3' (SEQ ID NO: 14289)

3'-AUUUCCAUUAGGUGGGUAAAUAGCAAA-5' (SEQ ID NO: 7359)

C5-3710 Target:
5'-TAAAGGTAATCCACCCATTTATCGTTT-3' (SEQ ID NO: 9669)

5'-AAAGGUAAUCCACCCAUUUAUCGUUUU-3' (SEQ ID NO: 14290)

3'-UUUCCAUUAGGUGGGUAAAUAGCAAAA-5' (SEQ ID NO: 7360)

C5-3711 Target:
5'-AAAGGTAATCCACCCATTTATCGTTTT-3' (SEQ ID NO: 9670)

5'-AAGGUAAUCCACCCAUUUAUCGUUUUU-3' (SEQ ID NO: 14291)

3'-UUCCAUUAGGUGGGUAAAUAGCAAAAA-5' (SEQ ID NO: 7361)

C5-3712 Target:
5'-AAGGTAATCCACCCATTTATCGTTTTT-3' (SEQ ID NO: 9671)

5'-AGGUAAUCCACCCAUUUAUCGUUUUUG-3' (SEQ ID NO: 14292)

3'-UCCAUUAGGUGGGUAAAUAGCAAAAAC-5' (SEQ ID NO: 7362)

TABLE 9-continued

"Blunt/Blunt" DsiRNAs Corresponding to Human Anti-C5 DsiRNAs Predicted to have >50% Knockdown Efficacy C5-3713 Target:
5'-AGGTAATCCACCCATTTATCGTTTTTG-3' (SEQ ID NO: 9672)

5'-GGUAAUCCACCCAUUUAUCGUUUUUGG-3' (SEQ ID NO: 14293)

3'-CCAUUAGGUGGGUAAAUAGCAAAAACC-5' (SEQ ID NO: 7363)

C5-3714 Target:
5'-GGTAATCCACCCATTTATCGTTTTTGG-3' (SEQ ID NO: 9673)

5'-GUAAUCCACCCAUUUAUCGUUUUUGGA-3' (SEQ ID NO: 14294)

3'-CAUUAGGUGGGUAAAUAGCAAAAACCU-5' (SEQ ID NO: 7364)

C5-3715 Target:
5'-GTAATCCACCCATTTATCGTTTTTGGA-3' (SEQ ID NO: 9674)

5'-UAAUCCACCCAUUUAUCGUUUUUGGAA-3' (SEQ ID NO: 14295)

3'-AUUAGGUGGGUAAAUAGCAAAAACCUU-5' (SEQ ID NO: 7365)

C5-3716 Target:
5'-TAATCCACCCATTTATCGTTTTTGGAA-3' (SEQ ID NO: 9675)

5'-AAUCCACCCAUUUAUCGUUUUUGGAAA-3' (SEQ ID NO: 14296)

3'-UUAGGUGGGUAAAUAGCAAAAACCUUU-5' (SEQ ID NO: 7366)

C5-3717 Target:
5'-AATCCACCCATTTATCGTTTTTGGAAA-3' (SEQ ID NO: 9676)

5'-AUCCACCCAUUUAUCGUUUUUGGAAAG-3' (SEQ ID NO: 14297)

3'-UAGGUGGGUAAAUAGCAAAAACCUUUC-5' (SEQ ID NO: 7367)

C5-3718 Target:
5'-ATCCACCCATTTATCGTTTTTGGAAAG-3' (SEQ ID NO: 9677)

5'-UCCACCCAUUUAUCGUUUUUGGAAAGA-3' (SEQ ID NO: 14298)

3'-AGGUGGGUAAAUAGCAAAAACCUUUCU-5' (SEQ ID NO: 7368)

C5-3719 Target:
5'-TCCACCCATTTATCGTTTTTGGAAAGA-3' (SEQ ID NO: 9678)

5'-CCACCCAUUUAUCGUUUUUGGAAAGAC-3' (SEQ ID NO: 14299)

3'-GGUGGGUAAAUAGCAAAAACCUUUCUG-5' (SEQ ID NO: 7369)

C5-3720 Target:
5'-CCACCCATTTATCGTTTTTGGAAAGAC-3' (SEQ ID NO: 9679)

5'-CACCCAUUUAUCGUUUUUGGAAAGACA-3' (SEQ ID NO: 14300)

3'-GUGGGUAAAUAGCAAAAACCUUUCUGU-5' (SEQ ID NO: 7370)

C5-3721 Target:
5'-CACCCATTTATCGTTTTTGGAAAGACA-3' (SEQ ID NO: 9680)

5'-CCCAUUUAUCGUUUUUGGAAAGACAAU-3' (SEQ ID NO: 14301)

3'-GGGUAAAUAGCAAAAACCUUUCUGUUA-5' (SEQ ID NO: 7371)

C5-3723 Target:
5'-CCCATTTATCGTTTTTGGAAAGACAAT-3' (SEQ ID NO: 9681)

5'-CCAUUUAUCGUUUUUGGAAAGACAAUC-3' (SEQ ID NO: 14302)

3'-GGUAAAUAGCAAAAACCUUUCUGUUAG-5' (SEQ ID NO: 7372)

C5-3724 Target:
5'-CCATTTATCGTTTTTGGAAAGACAATC-3' (SEQ ID NO: 9682)

5'-CAUUUAUCGUUUUUGGAAAGACAAUCU-3' (SEQ ID NO: 14303)

3'-GUAAAUAGCAAAAACCUUUCUGUUAGA-5' (SEQ ID NO: 7373)

C5-3725 Target:
5'-CATTTATCGTTTTTGGAAAGACAATCT-3' (SEQ ID NO: 9683)

5'-AUUUAUCGUUUUUGGAAAGACAAUCUU-3' (SEQ ID NO: 14304)

3'-UAAAUAGCAAAAACCUUUCUGUUAGAA-5' (SEQ ID NO: 7374)

C5-3726 Target:
5'-ATTTATCGTTTTTGGAAAGACAATCTT-3' (SEQ ID NO: 9684)

5'-UUUAUCGUUUUUGGAAAGACAAUCUUC-3' (SEQ ID NO: 14305)

3'-AAAUAGCAAAAACCUUUCUGUUAGAAG-5' (SEQ ID NO: 7375)

C5-3727 Target:
5'-TTTATCGTTTTTGGAAAGACAATCTTC-3' (SEQ ID NO: 9685)

5'-AGCAUAAAGACAGCUCUGUACCUAACA-3' (SEQ ID NO: 14306)

3'-UCGUAUUUCUGUCGAGACAUGGAUUGU-5' (SEQ ID NO: 7376)

C5-3754 Target:
5'-AGCATAAAGACAGCTCTGTACCTAACA-3' (SEQ ID NO: 9686)

5'-GCAUAAAGACAGCUCUGUACCUAACAC-3' (SEQ ID NO: 14307)

3'-CGUAUUUCUGUCGAGACAUGGAUUGUG-5' (SEQ ID NO: 7377)

C5-3755 Target:
5'-GCATAAAGACAGCTCTGTACCTAACAC-3' (SEQ ID NO: 9687)

5'-CAUAAAGACAGCUCUGUACCUAACACU-3' (SEQ ID NO: 14308)

3'-GUAUUUCUGUCGAGACAUGGAUUGUGA-5' (SEQ ID NO: 7378)

C5-3756 Target:
5'-CATAAAGACAGCTCTGTACCTAACACT-3' (SEQ ID NO: 9688)

5'-AUAAAGACAGCUCUGUACCUAACACUG-3' (SEQ ID NO: 14309)

3'-UAUUUCUGUCGAGACAUGGAUUGUGAC-5' (SEQ ID NO: 7379)

C5-3757 Target:
5'-ATAAAGACAGCTCTGTACCTAACACTG-3' (SEQ ID NO: 9689)

5'-UAAAGACAGCUCUGUACCUAACACUGG-3' (SEQ ID NO: 14310)

3'-AUUUCUGUCGAGACAUGGAUUGUGACC-5' (SEQ ID NO: 7380)

C5-3758 Target:
5'-TAAAGACAGCTCTGTACCTAACACTGG-3' (SEQ ID NO: 9690)

5'-AAAGACAGCUCUGUACCUAACACUGGU-3' (SEQ ID NO: 14311)

3'-UUUCUGUCGAGACAUGGAUUGUGACCA-5' (SEQ ID NO: 7381)

C5-3759 Target:
5'-AAAGACAGCTCTGTACCTAACACTGGT-3' (SEQ ID NO: 9691)

5'-AAGACAGCUCUGUACCUAACACUGGUA-3' (SEQ ID NO: 14312)

3'-UUCUGUCGAGACAUGGAUUGUGACCAU-5' (SEQ ID NO: 7382)

TABLE 9-continued

"Blunt/Blunt" DsiRNAs Corresponding to Human Anti-C5
DsiRNAs Predicted to have >50% Knockdown Efficacy C5-3760 Target:
5'-AAGACAGCTCTGTACCTAACACTGGTA-3' (SEQ ID NO: 9692)

5'-AGACAGCUCUGUACCUAACACUGGUAC-3' (SEQ ID NO: 14313)

3'-UCUGUCGAGACAUGGAUUGUGACCAUG-5' (SEQ ID NO: 7383)

C5-3761 Target:
5'-AGACAGCTCTGTACCTAACACTGGTAC-3' (SEQ ID NO: 9693)

5'-GACAGCUCUGUACCUAACACUGGUACG-3' (SEQ ID NO: 14314)

3'-CUGUCGAGACAUGGAUUGUGACCAUGC-5' (SEQ ID NO: 7384)

C5-3762 Target:
5'-GACAGCTCTGTACCTAACACTGGTACG-3' (SEQ ID NO: 9694)

5'-ACAGCUCUGUACCUAACACUGGUACGG-3' (SEQ ID NO: 14315)

3'-UGUCGAGACAUGGAUUGUGACCAUGCC-5' (SEQ ID NO: 7385)

C5-3763 Target:
5'-ACAGCTCTGTACCTAACACTGGTACGG-3' (SEQ ID NO: 9695)

5'-CAGCUCUGUACCUAACACUGGUACGGC-3' (SEQ ID NO: 14316)

3'-GUCGAGACAUGGAUUGUGACCAUGCCG-5' (SEQ ID NO: 7386)

C5-3764 Target:
5'-CAGCTCTGTACCTAACACTGGTACGGC-3' (SEQ ID NO: 9696)

5'-AGCUCUGUACCUAACACUGGUACGGCA-3' (SEQ ID NO: 14317)

3'-UCGAGACAUGGAUUGUGACCAUGCCGU-5' (SEQ ID NO: 7387)

C5-3765 Target:
5'-AGCTCTGTACCTAACACTGGTACGGCA-3' (SEQ ID NO: 9697)

5'-GCUCUGUACCUAACACUGGUACGGCAC-3' (SEQ ID NO: 14318)

3'-CGAGACAUGGAUUGUGACCAUGCCGUG-5' (SEQ ID NO: 7388)

C5-3766 Target:
5'-GCTCTGTACCTAACACTGGTACGGCAC-3' (SEQ ID NO: 9698)

5'-CUCUGUACCUAACACUGGUACGGCACG-3' (SEQ ID NO: 14319)

3'-GAGACAUGGAUUGUGACCAUGCCGUGC-5' (SEQ ID NO: 7389)

C5-3767 Target:
5'-CTCTGTACCTAACACTGGTACGGCACG-3' (SEQ ID NO: 9699)

5'-CGGCACGUAUGGUAGAAACAACUGCCU-3' (SEQ ID NO: 14320)

3'-GCCGUGCAUACCAUCUUUGUUGACGGA-5' (SEQ ID NO: 7390)

C5-3787 Target:
5'-CGGCACGTATGGTAGAAACAACTGCCT-3' (SEQ ID NO: 9700)

5'-GGCACGUAUGGUAGAAACAACUGCCUA-3' (SEQ ID NO: 14321)

3'-CCGUGCAUACCAUCUUUGUUGACGGAU-5' (SEQ ID NO: 7391)

C5-3788 Target:
5'-GGCACGTATGGTAGAAACAACTGCCTA-3' (SEQ ID NO: 9701)

5'-GCACGUAUGGUAGAAACAACUGCCUAU-3' (SEQ ID NO: 14322)

3'-CGUGCAUACCAUCUUUGUUGACGGAUA-5' (SEQ ID NO: 7392)

C5-3789 Target:
5'-GCACGTATGGTAGAAACAACTGCCTAT-3' (SEQ ID NO: 9702)

5'-CACGUAUGGUAGAAACAACUGCCUAUG-3' (SEQ ID NO: 14323)

3'-GUGCAUACCAUCUUUGUUGACGGAUAC-5' (SEQ ID NO: 7393)

C5-3790 Target:
5'-CACGTATGGTAGAAACAACTGCCTATG-3' (SEQ ID NO: 9703)

5'-ACGUAUGGUAGAAACAACUGCCUAUGC-3' (SEQ ID NO: 14324)

3'-UGCAUACCAUCUUUGUUGACGGAUACG-5' (SEQ ID NO: 7394)

C5-3791 Target:
5'-ACGTATGGTAGAAACAACTGCCTATGC-3' (SEQ ID NO: 9704)

5'-CGUAUGGUAGAAACAACUGCCUAUGCU-3' (SEQ ID NO: 14325)

3'-GCAUACCAUCUUUGUUGACGGAUACGA-5' (SEQ ID NO: 7395)

C5-3792 Target:
5'-CGTATGGTAGAAACAACTGCCTATGCT-3' (SEQ ID NO: 9705)

5'-GUAUGGUAGAAACAACUGCCUAUGCUU-3' (SEQ ID NO: 14326)

3'-CAUACCAUCUUUGUUGACGGAUACGAA-5' (SEQ ID NO: 7396)

C5-3793 Target:
5'-GTATGGTAGAAACAACTGCCTATGCTT-3' (SEQ ID NO: 9706)

5'-UAUGGUAGAAACAACUGCCUAUGCUUU-3' (SEQ ID NO: 14327)

3'-AUACCAUCUUUGUUGACGGAUACGAAA-5' (SEQ ID NO: 7397)

C5-3794 Target:
5'-TATGGTAGAAACAACTGCCTATGCTTT-3' (SEQ ID NO: 9707)

5'-AUGGUAGAAACAACUGCCUAUGCUUUA-3' (SEQ ID NO: 14328)

3'-UACCAUCUUUGUUGACGGAUACGAAAU-5' (SEQ ID NO: 7398)

C5-3795 Target:
5'-ATGGTAGAAACAACTGCCTATGCTTTA-3' (SEQ ID NO: 9708)

5'-UGGUAGAAACAACUGCCUAUGCUUUAC-3' (SEQ ID NO: 14329)

3'-ACCAUCUUUGUUGACGGAUACGAAAUG-5' (SEQ ID NO: 7399)

C5-3796 Target:
5'-TGGTAGAAACAACTGCCTATGCTTTAC-3' (SEQ ID NO: 9709)

5'-GGUAGAAACAACUGCCUAUGCUUUACU-3' (SEQ ID NO: 14330)

3'-CCAUCUUUGUUGACGGAUACGAAAUGA-5' (SEQ ID NO: 7400)

C5-3797 Target:
5'-GGTAGAAACAACTGCCTATGCTTTACT-3' (SEQ ID NO: 9710)

5'-GUAGAAACAACUGCCUAUGCUUUACUC-3' (SEQ ID NO: 14331)

3'-CAUCUUUGUUGACGGAUACGAAAUGAG-5' (SEQ ID NO: 7401)

C5-3798 Target:
5'-GTAGAAACAACTGCCTATGCTTTACTC-3' (SEQ ID NO: 9711)

5'-UAGAAACAACUGCCUAUGCUUUACUCA-3' (SEQ ID NO: 14332)

3'-AUCUUUGUUGACGGAUACGAAAUGAGU-5' (SEQ ID NO: 7402)

TABLE 9-continued

"Blunt/Blunt" DsiRNAs Corresponding to Human Anti-C5 DsiRNAs Predicted to have >50% Knockdown Efficacy C5-3799 Target:
5'-TAGAAACAACTGCCTATGCTTTACTCA-3' (SEQ ID NO: 9712)

5'-AGAAACAACUGCCUAUGCUUUACUCAC-3' (SEQ ID NO: 14333)

3'-UCUUUGUUGACGGAUACGAAAUGAGUG-5' (SEQ ID NO: 7403)

C5-3800 Target:
5'-AGAAACAACTGCCTATGCTTTACTCAC-3' (SEQ ID NO: 9713)

5'-GAAACAACUGCCUAUGCUUUACUCACC-3' (SEQ ID NO: 14334)

3'-CUUUGUUGACGGAUACGAAAUGAGUGG-5' (SEQ ID NO: 7404)

C5-3801 Target:
5'-GAAACAACTGCCTATGCTTTACTCACC-3' (SEQ ID NO: 9714)

5'-AAACAACUGCCUAUGCUUUACUCACCA-3' (SEQ ID NO: 14335)

3'-UUUGUUGACGGAUACGAAAUGAGUGGU-5' (SEQ ID NO: 7405)

C5-3802 Target:
5'-AAACAACTGCCTATGCTTTACTCACCA-3' (SEQ ID NO: 9715)

5'-AACAACUGCCUAUGCUUUACUCACCAG-3' (SEQ ID NO: 14336)

3'-UUGUUGACGGAUACGAAAUGAGUGGUC-5' (SEQ ID NO: 7406)

C5-3803 Target:
5'-AACAACTGCCTATGCTTTACTCACCAG-3' (SEQ ID NO: 9716)

5'-ACAACUGCCUAUGCUUUACUCACCAGU-3' (SEQ ID NO: 14337)

3'-UGUUGACGGAUACGAAAUGAGUGGUCA-5' (SEQ ID NO: 7407)

C5-3804 Target:
5'-ACAACTGCCTATGCTTTACTCACCAGT-3' (SEQ ID NO: 9717)

5'-CAACUGCCUAUGCUUUACUCACCAGUC-3' (SEQ ID NO: 14338)

3'-GUUGACGGAUACGAAAUGAGUGGUCAG-5' (SEQ ID NO: 7408)

C5-3805 Target:
5'-CAACTGCCTATGCTTTACTCACCAGTC-3' (SEQ ID NO: 9718)

5'-AACUGCCUAUGCUUUACUCACCAGUCU-3' (SEQ ID NO: 14339)

3'-UUGACGGAUACGAAAUGAGUGGUCAGA-5' (SEQ ID NO: 7409)

C5-3806 Target:
5'-AACTGCCTATGCTTTACTCACCAGTCT-3' (SEQ ID NO: 9719)

5'-ACUGCCUAUGCUUUACUCACCAGUCUG-3' (SEQ ID NO: 14340)

3'-UGACGGAUACGAAAUGAGUGGUCAGAC-5' (SEQ ID NO: 7410)

C5-3807 Target:
5'-ACTGCCTATGCTTTACTCACCAGTCTG-3' (SEQ ID NO: 9720)

5'-CUGCCUAUGCUUUACUCACCAGUCUGA-3' (SEQ ID NO: 14341)

3'-GACGGAUACGAAAUGAGUGGUCAGACU-5' (SEQ ID NO: 7411)

C5-3808 Target:
5'-CTGCCTATGCTTTACTCACCAGTCTGA-3' (SEQ ID NO: 9721)

5'-UGCCUAUGCUUUACUCACCAGUCUGAA-3' (SEQ ID NO: 14342)

3'-ACGGAUACGAAAUGAGUGGUCAGACUU-5' (SEQ ID NO: 7412)

C5-3809 Target:
5'-TGCCTATGCTTTACTCACCAGTCTGAA-3' (SEQ ID NO: 9722)

5'-GCCUAUGCUUUACUCACCAGUCUGAAC-3' (SEQ ID NO: 14343)

3'-CGGAUACGAAAUGAGUGGUCAGACUUG-5' (SEQ ID NO: 7413)

C5-3810 Target:
5'-GCCTATGCTTTACTCACCAGTCTGAAC-3' (SEQ ID NO: 9723)

5'-CCUAUGCUUUACUCACCAGUCUGAACU-3' (SEQ ID NO: 14344)

3'-GGAUACGAAAUGAGUGGUCAGACUUGA-5' (SEQ ID NO: 7414)

C5-3811 Target:
5'-CCTATGCTTTACTCACCAGTCTGAACT-3' (SEQ ID NO: 9724)

5'-CUAUGCUUUACUCACCAGUCUGAACUU-3' (SEQ ID NO: 14345)

3'-GAUACGAAAUGAGUGGUCAGACUUGAA-5' (SEQ ID NO: 7415)

C5-3812 Target:
5'-CTATGCTTTACTCACCAGTCTGAACTT-3' (SEQ ID NO: 9725)

5'-UAUGCUUUACUCACCAGUCUGAACUUG-3' (SEQ ID NO: 14346)

3'-AUACGAAAUGAGUGGUCAGACUUGAAC-5' (SEQ ID NO: 7416)

C5-3813 Target:
5'-TATGCTTTACTCACCAGTCTGAACTTG-3' (SEQ ID NO: 9726)

5'-GCUUUACUCACCAGUCUGAACUUGAAA-3' (SEQ ID NO: 14347)

3'-CGAAAUGAGUGGUCAGACUUGAACUUU-5' (SEQ ID NO: 7417)

C5-3816 Target:
5'-GCTTTACTCACCAGTCTGAACTTGAAA-3' (SEQ ID NO: 9727)

5'-CUUUACUCACCAGUCUGAACUUGAAAG-3' (SEQ ID NO: 14348)

3'-GAAAUGAGUGGUCAGACUUGAACUUUC-5' (SEQ ID NO: 7418)

C5-3817 Target:
5'-CTTTACTCACCAGTCTGAACTTGAAAG-3' (SEQ ID NO: 9728)

5'-UUUACUCACCAGUCUGAACUUGAAAGA-3' (SEQ ID NO: 14349)

3'-AAAUGAGUGGUCAGACUUGAACUUUCU-5' (SEQ ID NO: 7419)

C5-3818 Target:
5'-TTTACTCACCAGTCTGAACTTGAAAGA-3' (SEQ ID NO: 9729)

5'-UUACUCACCAGUCUGAACUUGAAAGAU-3' (SEQ ID NO: 14350)

3'-AAUGAGUGGUCAGACUUGAACUUUCUA-5' (SEQ ID NO: 7420)

C5-3819 Target:
5'-TTACTCACCAGTCTGAACTTGAAAGAT-3' (SEQ ID NO: 9730)

5'-ACUCACCAGUCUGAACUUGAAAGAUAU-3' (SEQ ID NO: 14351)

3'-UGAGUGGUCAGACUUGAACUUUCUAUA-5' (SEQ ID NO: 7421)

C5-3821 Target:
5'-ACTCACCAGTCTGAACTTGAAAGATAT-3' (SEQ ID NO: 9731)

5'-CUCACCAGUCUGAACUUGAAAGAUAUA-3' (SEQ ID NO: 14352)

3'-GAGUGGUCAGACUUGAACUUUCUAUAU-5' (SEQ ID NO: 7422)

TABLE 9-continued

"Blunt/Blunt" DsiRNAs Corresponding to Human Anti-C5 DsiRNAs Predicted to have >50% Knockdown Efficacy C5-3822 Target:
5'-CTCACCAGTCTGAACTTGAAAGATATA-3' (SEQ ID NO: 9732)

5'-UCACCAGUCUGAACUUGAAAGAUAUAA-3' (SEQ ID NO: 14353)

3'-AGUGGUCAGACUUGAACUUUCUAUAUU-5' (SEQ ID NO: 7423)

C5-3823 Target:
5'-TCACCAGTCTGAACTTGAAAGATATAA-3' (SEQ ID NO: 9733)

5'-AGUCAUCAAAUGGCUAUCAGAAGAGCA-3' (SEQ ID NO: 14354)

3'-UCAGUAGUUUACCGAUAGUCUUCUCGU-5' (SEQ ID NO: 7424)

C5-3863 Target:
5'-AGTCATCAAATGGCTATCAGAAGAGCA-3' (SEQ ID NO: 9734)

5'-GUCAUCAAAUGGCUAUCAGAAGAGCAG-3' (SEQ ID NO: 14355)

3'-CAGUAGUUUACCGAUAGUCUUCUCGUC-5' (SEQ ID NO: 7425)

C5-3864 Target:
5'-GTCATCAAATGGCTATCAGAAGAGCAG-3' (SEQ ID NO: 9735)

5'-UCAUCAAAUGGCUAUCAGAAGAGCAGA-3' (SEQ ID NO: 14356)

3'-AGUAGUUUACCGAUAGUCUUCUCGUCU-5' (SEQ ID NO: 7426)

C5-3865 Target:
5'-TCATCAAATGGCTATCAGAAGAGCAGA-3' (SEQ ID NO: 9736)

5'-CAUCAAAUGGCUAUCAGAAGAGCAGAG-3' (SEQ ID NO: 14357)

3'-GUAGUUUACCGAUAGUCUUCUCGUCUC-5' (SEQ ID NO: 7427)

C5-3866 Target:
5'-CATCAAATGGCTATCAGAAGAGCAGAG-3' (SEQ ID NO: 9737)

5'-AUCAAAUGGCUAUCAGAAGAGCAGAGG-3' (SEQ ID NO: 14358)

3'-UAGUUUACCGAUAGUCUUCUCGUCUCC-5' (SEQ ID NO: 7428)

C5-3867 Target:
5'-ATCAAATGGCTATCAGAAGAGCAGAGG-3' (SEQ ID NO: 9738)

5'-UCAAAUGGCUAUCAGAAGAGCAGAGGU-3' (SEQ ID NO: 14359)

3'-AGUUUACCGAUAGUCUUCUCGUCUCCA-5' (SEQ ID NO: 7429)

C5-3868 Target:
5'-TCAAATGGCTATCAGAAGAGCAGAGGT-3' (SEQ ID NO: 9739)

5'-CAAAUGGCUAUCAGAAGAGCAGAGGUA-3' (SEQ ID NO: 14360)

3'-GUUUACCGAUAGUCUUCUCGUCUCCAU-5' (SEQ ID NO: 7430)

C5-3869 Target:
5'-CAAATGGCTATCAGAAGAGCAGAGGTA-3' (SEQ ID NO: 9740)

5'-AAAUGGCUAUCAGAAGAGCAGAGGUAU-3' (SEQ ID NO: 14361)

3'-UUUACCGAUAGUCUUCUCGUCUCCAUA-5' (SEQ ID NO: 7431)

C5-3870 Target:
5'-AAATGGCTATCAGAAGAGCAGAGGTAT-3' (SEQ ID NO: 9741)

5'-AAUGGCUAUCAGAAGAGCAGAGGUAUG-3' (SEQ ID NO: 14362)

3'-UUACCGAUAGUCUUCUCGUCUCCAUAC-5' (SEQ ID NO: 7432)

C5-3871 Target:
5'-AATGGCTATCAGAAGAGCAGAGGTATG-3' (SEQ ID NO: 9742)

5'-AUGGCUAUCAGAAGAGCAGAGGUAUGG-3' (SEQ ID NO: 14363)

3'-UACCGAUAGUCUUCUCGUCUCCAUACC-5' (SEQ ID NO: 7433)

C5-3872 Target:
5'-ATGGCTATCAGAAGAGCAGAGGTATGG-3' (SEQ ID NO: 9743)

5'-UGGCUAUCAGAAGAGCAGAGGUAUGGA-3' (SEQ ID NO: 14364)

3'-ACCGAUAGUCUUCUCGUCUCCAUACCU-5' (SEQ ID NO: 7434)

C5-3873 Target:
5'-TGGCTATCAGAAGAGCAGAGGTATGGA-3' (SEQ ID NO: 9744)

5'-GGCUAUCAGAAGAGCAGAGGUAUGGAG-3' (SEQ ID NO: 14365)

3'-CCGAUAGUCUUCUCGUCUCCAUACCUC-5' (SEQ ID NO: 7435)

C5-3874 Target:
5'-GGCTATCAGAAGAGCAGAGGTATGGAG-3' (SEQ ID NO: 9745)

5'-GCUAUCAGAAGAGCAGAGGUAUGGAGG-3' (SEQ ID NO: 14366)

3'-CGAUAGUCUUCUCGUCUCCAUACCUCC-5' (SEQ ID NO: 7436)

C5-3875 Target:
5'-GCTATCAGAAGAGCAGAGGTATGGAGG-3' (SEQ ID NO: 9746)

5'-CUAUCAGAAGAGCAGAGGUAUGGAGGU-3' (SEQ ID NO: 14367)

3'-GAUAGUCUUCUCGUCUCCAUACCUCCA-5' (SEQ ID NO: 7437)

C5-3876 Target:
5'-CTATCAGAAGAGCAGAGGTATGGAGGT-3' (SEQ ID NO: 9747)

5'-UAUCAGAAGAGCAGAGGUAUGGAGGUG-3' (SEQ ID NO: 14368)

3'-AUAGUCUUCUCGUCUCCAUACCUCCAC-5' (SEQ ID NO: 7438)

C5-3877 Target:
5'-TATCAGAAGAGCAGAGGTATGGAGGTG-3' (SEQ ID NO: 9748)

5'-AUCAGAAGAGCAGAGGUAUGGAGGUGG-3' (SEQ ID NO: 14369)

3'-UAGUCUUCUCGUCUCCAUACCUCCACC-5' (SEQ ID NO: 7439)

C5-3878 Target:
5'-ATCAGAAGAGCAGAGGTATGGAGGTGG-3' (SEQ ID NO: 9749)

5'-UCAGAAGAGCAGAGGUAUGGAGGUGGC-3' (SEQ ID NO: 14370)

3'-AGUCUUCUCGUCUCCAUACCUCCACCG-5' (SEQ ID NO: 7440)

C5-3879 Target:
5'-TCAGAAGAGCAGAGGTATGGAGGTGGC-3' (SEQ ID NO: 9750)

5'-GAAGAGCAGAGGUAUGGAGGUGGCUUU-3' (SEQ ID NO: 14371)

3'-CUUCUCGUCUCCAUACCUCCACCGAAA-5' (SEQ ID NO: 7441)

C5-3882 Target:
5'-GAAGAGCAGAGGTATGGAGGTGGCTTT-3' (SEQ ID NO: 9751)

5'-AAGAGCAGAGGUAUGGAGGUGGCUUUU-3' (SEQ ID NO: 14372)

3'-UUCUCGUCUCCAUACCUCCACCGAAAA-5' (SEQ ID NO: 7442)

TABLE 9-continued

"Blunt/Blunt" DsiRNAs Corresponding to Human Anti-C5 DsiRNAs Predicted to have >50% Knockdown Efficacy C5-3883 Target:
5'-AAGAGCAGAGGTATGGAGGTGGCTTTT-3' (SEQ ID NO: 9752)

5'-AGAGCAGAGGUAUGGAGGUGGCUUUUA-3' (SEQ ID NO: 14373)

3'-UCUCGUCUCCAUACCUCCACCGAAAAU-5' (SEQ ID NO: 7443)

C5-3884 Target:
5'-AGAGCAGAGGTATGGAGGTGGCTTTTA-3' (SEQ ID NO: 9753)

5'-GAGCAGAGGUAUGGAGGUGGCUUUUAU-3' (SEQ ID NO: 14374)

3'-CUCGUCUCCAUACCUCCACCGAAAAUA-5' (SEQ ID NO: 7444)

C5-3885 Target:
5'-GAGCAGAGGTATGGAGGTGGCTTTTAT-3' (SEQ ID NO: 9754)

5'-AGCAGAGGUAUGGAGGUGGCUUUUAUU-3' (SEQ ID NO: 14375)

3'-UCGUCUCCAUACCUCCACCGAAAAUAA-5' (SEQ ID NO: 7445)

C5-3886 Target:
5'-AGCAGAGGTATGGAGGTGGCTTTTATT-3' (SEQ ID NO: 9755)

5'-GCAGAGGUAUGGAGGUGGCUUUUAUUC-3' (SEQ ID NO: 14376)

3'-CGUCUCCAUACCUCCACCGAAAAUAAG-5' (SEQ ID NO: 7446)

C5-3887 Target:
5'-GCAGAGGTATGGAGGTGGCTTTTATTC-3' (SEQ ID NO: 9756)

5'-CAGAGGUAUGGAGGUGGCUUUUAUUCA-3' (SEQ ID NO: 14377)

3'-GUCUCCAUACCUCCACCGAAAAUAAGU-5' (SEQ ID NO: 7447)

C5-3888 Target:
5'-CAGAGGTATGGAGGTGGCTTTTATTCA-3' (SEQ ID NO: 9757)

5'-AGAGGUAUGGAGGUGGCUUUUAUUCAA-3' (SEQ ID NO: 14378)

3'-UCUCCAUACCUCCACCGAAAAUAAGUU-5' (SEQ ID NO: 7448)

C5-3889 Target:
5'-AGAGGTATGGAGGTGGCTTTTATTCAA-3' (SEQ ID NO: 9758)

5'-GAGGUAUGGAGGUGGCUUUUAUUCAAC-3' (SEQ ID NO: 14379)

3'-CUCCAUACCUCCACCGAAAAUAAGUUG-5' (SEQ ID NO: 7449)

C5-3890 Target:
5'-GAGGTATGGAGGTGGCTTTTATTCAAC-3' (SEQ ID NO: 9759)

5'-AGGUAUGGAGGUGGCUUUUAUUCAACC-3' (SEQ ID NO: 14380)

3'-UCCAUACCUCCACCGAAAAUAAGUUGG-5' (SEQ ID NO: 7450)

C5-3891 Target:
5'-AGGTATGGAGGTGGCTTTTATTCAACC-3' (SEQ ID NO: 9760)

5'-GGUAUGGAGGUGGCUUUUAUUCAACCC-3' (SEQ ID NO: 14381)

3'-CCAUACCUCCACCGAAAAUAAGUUGGG-5' (SEQ ID NO: 7451)

C5-3892 Target:
5'-GGTATGGAGGTGGCTTTTATTCAACCC-3' (SEQ ID NO: 9761)

5'-GUAUGGAGGUGGCUUUUAUUCAACCCA-3' (SEQ ID NO: 14382)

3'-CAUACCUCCACCGAAAAUAAGUUGGGU-5' (SEQ ID NO: 7452)

TABLE 9-continued

"Blunt/Blunt" DsiRNAs Corresponding to Human Anti-C5 DsiRNAs Predicted to have >50% Knockdown Efficacy C5-3893 Target:
5'-GTATGGAGGTGGCTTTTATTCAACCCA-3' (SEQ ID NO: 9762)

5'-UAUGGAGGUGGCUUUUAUUCAACCCAG-3' (SEQ ID NO: 14383)

3'-AUACCUCCACCGAAAAUAAGUUGGGUC-5' (SEQ ID NO: 7453)

C5-3894 Target:
5'-TATGGAGGTGGCTTTTATTCAACCCAG-3' (SEQ ID NO: 9763)

5'-AUGGAGGUGGCUUUUAUUCAACCCAGG-3' (SEQ ID NO: 14384)

3'-UACCUCCACCGAAAAUAAGUUGGGUCC-5' (SEQ ID NO: 7454)

C5-3895 Target:
5'-ATGGAGGTGGCTTTTATTCAACCCAGG-3' (SEQ ID NO: 9764)

5'-UGGAGGUGGCUUUUAUUCAACCCAGGA-3' (SEQ ID NO: 14385)

3'-ACCUCCACCGAAAAUAAGUUGGGUCCU-5' (SEQ ID NO: 7455)

C5-3896 Target:
5'-TGGAGGTGGCTTTTATTCAACCCAGGA-3' (SEQ ID NO: 9765)

5'-GGAGGUGGCUUUUAUUCAACCCAGGAC-3' (SEQ ID NO: 14386)

3'-CCUCCACCGAAAAUAAGUUGGGUCCUG-5' (SEQ ID NO: 7456)

C5-3897 Target:
5'-GGAGGTGGCTTTTATTCAACCCAGGAC-3' (SEQ ID NO: 9766)

5'-GAGGUGGCUUUUAUUCAACCCAGGACA-3' (SEQ ID NO: 14387)

3'-CUCCACCGAAAAUAAGUUGGGUCCUGU-5' (SEQ ID NO: 7457)

C5-3898 Target:
5'-GAGGTGGCTTTTATTCAACCCAGGACA-3' (SEQ ID NO: 9767)

5'-AGGUGGCUUUUAUUCAACCCAGGACAC-3' (SEQ ID NO: 14388)

3'-UCCACCGAAAAUAAGUUGGGUCCUGUG-5' (SEQ ID NO: 7458)

C5-3899 Target:
5'-AGGTGGCTTTTATTCAACCCAGGACAC-3' (SEQ ID NO: 9768)

5'-GGAAUAUUCACUCCUGGUUAAACAACU-3' (SEQ ID NO: 14389)

3'-CCUUAUAAGUGAGGACCAAUUUGUUGA-5' (SEQ ID NO: 7459)

C5-3950 Target:
5'-GGAATATTCACTCCTGGTTAAACAACT-3' (SEQ ID NO: 9769)

5'-GAAUAUUCACUCCUGGUUAAACAACUC-3' (SEQ ID NO: 14390)

3'-CUUAUAAGUGAGGACCAAUUUGUUGAG-5' (SEQ ID NO: 7460)

C5-3951 Target:
5'-GAATATTCACTCCTGGTTAAACAACTC-3' (SEQ ID NO: 9770)

5'-AAUAUUCACUCCUGGUUAAACAACUCC-3' (SEQ ID NO: 14391)

3'-UUAUAAGUGAGGACCAAUUUGUUGAGG-5' (SEQ ID NO: 7461)

C5-3952 Target:
5'-AATATTCACTCCTGGTTAAACAACTCC-3' (SEQ ID NO: 9771)

5'-AUAUUCACUCCUGGUUAAACAACUCCG-3' (SEQ ID NO: 14392)

3'-UAUAAGUGAGGACCAAUUUGUUGAGGC-5' (SEQ ID NO: 7462)

TABLE 9-continued

"Blunt/Blunt" DsiRNAs Corresponding to Human Anti-C5 DsiRNAs Predicted to have >50% Knockdown Efficacy C5-3953 Target:
5'-ATATTCACTCCTGGTTAAACAACTCCG-3' (SEQ ID NO: 9772)

5'-GCCUUACAUAAUUAUAAAAUGACAGAC-3' (SEQ ID NO: 14393)

3'-CGGAAUGUAUUAAUAUUUUACUGUCUG-5' (SEQ ID NO: 7463)

C5-4020 Target:
5'-GCCTTACATAATTATAAAATGACAGAC-3' (SEQ ID NO: 9773)

5'-CCUUACAUAAUUAUAAAAUGACAGACA-3' (SEQ ID NO: 14394)

3'-GGAAUGUAUUAAUAUUUUACUGUCUGU-5' (SEQ ID NO: 7464)

C5-4021 Target:
5'-CCTTACATAATTATAAAATGACAGACA-3' (SEQ ID NO: 9774)

5'-CUUACAUAAUUAUAAAAUGACAGACAA-3' (SEQ ID NO: 14395)

3'-GAAUGUAUUAAUAUUUUACUGUCUGUU-5' (SEQ ID NO: 7465)

C5-4022 Target:
5'-CTTACATAATTATAAAATGACAGACAA-3' (SEQ ID NO: 9775)

5'-UUACAUAAUUAUAAAAUGACAGACAAG-3' (SEQ ID NO: 14396)

3'-AAUGUAUUAAUAUUUUACUGUCUGUUC-5' (SEQ ID NO: 7466)

C5-4023 Target:
5'-TTACATAATTATAAAATGACAGACAAG-3' (SEQ ID NO: 9776)

5'-UACAUAAUUAUAAAAUGACAGACAAGA-3' (SEQ ID NO: 14397)

3'-AUGUAUUAAUAUUUUACUGUCUGUUCU-5' (SEQ ID NO: 7467)

C5-4024 Target:
5'-TACATAATTATAAAATGACAGACAAGA-3' (SEQ ID NO: 9777)

5'-ACAUAAUUAUAAAAUGACAGACAAGAA-3' (SEQ ID NO: 14398)

3'-UGUAUUAAUAUUUUACUGUCUGUUCUU-5' (SEQ ID NO: 7468)

C5-4025 Target:
5'-ACATAATTATAAAATGACAGACAAGAA-3' (SEQ ID NO: 9778)

5'-CAUAAUUAUAAAAUGACAGACAAGAAU-3' (SEQ ID NO: 14399)

3'-GUAUUAAUAUUUUACUGUCUGUUCUUA-5' (SEQ ID NO: 7469)

C5-4026 Target:
5'-CATAATTATAAAATGACAGACAAGAAT-3' (SEQ ID NO: 9779)

5'-AUAAUUAUAAAAUGACAGACAAGAAUU-3' (SEQ ID NO: 14400)

3'-UAUUAAUAUUUUACUGUCUGUUCUUAA-5' (SEQ ID NO: 7470)

C5-4027 Target:
5'-ATAATTATAAAATGACAGACAAGAATT-3' (SEQ ID NO: 9780)

5'-UAAUUAUAAAAUGACAGACAAGAAUUU-3' (SEQ ID NO: 14401)

3'-AUUAAUAUUUUACUGUCUGUUCUUAAA-5' (SEQ ID NO: 7471)

C5-4028 Target:
5'-TAATTATAAAATGACAGACAAGAATTT-3' (SEQ ID NO: 9781)

5'-AAUUAUAAAAUGACAGACAAGAAUUUC-3' (SEQ ID NO: 14402)

3'-UUAAUAUUUUACUGUCUGUUCUUAAAG-5' (SEQ ID NO: 7472)

C5-4029 Target:
5'-AATTATAAAATGACAGACAAGAATTTC-3' (SEQ ID NO: 9782)

5'-AUUAUAAAAUGACAGACAAGAAUUUCC-3' (SEQ ID NO: 14403)

3'-UAAUAUUUUACUGUCUGUUCUUAAAGG-5' (SEQ ID NO: 7473)

C5-4030 Target:
5'-ATTATAAAATGACAGACAAGAATTTCC-3' (SEQ ID NO: 9783)

5'-UUAUAAAAUGACAGACAAGAAUUUCCU-3' (SEQ ID NO: 14404)

3'-AAUAUUUUACUGUCUGUUCUUAAAGGA-5' (SEQ ID NO: 7474)

C5-4031 Target:
5'-TTATAAAATGACAGACAAGAATTTCCT-3' (SEQ ID NO: 9784)

5'-UAUAAAAUGACAGACAAGAAUUUCCUU-3' (SEQ ID NO: 14405)

3'-AUAUUUUACUGUCUGUUCUUAAAGGAA-5' (SEQ ID NO: 7475)

C5-4032 Target:
5'-TATAAAATGACAGACAAGAATTTCCTT-3' (SEQ ID NO: 9785)

5'-AUAAAAUGACAGACAAGAAUUUCCUUG-3' (SEQ ID NO: 14406)

3'-UAUUUUACUGUCUGUUCUUAAAGGAAC-5' (SEQ ID NO: 7476)

C5-4033 Target:
5'-ATAAAATGACAGACAAGAATTTCCTTG-3' (SEQ ID NO: 9786)

5'-UAAAAUGACAGACAAGAAUUUCCUUGG-3' (SEQ ID NO: 14407)

3'-AUUUUACUGUCUGUUCUUAAAGGAACC-5' (SEQ ID NO: 7477)

C5-4034 Target:
5'-TAAAATGACAGACAAGAATTTCCTTGG-3' (SEQ ID NO: 9787)

5'-AAAAUGACAGACAAGAAUUUCCUUGGG-3' (SEQ ID NO: 14408)

3'-UUUUACUGUCUGUUCUUAAAGGAACCC-5' (SEQ ID NO: 7478)

C5-4035 Target:
5'-AAAATGACAGACAAGAATTTCCTTGGG-3' (SEQ ID NO: 9788)

5'-AAAUGACAGACAAGAAUUUCCUUGGGA-3' (SEQ ID NO: 14409)

3'-UUUACUGUCUGUUCUUAAAGGAACCCU-5' (SEQ ID NO: 7479)

C5-4036 Target:
5'-AAATGACAGACAAGAATTTCCTTGGGA-3' (SEQ ID NO: 9789)

5'-AAUGACAGACAAGAAUUUCCUUGGGAG-3' (SEQ ID NO: 14410)

3'-UUACUGUCUGUUCUUAAAGGAACCCUC-5' (SEQ ID NO: 7480)

C5-4037 Target:
5'-AATGACAGACAAGAATTTCCTTGGGAG-3' (SEQ ID NO: 9790)

5'-AUGACAGACAAGAAUUUCCUUGGGAGG-3' (SEQ ID NO: 14411)

3'-UACUGUCUGUUCUUAAAGGAACCCUCC-5' (SEQ ID NO: 7481)

C5-4038 Target:
5'-ATGACAGACAAGAATTTCCTTGGGAGG-3' (SEQ ID NO: 9791)

5'-UGACAGACAAGAAUUUCCUUGGGAGGC-3' (SEQ ID NO: 14412)

3'-ACUGUCUGUUCUUAAAGGAACCCUCCG-5' (SEQ ID NO: 7482)

TABLE 9-continued

"Blunt/Blunt" DsiRNAs Corresponding to Human Anti-C5 DsiRNAs Predicted to have >50% Knockdown Efficacy C5-4039 Target:
5'-TGACAGACAAGAATTTCCTTGGGAGGC-3' (SEQ ID NO: 9792)

5'-GACAGACAAGAAUUUCCUUGGGAGGCC-3' (SEQ ID NO: 14413)

3'-CUGUCUGUUCUUAAAGGAACCCUCCGG-5' (SEQ ID NO: 7483)

C5-4040 Target:
5'-GACAGACAAGAATTTCCTTGGGAGGCC-3' (SEQ ID NO: 9793)

5'-ACAGACAAGAAUUUCCUUGGGAGGCCA-3' (SEQ ID NO: 14414)

3'-UGUCUGUUCUUAAAGGAACCCUCCGGU-5' (SEQ ID NO: 7484)

C5-4041 Target:
5'-ACAGACAAGAATTTCCTTGGGAGGCCA-3' (SEQ ID NO: 9794)

5'-CAGACAAGAAUUUCCUUGGGAGGCCAG-3' (SEQ ID NO: 14415)

3'-GUCUGUUCUUAAAGGAACCCUCCGGUC-5' (SEQ ID NO: 7485)

C5-4042 Target:
5'-CAGACAAGAATTTCCTTGGGAGGCCAG-3' (SEQ ID NO: 9795)

5'-AGACAAGAAUUUCCUUGGGAGGCCAGU-3' (SEQ ID NO: 14416)

3'-UCUGUUCUUAAAGGAACCCUCCGGUCA-5' (SEQ ID NO: 7486)

C5-4043 Target:
5'-AGACAAGAATTTCCTTGGGAGGCCAGT-3' (SEQ ID NO: 9796)

5'-GACAAGAAUUUCCUUGGGAGGCCAGUA-3' (SEQ ID NO: 14417)

3'-CUGUUCUUAAAGGAACCCUCCGGUCAU-5' (SEQ ID NO: 7487)

C5-4044 Target:
5'-GACAAGAATTTCCTTGGGAGGCCAGTA-3' (SEQ ID NO: 9797)

5'-ACAAGAAUUUCCUUGGGAGGCCAGUAG-3' (SEQ ID NO: 14418)

3'-UGUUCUUAAAGGAACCCUCCGGUCAUC-5' (SEQ ID NO: 7488)

C5-4045 Target:
5'-ACAAGAATTTCCTTGGGAGGCCAGTAG-3' (SEQ ID NO: 9798)

5'-CAAGAAUUUCCUUGGGAGGCCAGUAGA-3' (SEQ ID NO: 14419)

3'-GUUCUUAAAGGAACCCUCCGGUCAUCU-5' (SEQ ID NO: 7489)

C5-4046 Target:
5'-CAAGAATTTCCTTGGGAGGCCAGTAGA-3' (SEQ ID NO: 9799)

5'-AAGAAUUUCCUUGGGAGGCCAGUAGAG-3' (SEQ ID NO: 14420)

3'-UUCUUAAAGGAACCCUCCGGUCAUCUC-5' (SEQ ID NO: 7490)

C5-4047 Target:
5'-AAGAATTTCCTTGGGAGGCCAGTAGAG-3' (SEQ ID NO: 9800)

5'-UCCUUGGGAGGCCAGUAGAGGUGCUUC-3' (SEQ ID NO: 14421)

3'-AGGAACCCUCCGGUCAUCUCCACGAAG-5' (SEQ ID NO: 7491)

C5-4054 Target:
5'-TCCTTGGGAGGCCAGTAGAGGTGCTTC-3' (SEQ ID NO: 9801)

5'-UUGGGAGGCCAGUAGAGGUGCUUCUCA-3' (SEQ ID NO: 14422)

3'-AACCCUCCGGUCAUCUCCACGAAGAGU-5' (SEQ ID NO: 7492)

C5-4057 Target:
5'-TTGGGAGGCCAGTAGAGGTGCTTCTCA-3' (SEQ ID NO: 9802)

5'-UGGGAGGCCAGUAGAGGUGCUUCUCAA-3' (SEQ ID NO: 14423)

3'-ACCCUCCGGUCAUCUCCACGAAGAGUU-5' (SEQ ID NO: 7493)

C5-4058 Target:
5'-TGGGAGGCCAGTAGAGGTGCTTCTCAA-3' (SEQ ID NO: 9803)

5'-GGGAGGCCAGUAGAGGUGCUUCUCAAU-3' (SEQ ID NO: 14424)

3'-CCCUCCGGUCAUCUCCACGAAGAGUUA-5' (SEQ ID NO: 7494)

C5-4059 Target:
5'-GGGAGGCCAGTAGAGGTGCTTCTCAAT-3' (SEQ ID NO: 9804)

5'-GGAGGCCAGUAGAGGUGCUUCUCAAUG-3' (SEQ ID NO: 14425)

3'-CCUCCGGUCAUCUCCACGAAGAGUUAC-5' (SEQ ID NO: 7495)

C5-4060 Target:
5'-GGAGGCCAGTAGAGGTGCTTCTCAATG-3' (SEQ ID NO: 9805)

5'-GAGGCCAGUAGAGGUGCUUCUCAAUGA-3' (SEQ ID NO: 14426)

3'-CUCCGGUCAUCUCCACGAAGAGUUACU-5' (SEQ ID NO: 7496)

C5-4061 Target:
5'-GAGGCCAGTAGAGGTGCTTCTCAATGA-3' (SEQ ID NO: 9806)

5'-AGGCCAGUAGAGGUGCUUCUCAAUGAU-3' (SEQ ID NO: 14427)

3'-UCCGGUCAUCUCCACGAAGAGUUACUA-5' (SEQ ID NO: 7497)

C5-4062 Target:
5'-AGGCCAGTAGAGGTGCTTCTCAATGAT-3' (SEQ ID NO: 9807)

5'-GGCCAGUAGAGGUGCUUCUCAAUGAUG-3' (SEQ ID NO: 14428)

3'-CCGGUCAUCUCCACGAAGAGUUACUAC-5' (SEQ ID NO: 7498)

C5-4063 Target:
5'-GGCCAGTAGAGGTGCTTCTCAATGATG-3' (SEQ ID NO: 9808)

5'-GCCAGUAGAGGUGCUUCUCAAUGAUGA-3' (SEQ ID NO: 14429)

3'-CGGUCAUCUCCACGAAGAGUUACUACU-5' (SEQ ID NO: 7499)

C5-4064 Target:
5'-GCCAGTAGAGGTGCTTCTCAATGATGA-3' (SEQ ID NO: 9809)

5'-CCAGUAGAGGUGCUUCUCAAUGAUGAC-3' (SEQ ID NO: 14430)

3'-GGUCAUCUCCACGAAGAGUUACUACUG-5' (SEQ ID NO: 7500)

C5-4065 Target:
5'-CCAGTAGAGGTGCTTCTCAATGATGAC-3' (SEQ ID NO: 9810)

5'-CAGUAGAGGUGCUUCUCAAUGAUGACC-3' (SEQ ID NO: 14431)

3'-GUCAUCUCCACGAAGAGUUACUACUGG-5' (SEQ ID NO: 7501)

C5-4066 Target:
5'-CAGTAGAGGTGCTTCTCAATGATGACC-3' (SEQ ID NO: 9811)

5'-AGUAGAGGUGCUUCUCAAUGAUGACCU-3' (SEQ ID NO: 14432)

3'-UCAUCUCCACGAAGAGUUACUACUGGA-5' (SEQ ID NO: 7502)

TABLE 9-continued

"Blunt/Blunt" DsiRNAs Corresponding to Human Anti-C5 DsiRNAs Predicted to have >50% Knockdown Efficacy C5-4067 Target:
5'-AGTAGAGGTGCTTCTCAATGATGACCT-3' (SEQ ID NO: 9812)

5'-GUAGAGGUGCUUCUCAAUGAUGACCUC-3' (SEQ ID NO: 14433)

3'-CAUCUCCACGAAGAGUUACUACUGGAG-5' (SEQ ID NO: 7503)

C5-4068 Target:
5'-GTAGAGGTGCTTCTCAATGATGACCTC-3' (SEQ ID NO: 9813)

5'-UAGAGGUGCUUCUCAAUGAUGACCUCA-3' (SEQ ID NO: 14434)

3'-AUCUCCACGAAGAGUUACUACUGGAGU-5' (SEQ ID NO: 7504)

C5-4069 Target:
5'-TAGAGGTGCTTCTCAATGATGACCTCA-3' (SEQ ID NO: 9814)

5'-AGAGGUGCUUCUCAAUGAUGACCUCAU-3' (SEQ ID NO: 14435)

3'-UCUCCACGAAGAGUUACUACUGGAGUA-5' (SEQ ID NO: 7505)

C5-4070 Target:
5'-AGAGGTGCTTCTCAATGATGACCTCAT-3' (SEQ ID NO: 9815)

5'-GAGGUGCUUCUCAAUGAUGACCUCAUU-3' (SEQ ID NO: 14436)

3'-CUCCACGAAGAGUUACUACUGGAGUAA-5' (SEQ ID NO: 7506)

C5-4071 Target:
5'-GAGGTGCTTCTCAATGATGACCTCATT-3' (SEQ ID NO: 9816)

5'-AGGUGCUUCUCAAUGAUGACCUCAUUG-3' (SEQ ID NO: 14437)

3'-UCCACGAAGAGUUACUACUGGAGUAAC-5' (SEQ ID NO: 7507)

C5-4072 Target:
5'-AGGTGCTTCTCAATGATGACCTCATTG-3' (SEQ ID NO: 9817)

5'-GGUGCUUCUCAAUGAUGACCUCAUUGU-3' (SEQ ID NO: 14438)

3'-CCACGAAGAGUUACUACUGGAGUAACA-5' (SEQ ID NO: 7508)

C5-4073 Target:
5'-GGTGCTTCTCAATGATGACCTCATTGT-3' (SEQ ID NO: 9818)

5'-GUGCUUCUCAAUGAUGACCUCAUUGUC-3' (SEQ ID NO: 14439)

3'-CACGAAGAGUUACUACUGGAGUAACAG-5' (SEQ ID NO: 7509)

C5-4074 Target:
5'-GTGCTTCTCAATGATGACCTCATTGTC-3' (SEQ ID NO: 9819)

5'-CAUUGUCAGUACAGGAUUUGGCAGUGG-3' (SEQ ID NO: 14440)

3'-GUAACAGUCAUGUCCUAAACCGUCACC-5' (SEQ ID NO: 7510)

C5-4094 Target:
5'-CATTGTCAGTACAGGATTTGGCAGTGG-3' (SEQ ID NO: 9820)

5'-AUUGUCAGUACAGGAUUUGGCAGUGGC-3' (SEQ ID NO: 14441)

3'-UAACAGUCAUGUCCUAAACCGUCACCG-5' (SEQ ID NO: 7511)

C5-4095 Target:
5'-ATTGTCAGTACAGGATTTGGCAGTGGC-3' (SEQ ID NO: 9821)

5'-UUGUCAGUACAGGAUUUGGCAGUGGCU-3' (SEQ ID NO: 14442)

3'-AACAGUCAUGUCCUAAACCGUCACCGA-5' (SEQ ID NO: 7512)

C5-4096 Target:
5'-TTGTCAGTACAGGATTTGGCAGTGGCT-3' (SEQ ID NO: 9822)

5'-UGUCAGUACAGGAUUUGGCAGUGGCUU-3' (SEQ ID NO: 14443)

3'-ACAGUCAUGUCCUAAACCGUCACCGAA-5' (SEQ ID NO: 7513)

C5-4097 Target:
5'-TGTCAGTACAGGATTTGGCAGTGGCTT-3' (SEQ ID NO: 9823)

5'-GUCAGUACAGGAUUUGGCAGUGGCUUG-3' (SEQ ID NO: 14444)

3'-CAGUCAUGUCCUAAACCGUCACCGAAC-5' (SEQ ID NO: 7514)

C5-4098 Target:
5'-GTCAGTACAGGATTTGGCAGTGGCTTG-3' (SEQ ID NO: 9824)

5'-UCAGUACAGGAUUUGGCAGUGGCUUGG-3' (SEQ ID NO: 14445)

3'-AGUCAUGUCCUAAACCGUCACCGAACC-5' (SEQ ID NO: 7515)

C5-4099 Target:
5'-TCAGTACAGGATTTGGCAGTGGCTTGG-3' (SEQ ID NO: 9825)

5'-CAGUACAGGAUUUGGCAGUGGCUUGGC-3' (SEQ ID NO: 14446)

3'-GUCAUGUCCUAAACCGUCACCGAACCG-5' (SEQ ID NO: 7516)

C5-4100 Target:
5'-CAGTACAGGATTTGGCAGTGGCTTGGC-3' (SEQ ID NO: 9826)

5'-AGUACAGGAUUUGGCAGUGGCUUGGCU-3' (SEQ ID NO: 14447)

3'-UCAUGUCCUAAACCGUCACCGAACCGA-5' (SEQ ID NO: 7517)

C5-4101 Target:
5'-AGTACAGGATTTGGCAGTGGCTTGGCT-3' (SEQ ID NO: 9827)

5'-GUACAGGAUUUGGCAGUGGCUUGGCUA-3' (SEQ ID NO: 14448)

3'-CAUGUCCUAAACCGUCACCGAACCGAU-5' (SEQ ID NO: 7518)

C5-4102 Target:
5'-GTACAGGATTTGGCAGTGGCTTGGCTA-3' (SEQ ID NO: 9828)

5'-UACAGGAUUUGGCAGUGGCUUGGCUAC-3' (SEQ ID NO: 14449)

3'-AUGUCCUAAACCGUCACCGAACCGAUG-5' (SEQ ID NO: 7519)

C5-4103 Target:
5'-TACAGGATTTGGCAGTGGCTTGGCTAC-3' (SEQ ID NO: 9829)

5'-ACAGGAUUUGGCAGUGGCUUGGCUACA-3' (SEQ ID NO: 14450)

3'-UGUCCUAAACCGUCACCGAACCGAUGU-5' (SEQ ID NO: 7520)

C5-4104 Target:
5'-ACAGGATTTGGCAGTGGCTTGGCTACA-3' (SEQ ID NO: 9830)

5'-AGGAUUUGGCAGUGGCUUGGCUACAGU-3' (SEQ ID NO: 14451)

3'-UCCUAAACCGUCACCGAACCGAUGUCA-5' (SEQ ID NO: 7521)

C5-4106 Target:
5'-AGGATTTGGCAGTGGCTTGGCTACAGT-3' (SEQ ID NO: 9831)

5'-GGAUUUGGCAGUGGCUUGGCUACAGUA-3' (SEQ ID NO: 14452)

3'-CCUAAACCGUCACCGAACCGAUGUCAU-5' (SEQ ID NO: 7522)

TABLE 9-continued

"Blunt/Blunt" DsiRNAs Corresponding to Human Anti-C5 DsiRNAs Predicted to have >50% Knockdown Efficacy C5-4107 Target:
5'-GGATTTGGCAGTGGCTTGGCTACAGTA-3' (SEQ ID NO: 9832)

5'-GAUUUGGCAGUGGCUUGGCUACAGUAC-3' (SEQ ID NO: 14453)

3'-CUAAACCGUCACCGAACCGAUGUCAUG-5' (SEQ ID NO: 7523)

C5-4108 Target:
5'-GATTTGGCAGTGGCTTGGCTACAGTAC-3' (SEQ ID NO: 9833)

5'-AUUUGGCAGUGGCUUGGCUACAGUACA-3' (SEQ ID NO: 14454)

3'-UAAACCGUCACCGAACCGAUGUCAUGU-5' (SEQ ID NO: 7524)

C5-4109 Target:
5'-ATTTGGCAGTGGCTTGGCTACAGTACA-3' (SEQ ID NO: 9834)

5'-CAGUACAUGUAACAACUGUAGUUCACA-3' (SEQ ID NO: 14455)

3'-GUCAUGUACAUUGUUGACAUCAAGUGU-5' (SEQ ID NO: 7525)

C5-4129 Target:
5'-CAGTACATGTAACAACTGTAGTTCACA-3' (SEQ ID NO: 9835)

5'-AGUACAUGUAACAACUGUAGUUCACAA-3' (SEQ ID NO: 14456)

3'-UCAUGUACAUUGUUGACAUCAAGUGUU-5' (SEQ ID NO: 7526)

C5-4130 Target:
5'-AGTACATGTAACAACTGTAGTTCACAA-3' (SEQ ID NO: 9836)

5'-GUACAUGUAACAACUGUAGUUCACAAA-3' (SEQ ID NO: 14457)

3'-CAUGUACAUUGUUGACAUCAAGUGUUU-5' (SEQ ID NO: 7527)

C5-4131 Target:
5'-GTACATGTAACAACTGTAGTTCACAAA-3' (SEQ ID NO: 9837)

5'-ACAUGUAACAACUGUAGUUCACAAAAC-3' (SEQ ID NO: 14458)

3'-UGUACAUUGUUGACAUCAAGUGUUUUG-5' (SEQ ID NO: 7528)

C5-4133 Target:
5'-ACATGTAACAACTGTAGTTCACAAAAC-3' (SEQ ID NO: 9838)

5'-CAUGUAACAACUGUAGUUCACAAAACC-3' (SEQ ID NO: 14459)

3'-GUACAUUGUUGACAUCAAGUGUUUUGG-5' (SEQ ID NO: 7529)

C5-4134 Target:
5'-CATGTAACAACTGTAGTTCACAAAACC-3' (SEQ ID NO: 9839)

5'-AUGUAACAACUGUAGUUCACAAAACCA-3' (SEQ ID NO: 14460)

3'-UACAUUGUUGACAUCAAGUGUUUUGGU-5' (SEQ ID NO: 7530)

C5-4135 Target:
5'-ATGTAACAACTGTAGTTCACAAAACCA-3' (SEQ ID NO: 9840)

5'-UGUAACAACUGUAGUUCACAAAACCAG-3' (SEQ ID NO: 14461)

3'-ACAUUGUUGACAUCAAGUGUUUUGGUC-5' (SEQ ID NO: 7531)

C5-4136 Target:
5'-TGTAACAACTGTAGTTCACAAAACCAG-3' (SEQ ID NO: 9841)

5'-GUAACAACUGUAGUUCACAAAACCAGU-3' (SEQ ID NO: 14462)

3'-CAUUGUUGACAUCAAGUGUUUUGGUCA-5' (SEQ ID NO: 7532)

C5-4137 Target:
5'-GTAACAACTGTAGTTCACAAAACCAGT-3' (SEQ ID NO: 9842)

5'-UAACAACUGUAGUUCACAAAACCAGUA-3' (SEQ ID NO: 14463)

3'-AUUGUUGACAUCAAGUGUUUUGGUCAU-5' (SEQ ID NO: 7533)

C5-4138 Target:
5'-TAACAACTGTAGTTCACAAAACCAGTA-3' (SEQ ID NO: 9843)

5'-AACAACUGUAGUUCACAAAACCAGUAC-3' (SEQ ID NO: 14464)

3'-UUGUUGACAUCAAGUGUUUUGGUCAUG-5' (SEQ ID NO: 7534)

C5-4139 Target:
5'-AACAACTGTAGTTCACAAAACCAGTAC-3' (SEQ ID NO: 9844)

5'-ACAACUGUAGUUCACAAAACCAGUACC-3' (SEQ ID NO: 14465)

3'-UGUUGACAUCAAGUGUUUUGGUCAUGG-5' (SEQ ID NO: 7535)

C5-4140 Target:
5'-ACAACTGTAGTTCACAAAACCAGTACC-3' (SEQ ID NO: 9845)

5'-CAACUGUAGUUCACAAAACCAGUACCU-3' (SEQ ID NO: 14466)

3'-GUUGACAUCAAGUGUUUUGGUCAUGGA-5' (SEQ ID NO: 7536)

C5-4141 Target:
5'-CAACTGTAGTTCACAAAACCAGTACCT-3' (SEQ ID NO: 9846)

5'-AACUGUAGUUCACAAAACCAGUACCUC-3' (SEQ ID NO: 14467)

3'-UUGACAUCAAGUGUUUUGGUCAUGGAG-5' (SEQ ID NO: 7537)

C5-4142 Target:
5'-AACTGTAGTTCACAAAACCAGTACCTC-3' (SEQ ID NO: 9847)

5'-ACUGUAGUUCACAAAACCAGUACCUCU-3' (SEQ ID NO: 14468)

3'-UGACAUCAAGUGUUUUGGUCAUGGAGA-5' (SEQ ID NO: 7538)

C5-4143 Target:
5'-ACTGTAGTTCACAAAACCAGTACCTCT-3' (SEQ ID NO: 9848)

5'-CUGUAGUUCACAAAACCAGUACCUCUG-3' (SEQ ID NO: 14469)

3'-GACAUCAAGUGUUUUGGUCAUGGAGAC-5' (SEQ ID NO: 7539)

C5-4144 Target:
5'-CTGTAGTTCACAAAACCAGTACCTCTG-3' (SEQ ID NO: 9849)

5'-UGUAGUUCACAAAACCAGUACCUCUGA-3' (SEQ ID NO: 14470)

3'-ACAUCAAGUGUUUUGGUCAUGGAGACU-5' (SEQ ID NO: 7540)

C5-4145 Target:
5'-TGTAGTTCACAAAACCAGTACCTCTGA-3' (SEQ ID NO: 9850)

5'-GUAGUUCACAAAACCAGUACCUCUGAG-3' (SEQ ID NO: 14471)

3'-CAUCAAGUGUUUUGGUCAUGGAGACUC-5' (SEQ ID NO: 7541)

C5-4146 Target:
5'-GTAGTTCACAAAACCAGTACCTCTGAG-3' (SEQ ID NO: 9851)

5'-UAGUUCACAAAACCAGUACCUCUGAGG-3' (SEQ ID NO: 14472)

3'-AUCAAGUGUUUUGGUCAUGGAGACUCC-5' (SEQ ID NO: 7542)

TABLE 9-continued

"Blunt/Blunt" DsiRNAs Corresponding to Human Anti-C5 DsiRNAs Predicted to have >50% Knockdown Efficacy C5-4147 Target:
5'-TAGTTCACAAAACCAGTACCTCTGAGG-3' (SEQ ID NO: 9852)

5'-AGUUCACAAAACCAGUACCUCUGAGGA-3' (SEQ ID NO: 14473)

3'-UCAAGUGUUUUGGUCAUGGAGACUCCU-5' (SEQ ID NO: 7543)

C5-4148 Target:
5'-AGTTCACAAAACCAGTACCTCTGAGGA-3' (SEQ ID NO: 9853)

5'-GUUCACAAAACCAGUACCUCUGAGGAA-3' (SEQ ID NO: 14474)

3'-CAAGUGUUUUGGUCAUGGAGACUCCUU-5' (SEQ ID NO: 7544)

C5-4149 Target:
5'-GTTCACAAAACCAGTACCTCTGAGGAA-3' (SEQ ID NO: 9854)

5'-UUCACAAAACCAGUACCUCUGAGGAAG-3' (SEQ ID NO: 14475)

3'-AAGUGUUUUGGUCAUGGAGACUCCUUC-5' (SEQ ID NO: 7545)

C5-4150 Target:
5'-TTCACAAAACCAGTACCTCTGAGGAAG-3' (SEQ ID NO: 9855)

5'-UCACAAAACCAGUACCUCUGAGGAAGU-3' (SEQ ID NO: 14476)

3'-AGUGUUUUGGUCAUGGAGACUCCUUCA-5' (SEQ ID NO: 7546)

C5-4151 Target:
5'-TCACAAAACCAGTACCTCTGAGGAAGT-3' (SEQ ID NO: 9856)

5'-CACAAAACCAGUACCUCUGAGGAAGUU-3' (SEQ ID NO: 14477)

3'-GUGUUUUGGUCAUGGAGACUCCUUCAA-5' (SEQ ID NO: 7547)

C5-4152 Target:
5'-CACAAAACCAGTACCTCTGAGGAAGTT-3' (SEQ ID NO: 9857)

5'-ACAAAACCAGUACCUCUGAGGAAGUUU-3' (SEQ ID NO: 14478)

3'-UGUUUUGGUCAUGGAGACUCCUUCAAA-5' (SEQ ID NO: 7548)

C5-4153 Target:
5'-ACAAAACCAGTACCTCTGAGGAAGTTT-3' (SEQ ID NO: 9858)

5'-CAAAACCAGUACCUCUGAGGAAGUUUG-3' (SEQ ID NO: 14479)

3'-GUUUUGGUCAUGGAGACUCCUUCAAAC-5' (SEQ ID NO: 7549)

C5-4154 Target:
5'-CAAAACCAGTACCTCTGAGGAAGTTTG-3' (SEQ ID NO: 9859)

5'-AAAACCAGUACCUCUGAGGAAGUUUGC-3' (SEQ ID NO: 14480)

3'-UUUUGGUCAUGGAGACUCCUUCAAACG-5' (SEQ ID NO: 7550)

C5-4155 Target:
5'-AAAACCAGTACCTCTGAGGAAGTTTGC-3' (SEQ ID NO: 9860)

5'-AAACCAGUACCUCUGAGGAAGUUUGCA-3' (SEQ ID NO: 14481)

3'-UUUGGUCAUGGAGACUCCUUCAAACGU-5' (SEQ ID NO: 7551)

C5-4156 Target:
5'-AAACCAGTACCTCTGAGGAAGTTTGCA-3' (SEQ ID NO: 9861)

5'-AACCAGUACCUCUGAGGAAGUUUGCAG-3' (SEQ ID NO: 14482)

3'-UUGGUCAUGGAGACUCCUUCAAACGUC-5' (SEQ ID NO: 7552)

C5-4157 Target:
5'-AACCAGTACCTCTGAGGAAGTTTGCAG-3' (SEQ ID NO: 9862)

5'-ACCAGUACCUCUGAGGAAGUUUGCAGC-3' (SEQ ID NO: 14483)

3'-UGGUCAUGGAGACUCCUUCAAACGUCG-5' (SEQ ID NO: 7553)

C5-4158 Target:
5'-ACCAGTACCTCTGAGGAAGTTTGCAGC-3' (SEQ ID NO: 9863)

5'-CCAGUACCUCUGAGGAAGUUUGCAGCU-3' (SEQ ID NO: 14484)

3'-GGUCAUGGAGACUCCUUCAAACGUCGA-5' (SEQ ID NO: 7554)

C5-4159 Target:
5'-CCAGTACCTCTGAGGAAGTTTGCAGCT-3' (SEQ ID NO: 9864)

5'-CAGUACCUCUGAGGAAGUUUGCAGCUU-3' (SEQ ID NO: 14485)

3'-GUCAUGGAGACUCCUUCAAACGUCGAA-5' (SEQ ID NO: 7555)

C5-4160 Target:
5'-CAGTACCTCTGAGGAAGTTTGCAGCTT-3' (SEQ ID NO: 9865)

5'-AGUACCUCUGAGGAAGUUUGCAGCUUU-3' (SEQ ID NO: 14486)

3'-UCAUGGAGACUCCUUCAAACGUCGAAA-5' (SEQ ID NO: 7556)

C5-4161 Target:
5'-AGTACCTCTGAGGAAGTTTGCAGCTTT-3' (SEQ ID NO: 9866)

5'-GUACCUCUGAGGAAGUUUGCAGCUUUU-3' (SEQ ID NO: 14487)

3'-CAUGGAGACUCCUUCAAACGUCGAAAA-5' (SEQ ID NO: 7557)

C5-4162 Target:
5'-GTACCTCTGAGGAAGTTTGCAGCTTTT-3' (SEQ ID NO: 9867)

5'-UACCUCUGAGGAAGUUUGCAGCUUUUA-3' (SEQ ID NO: 14488)

3'-AUGGAGACUCCUUCAAACGUCGAAAAU-5' (SEQ ID NO: 7558)

C5-4163 Target:
5'-TACCTCTGAGGAAGTTTGCAGCTTTTA-3' (SEQ ID NO: 9868)

5'-ACCUCUGAGGAAGUUUGCAGCUUUUAU-3' (SEQ ID NO: 14489)

3'-UGGAGACUCCUUCAAACGUCGAAAAUA-5' (SEQ ID NO: 7559)

C5-4164 Target:
5'-ACCTCTGAGGAAGTTTGCAGCTTTTAT-3' (SEQ ID NO: 9869)

5'-CCUCUGAGGAAGUUUGCAGCUUUUAUU-3' (SEQ ID NO: 14490)

3'-GGAGACUCCUUCAAACGUCGAAAAUAA-5' (SEQ ID NO: 7560)

C5-4165 Target:
5'-CCTCTGAGGAAGTTTGCAGCTTTTATT-3' (SEQ ID NO: 9870)

5'-CUCUGAGGAAGUUUGCAGCUUUUAUUU-3' (SEQ ID NO: 14491)

3'-GAGACUCCUUCAAACGUCGAAAAUAAA-5' (SEQ ID NO: 7561)

C5-4166 Target:
5'-CTCTGAGGAAGTTTGCAGCTTTTATTT-3' (SEQ ID NO: 9871)

5'-UCUGAGGAAGUUUGCAGCUUUUAUUUG-3' (SEQ ID NO: 14492)

3'-AGACUCCUUCAAACGUCGAAAAUAAAC-5' (SEQ ID NO: 7562)

TABLE 9-continued

"Blunt/Blunt" DsiRNAs Corresponding to Human Anti-C5 DsiRNAs Predicted to have >50% Knockdown Efficacy C5-4167 Target:
5'-TCTGAGGAAGTTTGCAGCTTTTATTTG-3' (SEQ ID NO: 9872)

5'-GUUUGCAGCUUUUAUUUGAAAAUCGAU-3' (SEQ ID NO: 14493)

3'-CAAACGUCGAAAAUAAACUUUUAGCUA-5' (SEQ ID NO: 7563)

C5-4176 Target:
5'-GTTTGCAGCTTTTATTTGAAAATCGAT-3' (SEQ ID NO: 9873)

5'-UUUGCAGCUUUUAUUUGAAAAUCGAUA-3' (SEQ ID NO: 14494)

3'-AAACGUCGAAAAUAAACUUUUAGCUAU-5' (SEQ ID NO: 7564)

C5-4177 Target:
5'-TTTGCAGCTTTTATTTGAAAATCGATA-3' (SEQ ID NO: 9874)

5'-UCGAUACUCAGGAUAUUGAAGCAUCCC-3' (SEQ ID NO: 14495)

3'-AGCUAUGAGUCCUAUAACUUCGUAGGG-5' (SEQ ID NO: 7565)

C5-4198 Target:
5'-TCGATACTCAGGATATTGAAGCATCCC-3' (SEQ ID NO: 9875)

5'-GAUACUCAGGAUAUUGAAGCAUCCCAC-3' (SEQ ID NO: 14496)

3'-CUAUGAGUCCUAUAACUUCGUAGGGUG-5' (SEQ ID NO: 7566)

C5-4200 Target:
5'-GATACTCAGGATATTGAAGCATCCCAC-3' (SEQ ID NO: 9876)

5'-AUACUCAGGAUAUUGAAGCAUCCCACU-3' (SEQ ID NO: 14497)

3'-UAUGAGUCCUAUAACUUCGUAGGGUGA-5' (SEQ ID NO: 7567)

C5-4201 Target:
5'-ATACTCAGGATATTGAAGCATCCCACT-3' (SEQ ID NO: 9877)

5'-UACUCAGGAUAUUGAAGCAUCCCACUA-3' (SEQ ID NO: 14498)

3'-AUGAGUCCUAUAACUUCGUAGGGUGAU-5' (SEQ ID NO: 7568)

C5-4202 Target:
5'-TACTCAGGATATTGAAGCATCCCACTA-3' (SEQ ID NO: 9878)

5'-ACUCAGGAUAUUGAAGCAUCCCACUAC-3' (SEQ ID NO: 14499)

3'-UGAGUCCUAUAACUUCGUAGGGUGAUG-5' (SEQ ID NO: 7569)

C5-4203 Target:
5'-ACTCAGGATATTGAAGCATCCCACTAC-3' (SEQ ID NO: 9879)

5'-UCAGGAUAUUGAAGCAUCCCACUACAG-3' (SEQ ID NO: 14500)

3'-AGUCCUAUAACUUCGUAGGGUGAUGUC-5' (SEQ ID NO: 7570)

C5-4205 Target:
5'-TCAGGATATTGAAGCATCCCACTACAG-3' (SEQ ID NO: 9880)

5'-CAGGAUAUUGAAGCAUCCCACUACAGA-3' (SEQ ID NO: 14501)

3'-GUCCUAUAACUUCGUAGGGUGAUGUCU-5' (SEQ ID NO: 7571)

C5-4206 Target:
5'-CAGGATATTGAAGCATCCCACTACAGA-3' (SEQ ID NO: 9881)

5'-AGGAUAUUGAAGCAUCCCACUACAGAG-3' (SEQ ID NO: 14502)

3'-UCCUAUAACUUCGUAGGGUGAUGUCUC-5' (SEQ ID NO: 7572)

C5-4207 Target:
5'-AGGATATTGAAGCATCCCACTACAGAG-3' (SEQ ID NO: 9882)

5'-GGAUAUUGAAGCAUCCCACUACAGAGG-3' (SEQ ID NO: 14503)

3'-CCUAUAACUUCGUAGGGUGAUGUCUCC-5' (SEQ ID NO: 7573)

C5-4208 Target:
5'-GGATATTGAAGCATCCCACTACAGAGG-3' (SEQ ID NO: 9883)

5'-GAUAUUGAAGCAUCCCACUACAGAGGC-3' (SEQ ID NO: 14504)

3'-CUAUAACUUCGUAGGGUGAUGUCUCCG-5' (SEQ ID NO: 7574)

C5-4209 Target:
5'-GATATTGAAGCATCCCACTACAGAGGC-3' (SEQ ID NO: 9884)

5'-AUAUUGAAGCAUCCCACUACAGAGGCU-3' (SEQ ID NO: 14505)

3'-UAUAACUUCGUAGGGUGAUGUCUCCGA-5' (SEQ ID NO: 7575)

C5-4210 Target:
5'-ATATTGAAGCATCCCACTACAGAGGCT-3' (SEQ ID NO: 9885)

5'-UAUUGAAGCAUCCCACUACAGAGGCUA-3' (SEQ ID NO: 14506)

3'-AUAACUUCGUAGGGUGAUGUCUCCGAU-5' (SEQ ID NO: 7576)

C5-4211 Target:
5'-TATTGAAGCATCCCACTACAGAGGCTA-3' (SEQ ID NO: 9886)

5'-AUUGAAGCAUCCCACUACAGAGGCUAC-3' (SEQ ID NO: 14507)

3'-UAACUUCGUAGGGUGAUGUCUCCGAUG-5' (SEQ ID NO: 7577)

C5-4212 Target:
5'-ATTGAAGCATCCCACTACAGAGGCTAC-3' (SEQ ID NO: 9887)

5'-UUGAAGCAUCCCACUACAGAGGCUACG-3' (SEQ ID NO: 14508)

3'-AACUUCGUAGGGUGAUGUCUCCGAUGC-5' (SEQ ID NO: 7578)

C5-4213 Target:
5'-TTGAAGCATCCCACTACAGAGGCTACG-3' (SEQ ID NO: 9888)

5'-UGAAGCAUCCCACUACAGAGGCUACGG-3' (SEQ ID NO: 14509)

3'-ACUUCGUAGGGUGAUGUCUCCGAUGCC-5' (SEQ ID NO: 7579)

C5-4214 Target:
5'-TGAAGCATCCCACTACAGAGGCTACGG-3' (SEQ ID NO: 9889)

5'-GAAGCAUCCCACUACAGAGGCUACGGA-3' (SEQ ID NO: 14510)

3'-CUUCGUAGGGUGAUGUCUCCGAUGCCU-5' (SEQ ID NO: 7580)

C5-4215 Target:
5'-GAAGCATCCCACTACAGAGGCTACGGA-3' (SEQ ID NO: 9890)

5'-AAGCAUCCCACUACAGAGGCUACGGAA-3' (SEQ ID NO: 14511)

3'-UUCGUAGGGUGAUGUCUCCGAUGCCUU-5' (SEQ ID NO: 7581)

C5-4216 Target:
5'-AAGCATCCCACTACAGAGGCTACGGAA-3' (SEQ ID NO: 9891)

5'-AGCAUCCCACUACAGAGGCUACGGAAA-3' (SEQ ID NO: 14512)

3'-UCGUAGGGUGAUGUCUCCGAUGCCUUU-5' (SEQ ID NO: 7582)

TABLE 9-continued

"Blunt/Blunt" DsiRNAs Corresponding to Human Anti-C5
DsiRNAs Predicted to have >50% Knockdown Efficacy C5-4217 Target:
5'-AGCATCCCACTACAGAGGCTACGGAAA-3' (SEQ ID NO: 9892)

5'-GCAUCCCACUACAGAGGCUACGGAAAC-3' (SEQ ID NO: 14513)

3'-CGUAGGGUGAUGUCUCCGAUGCCUUUG-5' (SEQ ID NO: 7583)

C5-4218 Target:
5'-GCATCCCACTACAGAGGCTACGGAAAC-3' (SEQ ID NO: 9893)

5'-CAUCCCACUACAGAGGCUACGGAAACU-3' (SEQ ID NO: 14514)

3'-GUAGGGUGAUGUCUCCGAUGCCUUUGA-5' (SEQ ID NO: 7584)

C5-4219 Target:
5'-CATCCCACTACAGAGGCTACGGAAACT-3' (SEQ ID NO: 9894)

5'-AUCCCACUACAGAGGCUACGGAAACUC-3' (SEQ ID NO: 14515)

3'-UAGGGUGAUGUCUCCGAUGCCUUUGAG-5' (SEQ ID NO: 7585)

C5-4220 Target:
5'-ATCCCACTACAGAGGCTACGGAAACTC-3' (SEQ ID NO: 9895)

5'-UCCCACUACAGAGGCUACGGAAACUCU-3' (SEQ ID NO: 14516)

3'-AGGGUGAUGUCUCCGAUGCCUUUGAGA-5' (SEQ ID NO: 7586)

C5-4221 Target:
5'-TCCCACTACAGAGGCTACGGAAACTCT-3' (SEQ ID NO: 9896)

5'-CCCACUACAGAGGCUACGGAAACUCUG-3' (SEQ ID NO: 14517)

3'-GGGUGAUGUCUCCGAUGCCUUUGAGAC-5' (SEQ ID NO: 7587)

C5-4222 Target:
5'-CCCACTACAGAGGCTACGGAAACTCTG-3' (SEQ ID NO: 9897)

5'-CCACUACAGAGGCUACGGAAACUCUGA-3' (SEQ ID NO: 14518)

3'-GGUGAUGUCUCCGAUGCCUUUGAGACU-5' (SEQ ID NO: 7588)

C5-4223 Target:
5'-CCACTACAGAGGCTACGGAAACTCTGA-3' (SEQ ID NO: 9898)

5'-CACUACAGAGGCUACGGAAACUCUGAU-3' (SEQ ID NO: 14519)

3'-GUGAUGUCUCCGAUGCCUUUGAGACUA-5' (SEQ ID NO: 7589)

C5-4224 Target:
5'-CACTACAGAGGCTACGGAAACTCTGAT-3' (SEQ ID NO: 9899)

5'-ACUACAGAGGCUACGGAAACUCUGAUU-3' (SEQ ID NO: 14520)

3'-UGAUGUCUCCGAUGCCUUUGAGACUAA-5' (SEQ ID NO: 7590)

C5-4225 Target:
5'-ACTACAGAGGCTACGGAAACTCTGATT-3' (SEQ ID NO: 9900)

5'-CUACAGAGGCUACGGAAACUCUGAUUA-3' (SEQ ID NO: 14521)

3'-GAUGUCUCCGAUGCCUUUGAGACUAAU-5' (SEQ ID NO: 7591)

C5-4226 Target:
5'-CTACAGAGGCTACGGAAACTCTGATTA-3' (SEQ ID NO: 9901)

5'-UACAGAGGCUACGGAAACUCUGAUUAC-3' (SEQ ID NO: 14522)

3'-AUGUCUCCGAUGCCUUUGAGACUAAUG-5' (SEQ ID NO: 7592)

C5-4227 Target:
5'-TACAGAGGCTACGGAAACTCTGATTAC-3' (SEQ ID NO: 9902)

5'-ACAGAGGCUACGGAAACUCUGAUUACA-3' (SEQ ID NO: 14523)

3'-UGUCUCCGAUGCCUUUGAGACUAAUGU-5' (SEQ ID NO: 7593)

C5-4228 Target:
5'-ACAGAGGCTACGGAAACTCTGATTACA-3' (SEQ ID NO: 9903)

5'-CAGAGGCUACGGAAACUCUGAUUACAA-3' (SEQ ID NO: 14524)

3'-GUCUCCGAUGCCUUUGAGACUAAUGUU-5' (SEQ ID NO: 7594)

C5-4229 Target:
5'-CAGAGGCTACGGAAACTCTGATTACAA-3' (SEQ ID NO: 9904)

5'-AGAGGCUACGGAAACUCUGAUUACAAA-3' (SEQ ID NO: 14525)

3'-UCUCCGAUGCCUUUGAGACUAAUGUUU-5' (SEQ ID NO: 7595)

C5-4230 Target:
5'-AGAGGCTACGGAAACTCTGATTACAAA-3' (SEQ ID NO: 9905)

5'-GAGGCUACGGAAACUCUGAUUACAAAC-3' (SEQ ID NO: 14526)

3'-CUCCGAUGCCUUUGAGACUAAUGUUUG-5' (SEQ ID NO: 7596)

C5-4231 Target:
5'-GAGGCTACGGAAACTCTGATTACAAAC-3' (SEQ ID NO: 9906)

5'-AGGCUACGGAAACUCUGAUUACAAACG-3' (SEQ ID NO: 14527)

3'-UCCGAUGCCUUUGAGACUAAUGUUUGC-5' (SEQ ID NO: 7597)

C5-4232 Target:
5'-AGGCTACGGAAACTCTGATTACAAACG-3' (SEQ ID NO: 9907)

5'-GGCUACGGAAACUCUGAUUACAAACGC-3' (SEQ ID NO: 14528)

3'-CCGAUGCCUUUGAGACUAAUGUUUGCG-5' (SEQ ID NO: 7598)

C5-4233 Target:
5'-GGCTACGGAAACTCTGATTACAAACGC-3' (SEQ ID NO: 9908)

5'-GCUACGGAAACUCUGAUUACAAACGCA-3' (SEQ ID NO: 14529)

3'-CGAUGCCUUUGAGACUAAUGUUUGCGU-5' (SEQ ID NO: 7599)

C5-4234 Target:
5'-GCTACGGAAACTCTGATTACAAACGCA-3' (SEQ ID NO: 9909)

5'-CUACGGAAACUCUGAUUACAAACGCAU-3' (SEQ ID NO: 14530)

3'-GAUGCCUUUGAGACUAAUGUUUGCGUA-5' (SEQ ID NO: 7600)

C5-4235 Target:
5'-CTACGGAAACTCTGATTACAAACGCAT-3' (SEQ ID NO: 9910)

5'-UACGGAAACUCUGAUUACAAACGCAUA-3' (SEQ ID NO: 14531)

3'-AUGCCUUUGAGACUAAUGUUUGCGUAU-5' (SEQ ID NO: 7601)

C5-4236 Target:
5'-TACGGAAACTCTGATTACAAACGCATA-3' (SEQ ID NO: 9911)

5'-ACGGAAACUCUGAUUACAAACGCAUAG-3' (SEQ ID NO: 14532)

3'-UGCCUUUGAGACUAAUGUUUGCGUAUC-5' (SEQ ID NO: 7602)

TABLE 9-continued

"Blunt/Blunt" DsiRNAs Corresponding to Human Anti-C5 DsiRNAs Predicted to have >50% Knockdown Efficacy C5-4237 Target:
5'-ACGGAAACTCTGATTACAAACGCATAG-3' (SEQ ID NO: 9912)

5'-CGGAAACUCUGAUUACAAACGCAUAGU-3' (SEQ ID NO: 14533)

3'-GCCUUUGAGACUAAUGUUUGCGUAUCA-5' (SEQ ID NO: 7603)

C5-4238 Target:
5'-CGGAAACTCTGATTACAAACGCATAGT-3' (SEQ ID NO: 9913)

5'-GGAAACUCUGAUUACAAACGCAUAGUA-3' (SEQ ID NO: 14534)

3'-CCUUUGAGACUAAUGUUUGCGUAUCAU-5' (SEQ ID NO: 7604)

C5-4239 Target:
5'-GGAAACTCTGATTACAAACGCATAGTA-3' (SEQ ID NO: 9914)

5'-GAAACUCUGAUUACAAACGCAUAGUAG-3' (SEQ ID NO: 14535)

3'-CUUUGAGACUAAUGUUUGCGUAUCAUC-5' (SEQ ID NO: 7605)

C5-4240 Target:
5'-GAAACTCTGATTACAAACGCATAGTAG-3' (SEQ ID NO: 9915)

5'-AAACUCUGAUUACAAACGCAUAGUAGC-3' (SEQ ID NO: 14536)

3'-UUUGAGACUAAUGUUUGCGUAUCAUCG-5' (SEQ ID NO: 7606)

C5-4241 Target:
5'-AAACTCTGATTACAAACGCATAGTAGC-3' (SEQ ID NO: 9916)

5'-AACUCUGAUUACAAACGCAUAGUAGCA-3' (SEQ ID NO: 14537)

3'-UUGAGACUAAUGUUUGCGUAUCAUCGU-5' (SEQ ID NO: 7607)

C5-4242 Target:
5'-AACTCTGATTACAAACGCATAGTAGCA-3' (SEQ ID NO: 9917)

5'-ACUCUGAUUACAAACGCAUAGUAGCAU-3' (SEQ ID NO: 14538)

3'-UGAGACUAAUGUUUGCGUAUCAUCGUA-5' (SEQ ID NO: 7608)

C5-4243 Target:
5'-ACTCTGATTACAAACGCATAGTAGCAT-3' (SEQ ID NO: 9918)

5'-CUCUGAUUACAAACGCAUAGUAGCAUG-3' (SEQ ID NO: 14539)

3'-GAGACUAAUGUUUGCGUAUCAUCGUAC-5' (SEQ ID NO: 7609)

C5-4244 Target:
5'-CTCTGATTACAAACGCATAGTAGCATG-3' (SEQ ID NO: 9919)

5'-UCUGAUUACAAACGCAUAGUAGCAUGU-3' (SEQ ID NO: 14540)

3'-AGACUAAUGUUUGCGUAUCAUCGUACA-5' (SEQ ID NO: 7610)

C5-4245 Target:
5'-TCTGATTACAAACGCATAGTAGCATGT-3' (SEQ ID NO: 9920)

5'-CUGAUUACAAACGCAUAGUAGCAUGUG-3' (SEQ ID NO: 14541)

3'-GACUAAUGUUUGCGUAUCAUCGUACAC-5' (SEQ ID NO: 7611)

C5-4246 Target:
5'-CTGATTACAAACGCATAGTAGCATGTG-3' (SEQ ID NO: 9921)

5'-UGAUUACAAACGCAUAGUAGCAUGUGC-3' (SEQ ID NO: 14542)

3'-ACUAAUGUUUGCGUAUCAUCGUACACG-5' (SEQ ID NO: 7612)

C5-4247 Target:
5'-TGATTACAAACGCATAGTAGCATGTGC-3' (SEQ ID NO: 9922)

5'-GAUUACAAACGCAUAGUAGCAUGUGCC-3' (SEQ ID NO: 14543)

3'-CUAAUGUUUGCGUAUCAUCGUACACGG-5' (SEQ ID NO: 7613)

C5-4248 Target:
5'-GATTACAAACGCATAGTAGCATGTGCC-3' (SEQ ID NO: 9923)

5'-AUUACAAACGCAUAGUAGCAUGUGCCA-3' (SEQ ID NO: 14544)

3'-UAAUGUUUGCGUAUCAUCGUACACGGU-5' (SEQ ID NO: 7614)

C5-4249 Target:
5'-ATTACAAACGCATAGTAGCATGTGCCA-3' (SEQ ID NO: 9924)

5'-UUACAAACGCAUAGUAGCAUGUGCCAG-3' (SEQ ID NO: 14545)

3'-AAUGUUUGCGUAUCAUCGUACACGGUC-5' (SEQ ID NO: 7615)

C5-4250 Target:
5'-TTACAAACGCATAGTAGCATGTGCCAG-3' (SEQ ID NO: 9925)

5'-UACAAACGCAUAGUAGCAUGUGCCAGC-3' (SEQ ID NO: 14546)

3'-AUGUUUGCGUAUCAUCGUACACGGUCG-5' (SEQ ID NO: 7616)

C5-4251 Target:
5'-TACAAACGCATAGTAGCATGTGCCAGC-3' (SEQ ID NO: 9926)

5'-ACAAACGCAUAGUAGCAUGUGCCAGCU-3' (SEQ ID NO: 14547)

3'-UGUUUGCGUAUCAUCGUACACGGUCGA-5' (SEQ ID NO: 7617)

C5-4252 Target:
5'-ACAAACGCATAGTAGCATGTGCCAGCT-3' (SEQ ID NO: 9927)

5'-CAAACGCAUAGUAGCAUGUGCCAGCUA-3' (SEQ ID NO: 14548)

3'-GUUUGCGUAUCAUCGUACACGGUCGAU-5' (SEQ ID NO: 7618)

C5-4253 Target:
5'-CAAACGCATAGTAGCATGTGCCAGCTA-3' (SEQ ID NO: 9928)

5'-AAACGCAUAGUAGCAUGUGCCAGCUAC-3' (SEQ ID NO: 14549)

3'-UUUGCGUAUCAUCGUACACGGUCGAUG-5' (SEQ ID NO: 7619)

C5-4254 Target:
5'-AAACGCATAGTAGCATGTGCCAGCTAC-3' (SEQ ID NO: 9929)

5'-AACGCAUAGUAGCAUGUGCCAGCUACA-3' (SEQ ID NO: 14550)

3'-UUGCGUAUCAUCGUACACGGUCGAUGU-5' (SEQ ID NO: 7620)

C5-4255 Target:
5'-AACGCATAGTAGCATGTGCCAGCTACA-3' (SEQ ID NO: 9930)

5'-ACGCAUAGUAGCAUGUGCCAGCUACAA-3' (SEQ ID NO: 14551)

3'-UGCGUAUCAUCGUACACGGUCGAUGUU-5' (SEQ ID NO: 7621)

C5-4256 Target:
5'-ACGCATAGTAGCATGTGCCAGCTACAA-3' (SEQ ID NO: 9931)

5'-CGCAUAGUAGCAUGUGCCAGCUACAAG-3' (SEQ ID NO: 14552)

3'-GCGUAUCAUCGUACACGGUCGAUGUUC-5' (SEQ ID NO: 7622)

TABLE 9-continued

"Blunt/Blunt" DsiRNAs Corresponding to Human Anti-C5 DsiRNAs Predicted to have >50% Knockdown Efficacy C5-4257 Target:
5'-CGCATAGTAGCATGTGCCAGCTACAAG-3' (SEQ ID NO: 9932)

5'-GCAUAGUAGCAUGUGCCAGCUACAAGC-3' (SEQ ID NO: 14553)

3'-CGUAUCAUCGUACACGGUCGAUGUUCG-5' (SEQ ID NO: 7623)

C5-4258 Target:
5'-GCATAGTAGCATGTGCCAGCTACAAGC-3' (SEQ ID NO: 9933)

5'-CAUAGUAGCAUGUGCCAGCUACAAGCC-3' (SEQ ID NO: 14554)

3'-GUAUCAUCGUACACGGUCGAUGUUCGG-5' (SEQ ID NO: 7624)

C5-4259 Target:
5'-CATAGTAGCATGTGCCAGCTACAAGCC-3' (SEQ ID NO: 9934)

5'-AUAGUAGCAUGUGCCAGCUACAAGCCC-3' (SEQ ID NO: 14555)

3'-UAUCAUCGUACACGGUCGAUGUUCGGG-5' (SEQ ID NO: 7625)

C5-4260 Target:
5'-ATAGTAGCATGTGCCAGCTACAAGCCC-3' (SEQ ID NO: 9935)

5'-UAGUAGCAUGUGCCAGCUACAAGCCCA-3' (SEQ ID NO: 14556)

3'-AUCAUCGUACACGGUCGAUGUUCGGGU-5' (SEQ ID NO: 7626)

C5-4261 Target:
5'-TAGTAGCATGTGCCAGCTACAAGCCCA-3' (SEQ ID NO: 9936)

5'-CGGUGAUGGACAUCUCCUUGCCUACUG-3' (SEQ ID NO: 14557)

3'-GCCACUACCUGUAGAGGAACGGAUGAC-5' (SEQ ID NO: 7627)

C5-4321 Target:
5'-CGGTGATGGACATCTCCTTGCCTACTG-3' (SEQ ID NO: 9937)

5'-GGUGAUGGACAUCUCCUUGCCUACUGG-3' (SEQ ID NO: 14558)

3'-CCACUACCUGUAGAGGAACGGAUGACC-5' (SEQ ID NO: 7628)

C5-4322 Target:
5'-GGTGATGGACATCTCCTTGCCTACTGG-3' (SEQ ID NO: 9938)

5'-GUGAUGGACAUCUCCUUGCCUACUGGA-3' (SEQ ID NO: 14559)

3'-CACUACCUGUAGAGGAACGGAUGACCU-5' (SEQ ID NO: 7629)

C5-4323 Target:
5'-GTGATGGACATCTCCTTGCCTACTGGA-3' (SEQ ID NO: 9939)

5'-UGAUGGACAUCUCCUUGCCUACUGGAA-3' (SEQ ID NO: 14560)

3'-ACUACCUGUAGAGGAACGGAUGACCUU-5' (SEQ ID NO: 7630)

C5-4324 Target:
5'-TGATGGACATCTCCTTGCCTACTGGAA-3' (SEQ ID NO: 9940)

5'-GAUGGACAUCUCCUUGCCUACUGGAAU-3' (SEQ ID NO: 14561)

3'-CUACCUGUAGAGGAACGGAUGACCUUA-5' (SEQ ID NO: 7631)

C5-4325 Target:
5'-GATGGACATCTCCTTGCCTACTGGAAT-3' (SEQ ID NO: 9941)

5'-AUGGACAUCUCCUUGCCUACUGGAAUC-3' (SEQ ID NO: 14562)

3'-UACCUGUAGAGGAACGGAUGACCUUAG-5' (SEQ ID NO: 7632)

C5-4326 Target:
5'-ATGGACATCTCCTTGCCTACTGGAATC-3' (SEQ ID NO: 9942)

5'-UGGACAUCUCCUUGCCUACUGGAAUCA-3' (SEQ ID NO: 14563)

3'-ACCUGUAGAGGAACGGAUGACCUUAGU-5' (SEQ ID NO: 7633)

C5-4327 Target:
5'-TGGACATCTCCTTGCCTACTGGAATCA-3' (SEQ ID NO: 9943)

5'-GGACAUCUCCUUGCCUACUGGAAUCAG-3' (SEQ ID NO: 14564)

3'-CCUGUAGAGGAACGGAUGACCUUAGUC-5' (SEQ ID NO: 7634)

C5-4328 Target:
5'-GGACATCTCCTTGCCTACTGGAATCAG-3' (SEQ ID NO: 9944)

5'-GACAUCUCCUUGCCUACUGGAAUCAGU-3' (SEQ ID NO: 14565)

3'-CUGUAGAGGAACGGAUGACCUUAGUCA-5' (SEQ ID NO: 7635)

C5-4329 Target:
5'-GACATCTCCTTGCCTACTGGAATCAGT-3' (SEQ ID NO: 9945)

5'-ACAUCUCCUUGCCUACUGGAAUCAGUG-3' (SEQ ID NO: 14566)

3'-UGUAGAGGAACGGAUGACCUUAGUCAC-5' (SEQ ID NO: 7636)

C5-4330 Target:
5'-ACATCTCCTTGCCTACTGGAATCAGTG-3' (SEQ ID NO: 9946)

5'-CAUCUCCUUGCCUACUGGAAUCAGUGC-3' (SEQ ID NO: 14567)

3'-GUAGAGGAACGGAUGACCUUAGUCACG-5' (SEQ ID NO: 7637)

C5-4331 Target:
5'-CATCTCCTTGCCTACTGGAATCAGTGC-3' (SEQ ID NO: 9947)

5'-AUCUCCUUGCCUACUGGAAUCAGUGCA-3' (SEQ ID NO: 14568)

3'-UAGAGGAACGGAUGACCUUAGUCACGU-5' (SEQ ID NO: 7638)

C5-4332 Target:
5'-ATCTCCTTGCCTACTGGAATCAGTGCA-3' (SEQ ID NO: 9948)

5'-UCUCCUUGCCUACUGGAAUCAGUGCAA-3' (SEQ ID NO: 14569)

3'-AGAGGAACGGAUGACCUUAGUCACGUU-5' (SEQ ID NO: 7639)

C5-4333 Target:
5'-TCTCCTTGCCTACTGGAATCAGTGCAA-3' (SEQ ID NO: 9949)

5'-AGUGCAAAUGAAGAAGACUUAAAAGCC-3' (SEQ ID NO: 14570)

3'-UCACGUUUACUUCUUCUGAAUUUUCGG-5' (SEQ ID NO: 7640)

C5-4353 Target:
5'-AGTGCAAATGAAGAAGACTTAAAAGCC-3' (SEQ ID NO: 9950)

5'-GUGCAAAUGAAGAAGACUUAAAAGCCC-3' (SEQ ID NO: 14571)

3'-CACGUUUACUUCUUCUGAAUUUUCGGG-5' (SEQ ID NO: 7641)

C5-4354 Target:
5'-GTGCAAATGAAGAAGACTTAAAAGCCC-3' (SEQ ID NO: 9951)

5'-UGCAAAUGAAGAAGACUUAAAAGCCCU-3' (SEQ ID NO: 14572)

3'-ACGUUUACUUCUUCUGAAUUUUCGGGA-5' (SEQ ID NO: 7642)

TABLE 9-continued

"Blunt/Blunt" DsiRNAs Corresponding to Human Anti-C5 DsiRNAs Predicted to have >50% Knockdown Efficacy C5-4355 Target:
5'-TGCAAATGAAGAAGACTTAAAAGCCCT-3' (SEQ ID NO: 9952)

5'-GCAAAUGAAGAAGACUUAAAAGCCCUU-3' (SEQ ID NO: 14573)

3'-CGUUUACUUCUUCUGAAUUUUCGGGAA-5' (SEQ ID NO: 7643)

C5-4356 Target:
5'-GCAAATGAAGAAGACTTAAAAGCCCTT-3' (SEQ ID NO: 9953)

5'-CAAAUGAAGAAGACUUAAAAGCCCUUG-3' (SEQ ID NO: 14574)

3'-GUUUACUUCUUCUGAAUUUUCGGGAAC-5' (SEQ ID NO: 7644)

C5-4357 Target:
5'-CAAATGAAGAAGACTTAAAAGCCCTTG-3' (SEQ ID NO: 9954)

5'-AAAUGAAGAAGACUUAAAAGCCCUUGU-3' (SEQ ID NO: 14575)

3'-UUUACUUCUUCUGAAUUUUCGGGAACA-5' (SEQ ID NO: 7645)

C5-4358 Target:
5'-AAATGAAGAAGACTTAAAAGCCCTTGT-3' (SEQ ID NO: 9955)

5'-CCCUUGUGGAAGGGGUGGAUCAACUAU-3' (SEQ ID NO: 14576)

3'-GGGAACACCUUCCCCACCUAGUUGAUA-5' (SEQ ID NO: 7646)

C5-4378 Target:
5'-CCCTTGTGGAAGGGTGGATCAACTAT-3' (SEQ ID NO: 9956)

5'-CCUUGUGGAAGGGUGGAUCAACUAUU-3' (SEQ ID NO: 14577)

3'-GGAACACCUUCCCCACCUAGUUGAUAA-5' (SEQ ID NO: 7647)

C5-4379 Target:
5'-CCTTGTGGAAGGGTGGATCAACTATT-3' (SEQ ID NO: 9957)

5'-AACUAUUCACUGAUUACCAAAUCAAAG-3' (SEQ ID NO: 14578)

3'-UUGAUAAGUGACUAAUGGUUUAGUUUC-5' (SEQ ID NO: 7648)

C5-4399 Target:
5'-AACTATTCACTGATTACCAAATCAAAG-3' (SEQ ID NO: 9958)

5'-ACUAUUCACUGAUUACCAAAUCAAAGA-3' (SEQ ID NO: 14579)

3'-UGAUAAGUGACUAAUGGUUUAGUUUCU-5' (SEQ ID NO: 7649)

C5-4400 Target:
5'-ACTATTCACTGATTACCAAATCAAAGA-3' (SEQ ID NO: 9959)

5'-UCAAAGAUGGACAUGUUAUUCUGCAAC-3' (SEQ ID NO: 14580)

3'-AGUUUCUACCUGUACAAUAAGACGUUG-5' (SEQ ID NO: 7650)

C5-4420 Target:
5'-TCAAAGATGGACATGTTATTCTGCAAC-3' (SEQ ID NO: 9960)

5'-CAAAGAUGGACAUGUUAUUCUGCAACU-3' (SEQ ID NO: 14581)

3'-GUUUCUACCUGUACAAUAAGACGUUGA-5' (SEQ ID NO: 7651)

C5-4421 Target:
5'-CAAAGATGGACATGTTATTCTGCAACT-3' (SEQ ID NO: 9961)

5'-AAAGAUGGACAUGUUAUUCUGCAACUG-3' (SEQ ID NO: 14582)

3'-UUUCUACCUGUACAAUAAGACGUUGAC-5' (SEQ ID NO: 7652)

C5-4422 Target:
5'-AAAGATGGACATGTTATTCTGCAACTG-3' (SEQ ID NO: 9962)

5'-GAUGGACAUGUUAUUCUGCAACUGAAU-3' (SEQ ID NO: 14583)

3'-CUACCUGUACAAUAAGACGUUGACUUA-5' (SEQ ID NO: 7653)

C5-4425 Target:
5'-GATGGACATGTTATTCTGCAACTGAAT-3' (SEQ ID NO: 9963)

5'-UGGACAUGUUAUUCUGCAACUGAAUUC-3' (SEQ ID NO: 14584)

3'-ACCUGUACAAUAAGACGUUGACUUAAG-5' (SEQ ID NO: 7654)

C5-4427 Target:
5'-TGGACATGTTATTCTGCAACTGAATTC-3' (SEQ ID NO: 9964)

5'-CAUGUUAUUCUGCAACUGAAUUCGAUU-3' (SEQ ID NO: 14585)

3'-GUACAAUAAGACGUUGACUUAAGCUAA-5' (SEQ ID NO: 7655)

C5-4431 Target:
5'-CATGTTATTCTGCAACTGAATTCGATT-3' (SEQ ID NO: 9965)

5'-AUGUUAUUCUGCAACUGAAUUCGAUUC-3' (SEQ ID NO: 14586)

3'-UACAAUAAGACGUUGACUUAAGCUAAG-5' (SEQ ID NO: 7656)

C5-4432 Target:
5'-ATGTTATTCTGCAACTGAATTCGATTC-3' (SEQ ID NO: 9966)

5'-UGUUAUUCUGCAACUGAAUUCGAUUCC-3' (SEQ ID NO: 14587)

3'-ACAAUAAGACGUUGACUUAAGCUAAGG-5' (SEQ ID NO: 7657)

C5-4433 Target:
5'-TGTTATTCTGCAACTGAATTCGATTCC-3' (SEQ ID NO: 9967)

5'-GUUAUUCUGCAACUGAAUUCGAUUCCC-3' (SEQ ID NO: 14588)

3'-CAAUAAGACGUUGACUUAAGCUAAGGG-5' (SEQ ID NO: 7658)

C5-4434 Target:
5'-GTTATTCTGCAACTGAATTCGATTCCC-3' (SEQ ID NO: 9968)

5'-UAUUUGAACUCUUUGAAGUUGGGUUUC-3' (SEQ ID NO: 14589)

3'-AUAAACUUGAGAAACUUCAACCCAAAG-5' (SEQ ID NO: 7659)

C5-4492 Target:
5'-TATTTGAACTCTTTGAAGTTGGGTTTC-3' (SEQ ID NO: 9969)

5'-AUUUGAACUCUUUGAAGUUGGGUUUCU-3' (SEQ ID NO: 14590)

3'-UAAACUUGAGAAACUUCAACCCAAAGA-5' (SEQ ID NO: 7660)

C5-4493 Target:
5'-ATTTGAACTCTTTGAAGTTGGGTTTCT-3' (SEQ ID NO: 9970)

5'-UUUGAACUCUUUGAAGUUGGGUUUCUC-3' (SEQ ID NO: 14591)

3'-AAACUUGAGAAACUUCAACCCAAAGAG-5' (SEQ ID NO: 7661)

C5-4494 Target:
5'-TTTGAACTCTTTGAAGTTGGGTTTCTC-3' (SEQ ID NO: 9971)

5'-UUGAACUCUUUGAAGUUGGGUUUCUCA-3' (SEQ ID NO: 14592)

3'-AACUUGAGAAACUUCAACCCAAAGAGU-5' (SEQ ID NO: 7662)

TABLE 9-continued

"Blunt/Blunt" DsiRNAs Corresponding to Human Anti-C5 DsiRNAs Predicted to have >50% Knockdown Efficacy C5-4495 Target:
5'-TTGAACTCTTTGAAGTTGGGTTTCTCA-3' (SEQ ID NO: 9972)

5'-UGAACUCUUUGAAGUUGGGUUUCUCAG-3' (SEQ ID NO: 14593)

3'-ACUUGAGAAACUUCAACCCAAAGAGUC-5' (SEQ ID NO: 7663)

C5-4496 Target:
5'-TGAACTCTTTGAAGTTGGGTTTCTCAG-3' (SEQ ID NO: 9973)

5'-GAACUCUUUGAAGUUGGGUUUCUCAGU-3' (SEQ ID NO: 14594)

3'-CUUGAGAAACUUCAACCCAAAGAGUCA-5' (SEQ ID NO: 7664)

C5-4497 Target:
5'-GAACTCTTTGAAGTTGGGTTTCTCAGT-3' (SEQ ID NO: 9974)

5'-AACUCUUUGAAGUUGGGUUUCUCAGUC-3' (SEQ ID NO: 14595)

3'-UUGAGAAACUUCAACCCAAAGAGUCAG-5' (SEQ ID NO: 7665)

C5-4498 Target:
5'-AACTCTTTGAAGTTGGGTTTCTCAGTC-3' (SEQ ID NO: 9975)

5'-ACUCUUUGAAGUUGGGUUUCUCAGUCC-3' (SEQ ID NO: 14596)

3'-UGAGAAACUUCAACCCAAAGAGUCAGG-5' (SEQ ID NO: 7666)

C5-4499 Target:
5'-ACTCTTTGAAGTTGGGTTTCTCAGTCC-3' (SEQ ID NO: 9976)

5'-UCAGUCCUGCCACUUUCACAGUGUACG-3' (SEQ ID NO: 14597)

3'-AGUCAGGACGGUGAAAGUGUCACAUGC-5' (SEQ ID NO: 7667)

C5-4519 Target:
5'-TCAGTCCTGCCACTTTCACAGTGTACG-3' (SEQ ID NO: 9977)

5'-CAGUCCUGCCACUUUCACAGUGUACGA-3' (SEQ ID NO: 14598)

3'-GUCAGGACGGUGAAAGUGUCACAUGCU-5' (SEQ ID NO: 7668)

C5-4520 Target:
5'-CAGTCCTGCCACTTTCACAGTGTACGA-3' (SEQ ID NO: 9978)

5'-AGUCCUGCCACUUUCACAGUGUACGAA-3' (SEQ ID NO: 14599)

3'-UCAGGACGGUGAAAGUGUCACAUGCUU-5' (SEQ ID NO: 7669)

C5-4521 Target:
5'-AGTCCTGCCACTTTCACAGTGTACGAA-3' (SEQ ID NO: 9979)

5'-GUCCUGCCACUUUCACAGUGUACGAAU-3' (SEQ ID NO: 14600)

3'-CAGGACGGUGAAAGUGUCACAUGCUUA-5' (SEQ ID NO: 7670)

C5-4522 Target:
5'-GTCCTGCCACTTTCACAGTGTACGAAT-3' (SEQ ID NO: 9980)

5'-UCCUGCCACUUUCACAGUGUACGAAUA-3' (SEQ ID NO: 14601)

3'-AGGACGGUGAAAGUGUCACAUGCUUAU-5' (SEQ ID NO: 7671)

C5-4523 Target:
5'-TCCTGCCACTTTCACAGTGTACGAATA-3' (SEQ ID NO: 9981)

5'-ACGAAUACCACAGACCAGAUAAACAGU-3' (SEQ ID NO: 14602)

3'-UGCUUAUGGUGUCUGGUCUAUUUGUCA-5' (SEQ ID NO: 7672)

TABLE 9-continued

"Blunt/Blunt" DsiRNAs Corresponding to Human Anti-C5 DsiRNAs Predicted to have >50% Knockdown Efficacy C5-4543 Target:
5'-ACGAATACCACAGACCAGATAAACAGT-3' (SEQ ID NO: 9982)

5'-CGAAUACCACAGACCAGAUAAACAGUG-3' (SEQ ID NO: 14603)

3'-GCUUAUGGUGUCUGGUCUAUUUGUCAC-5' (SEQ ID NO: 7673)

C5-4544 Target:
5'-CGAATACCACAGACCAGATAAACAGTG-3' (SEQ ID NO: 9983)

5'-GAAUACCACAGACCAGAUAAACAGUGU-3' (SEQ ID NO: 14604)

3'-CUUAUGGUGUCUGGUCUAUUUGUCACA-5' (SEQ ID NO: 7674)

C5-4545 Target:
5'-GAATACCACAGACCAGATAAACAGTGT-3' (SEQ ID NO: 9984)

5'-AAUACCACAGACCAGAUAAACAGUGUA-3' (SEQ ID NO: 14605)

3'-UUAUGGUGUCUGGUCUAUUUGUCACAU-5' (SEQ ID NO: 7675)

C5-4546 Target:
5'-AATACCACAGACCAGATAAACAGTGTA-3' (SEQ ID NO: 9985)

5'-AUACCACAGACCAGAUAAACAGUGUAC-3' (SEQ ID NO: 14606)

3'-UAUGGUGUCUGGUCUAUUUGUCACAUG-5' (SEQ ID NO: 7676)

C5-4547 Target:
5'-ATACCACAGACCAGATAAACAGTGTAC-3' (SEQ ID NO: 9986)

5'-UACCACAGACCAGAUAAACAGUGUACC-3' (SEQ ID NO: 14607)

3'-AUGGUGUCUGGUCUAUUUGUCACAUGG-5' (SEQ ID NO: 7677)

C5-4548 Target:
5'-TACCACAGACCAGATAAACAGTGTACC-3' (SEQ ID NO: 9987)

5'-ACCACAGACCAGAUAAACAGUGUACCA-3' (SEQ ID NO: 14608)

3'-UGGUGUCUGGUCUAUUUGUCACAUGGU-5' (SEQ ID NO: 7678)

C5-4549 Target:
5'-ACCACAGACCAGATAAACAGTGTACCA-3' (SEQ ID NO: 9988)

5'-CCACAGACCAGAUAAACAGUGUACCAU-3' (SEQ ID NO: 14609)

3'-GGUGUCUGGUCUAUUUGUCACAUGGUA-5' (SEQ ID NO: 7679)

C5-4550 Target:
5'-CCACAGACCAGATAAACAGTGTACCAT-3' (SEQ ID NO: 9989)

5'-CACAGACCAGAUAAACAGUGUACCAUG-3' (SEQ ID NO: 14610)

3'-GUGUCUGGUCUAUUUGUCACAUGGUAC-5' (SEQ ID NO: 7680)

C5-4551 Target:
5'-CACAGACCAGATAAACAGTGTACCATG-3' (SEQ ID NO: 9990)

5'-ACAGACCAGAUAAACAGUGUACCAUGU-3' (SEQ ID NO: 14611)

3'-UGUCUGGUCUAUUUGUCACAUGGUACA-5' (SEQ ID NO: 7681)

C5-4552 Target:
5'-ACAGACCAGATAAACAGTGTACCATGT-3' (SEQ ID NO: 9991)

5'-CAGACCAGAUAAACAGUGUACCAUGUU-3' (SEQ ID NO: 14612)

3'-GUCUGGUCUAUUUGUCACAUGGUACAA-5' (SEQ ID NO: 7682)

TABLE 9-continued

"Blunt/Blunt" DsiRNAs Corresponding to Human Anti-C5 DsiRNAs Predicted to have >50% Knockdown Efficacy C5-4553 Target:
5'-CAGACCAGATAAACAGTGTACCATGTT-3' (SEQ ID NO: 9992)

5'-AGACCAGAUAAACAGUGUACCAUGUUU-3' (SEQ ID NO: 14613)

3'-UCUGGUCUAUUUGUCACAUGGUACAAA-5' (SEQ ID NO: 7683)

C5-4554 Target:
5'-AGACCAGATAAACAGTGTACCATGTTT-3' (SEQ ID NO: 9993)

5'-GACCAGAUAAACAGUGUACCAUGUUUU-3' (SEQ ID NO: 14614)

3'-CUGGUCUAUUUGUCACAUGGUACAAAA-5' (SEQ ID NO: 7684)

C5-4555 Target:
5'-GACCAGATAAACAGTGTACCATGTTTT-3' (SEQ ID NO: 9994)

5'-ACCAGAUAAACAGUGUACCAUGUUUUA-3' (SEQ ID NO: 14615)

3'-UGGUCUAUUUGUCACAUGGUACAAAAU-5' (SEQ ID NO: 7685)

C5-4556 Target:
5'-ACCAGATAAACAGTGTACCATGTTTTA-3' (SEQ ID NO: 9995)

5'-CCAGAUAAACAGUGUACCAUGUUUUAU-3' (SEQ ID NO: 14616)

3'-GGUCUAUUUGUCACAUGGUACAAAAUA-5' (SEQ ID NO: 7686)

C5-4557 Target:
5'-CCAGATAAACAGTGTACCATGTTTTAT-3' (SEQ ID NO: 9996)

5'-GAUAAACAGUGUACCAUGUUUUAUAGC-3' (SEQ ID NO: 14617)

3'-CUAUUUGUCACAUGGUACAAAAUAUCG-5' (SEQ ID NO: 7687)

C5-4560 Target:
5'-GATAAACAGTGTACCATGTTTTATAGC-3' (SEQ ID NO: 9997)

5'-UAAACAGUGUACCAUGUUUUAUAGCAC-3' (SEQ ID NO: 14618)

3'-AUUUGUCACAUGGUACAAAAUAUCGUG-5' (SEQ ID NO: 7688)

C5-4562 Target:
5'-TAAACAGTGTACCATGTTTTATAGCAC-3' (SEQ ID NO: 9998)

5'-AACAGUGUACCAUGUUUUAUAGCACUU-3' (SEQ ID NO: 14619)

3'-UUGUCACAUGGUACAAAAUAUCGUGAA-5' (SEQ ID NO: 7689)

C5-4564 Target:
5'-AACAGTGTACCATGTTTTATAGCACTT-3' (SEQ ID NO: 9999)

5'-ACAGUGUACCAUGUUUUAUAGCACUUC-3' (SEQ ID NO: 14620)

3'-UGUCACAUGGUACAAAAUAUCGUGAAG-5' (SEQ ID NO: 7690)

C5-4565 Target:
5'-ACAGTGTACCATGTTTTATAGCACTTC-3' (SEQ ID NO: 10000)

5'-CAGUGUACCAUGUUUUAUAGCACUUCC-3' (SEQ ID NO: 14621)

3'-GUCACAUGGUACAAAAUAUCGUGAAGG-5' (SEQ ID NO: 7691)

C5-4566 Target:
5'-CAGTGTACCATGTTTTATAGCACTTCC-3' (SEQ ID NO: 10001)

5'-AGUGUACCAUGUUUUAUAGCACUUCCA-3' (SEQ ID NO: 14622)

3'-UCACAUGGUACAAAAUAUCGUGAAGGU-5' (SEQ ID NO: 7692)

C5-4567 Target:
5'-AGTGTACCATGTTTTATAGCACTTCCA-3' (SEQ ID NO: 10002)

5'-GUGUACCAUGUUUUAUAGCACUUCCAA-3' (SEQ ID NO: 14623)

3'-CACAUGGUACAAAAUAUCGUGAAGGUU-5' (SEQ ID NO: 7693)

C5-4568 Target:
5'-GTGTACCATGTTTTATAGCACTTCCAA-3' (SEQ ID NO: 10003)

5'-UGUACCAUGUUUUAUAGCACUUCCAAU-3' (SEQ ID NO: 14624)

3'-ACAUGGUACAAAAUAUCGUGAAGGUUA-5' (SEQ ID NO: 7694)

C5-4569 Target:
5'-TGTACCATGTTTTATAGCACTTCCAAT-3' (SEQ ID NO: 10004)

5'-GUACCAUGUUUUAUAGCACUUCCAAUA-3' (SEQ ID NO: 14625)

3'-CAUGGUACAAAAUAUCGUGAAGGUUAU-5' (SEQ ID NO: 7695)

C5-4570 Target:
5'-GTACCATGTTTTATAGCACTTCCAATA-3' (SEQ ID NO: 10005)

5'-UACCAUGUUUUAUAGCACUUCCAAUAU-3' (SEQ ID NO: 14626)

3'-AUGGUACAAAAUAUCGUGAAGGUUAUA-5' (SEQ ID NO: 7696)

C5-4571 Target:
5'-TACCATGTTTTATAGCACTTCCAATAT-3' (SEQ ID NO: 10006)

5'-ACCAUGUUUUAUAGCACUUCCAAUAUC-3' (SEQ ID NO: 14627)

3'-UGGUACAAAAUAUCGUGAAGGUUAUAG-5' (SEQ ID NO: 7697)

C5-4572 Target:
5'-ACCATGTTTTATAGCACTTCCAATATC-3' (SEQ ID NO: 10007)

5'-CCAUGUUUUAUAGCACUUCCAAUAUCA-3' (SEQ ID NO: 14628)

3'-GGUACAAAAUAUCGUGAAGGUUAUAGU-5' (SEQ ID NO: 7698)

C5-4573 Target:
5'-CCATGTTTTATAGCACTTCCAATATCA-3' (SEQ ID NO: 10008)

5'-CAUGUUUUAUAGCACUUCCAAUAUCAA-3' (SEQ ID NO: 14629)

3'-GUACAAAAUAUCGUGAAGGUUAUAGUU-5' (SEQ ID NO: 7699)

C5-4574 Target:
5'-CATGTTTTATAGCACTTCCAATATCAA-3' (SEQ ID NO: 10009)

5'-AUGUUUUAUAGCACUUCCAAUAUCAAA-3' (SEQ ID NO: 14630)

3'-UACAAAAUAUCGUGAAGGUUAUAGUUU-5' (SEQ ID NO: 7700)

C5-4575 Target:
5'-ATGTTTTATAGCACTTCCAATATCAAA-3' (SEQ ID NO: 10010)

5'-UGUUUUAUAGCACUUCCAAUAUCAAAA-3' (SEQ ID NO: 14631)

3'-ACAAAAUAUCGUGAAGGUUAUAGUUUU-5' (SEQ ID NO: 7701)

C5-4576 Target:
5'-TGTTTTATAGCACTTCCAATATCAAAT-3' (SEQ ID NO: 10011)

5'-GUUUUAUAGCACUUCCAAUAUCAAAAU-3' (SEQ ID NO: 14632)

3'-CAAAAUAUCGUGAAGGUUAUAGUUUUA-5' (SEQ ID NO: 7702)

TABLE 9-continued

"Blunt/Blunt" DsiRNAs Corresponding to Human Anti-C5 DsiRNAs Predicted to have >50% Knockdown Efficacy C5-4577 Target:
5'-GTTTTATAGCACTTCCAATATCAAAAT-3' (SEQ ID NO: 10012)

5'-UUUUAUAGCACUUCCAAUAUCAAAAUU-3' (SEQ ID NO: 14633)

3'-AAAAUAUCGUGAAGGUUAUAGUUUUAA-5' (SEQ ID NO: 7703)

C5-4578 Target:
5'-TTTTATAGCACTTCCAATATCAAAATT-3' (SEQ ID NO: 10013)

5'-UUUAUAGCACUUCCAAUAUCAAAAUUC-3' (SEQ ID NO: 14634)

3'-AAAUAUCGUGAAGGUUAUAGUUUUAAG-5' (SEQ ID NO: 7704)

C5-4579 Target:
5'-TTTATAGCACTTCCAATATCAAAATTC-3' (SEQ ID NO: 10014)

5'-UAUAGCACUUCCAAUAUCAAAAUUCAG-3' (SEQ ID NO: 14635)

3'-AUAUCGUGAAGGUUAUAGUUUUAAGUC-5' (SEQ ID NO: 7705)

C5-4581 Target:
5'-TATAGCACTTCCAATATCAAAATTCAG-3' (SEQ ID NO: 10015)

5'-AUAGCACUUCCAAUAUCAAAAUUCAGA-3' (SEQ ID NO: 14636)

3'-UAUCGUGAAGGUUAUAGUUUUAAGUCU-5' (SEQ ID NO: 7706)

C5-4582 Target:
5'-ATAGCACTTCCAATATCAAAATTCAGA-3' (SEQ ID NO: 10016)

5'-UAGCACUUCCAAUAUCAAAAUUCAGAA-3' (SEQ ID NO: 14637)

3'-AUCGUGAAGGUUAUAGUUUUAAGUCUU-5' (SEQ ID NO: 7707)

C5-4583 Target:
5'-TAGCACTTCCAATATCAAAATTCAGAA-3' (SEQ ID NO: 10017)

5'-AGCACUUCCAAUAUCAAAAUUCAGAAA-3' (SEQ ID NO: 14638)

3'-UCGUGAAGGUUAUAGUUUUAAGUCUUU-5' (SEQ ID NO: 7708)

C5-4584 Target:
5'-AGCACTTCCAATATCAAAATTCAGAAA-3' (SEQ ID NO: 10018)

5'-GCACUUCCAAUAUCAAAAUUCAGAAAG-3' (SEQ ID NO: 14639)

3'-CGUGAAGGUUAUAGUUUUAAGUCUUUC-5' (SEQ ID NO: 7709)

C5-4585 Target:
5'-GCACTTCCAATATCAAAATTCAGAAAG-3' (SEQ ID NO: 10019)

5'-CACUUCCAAUAUCAAAAUUCAGAAAGU-3' (SEQ ID NO: 14640)

3'-GUGAAGGUUAUAGUUUUAAGUCUUUCA-5' (SEQ ID NO: 7710)

C5-4586 Target:
5'-CACTTCCAATATCAAAATTCAGAAAGT-3' (SEQ ID NO: 10020)

5'-ACUUCCAAUAUCAAAAUUCAGAAAGUC-3' (SEQ ID NO: 14641)

3'-UGAAGGUUAUAGUUUUAAGUCUUUCAG-5' (SEQ ID NO: 7711)

C5-4587 Target:
5'-ACTTCCAATATCAAAATTCAGAAAGTC-3' (SEQ ID NO: 10021)

5'-CUUCCAAUAUCAAAAUUCAGAAAGUCU-3' (SEQ ID NO: 14642)

3'-GAAGGUUAUAGUUUUAAGUCUUUCAGA-5' (SEQ ID NO: 7712)

C5-4588 Target:
5'-CTTCCAATATCAAAATTCAGAAAGTCT-3' (SEQ ID NO: 10022)

5'-UUCCAAUAUCAAAAUUCAGAAAGUCUG-3' (SEQ ID NO: 14643)

3'-AAGGUUAUAGUUUUAAGUCUUUCAGAC-5' (SEQ ID NO: 7713)

C5-4589 Target:
5'-TTCCAATATCAAAATTCAGAAAGTCTG-3' (SEQ ID NO: 10023)

5'-UCCAAUAUCAAAAUUCAGAAAGUCUGU-3' (SEQ ID NO: 14644)

3'-AGGUUAUAGUUUUAAGUCUUUCAGACA-5' (SEQ ID NO: 7714)

C5-4590 Target:
5'-TCCAATATCAAAATTCAGAAAGTCTGT-3' (SEQ ID NO: 10024)

5'-CCAAUAUCAAAAUUCAGAAAGUCUGUG-3' (SEQ ID NO: 14645)

3'-GGUUAUAGUUUUAAGUCUUUCAGACAC-5' (SEQ ID NO: 7715)

C5-4591 Target:
5'-CCAATATCAAAATTCAGAAAGTCTGTG-3' (SEQ ID NO: 10025)

5'-CAAUAUCAAAAUUCAGAAAGUCUGUGA-3' (SEQ ID NO: 14646)

3'-GUUAUAGUUUUAAGUCUUUCAGACACU-5' (SEQ ID NO: 7716)

C5-4592 Target:
5'-CAATATCAAAATTCAGAAAGTCTGTGA-3' (SEQ ID NO: 10026)

5'-AAUAUCAAAAUUCAGAAAGUCUGUGAA-3' (SEQ ID NO: 14647)

3'-UUAUAGUUUUAAGUCUUUCAGACACUU-5' (SEQ ID NO: 7717)

C5-4593 Target:
5'-AATATCAAAATTCAGAAAGTCTGTGAA-3' (SEQ ID NO: 10027)

5'-AUAUCAAAAUUCAGAAAGUCUGUGAAG-3' (SEQ ID NO: 14648)

3'-UAUAGUUUUAAGUCUUUCAGACACUUC-5' (SEQ ID NO: 7718)

C5-4594 Target:
5'-ATATCAAAATTCAGAAAGTCTGTGAAG-3' (SEQ ID NO: 10028)

5'-UAUCAAAAUUCAGAAAGUCUGUGAAGG-3' (SEQ ID NO: 14649)

3'-AUAGUUUUAAGUCUUUCAGACACUUCC-5' (SEQ ID NO: 7719)

C5-4595 Target:
5'-TATCAAAATTCAGAAAGTCTGTGAAGG-3' (SEQ ID NO: 10029)

5'-AUCAAAAUUCAGAAAGUCUGUGAAGGA-3' (SEQ ID NO: 14650)

3'-UAGUUUUAAGUCUUUCAGACACUUCCU-5' (SEQ ID NO: 7720)

C5-4596 Target:
5'-ATCAAAATTCAGAAAGTCTGTGAAGGA-3' (SEQ ID NO: 10030)

5'-UCAAAAUUCAGAAAGUCUGUGAAGGAG-3' (SEQ ID NO: 14651)

3'-AGUUUUAAGUCUUUCAGACACUUCCUC-5' (SEQ ID NO: 7721)

C5-4597 Target:
5'-TCAAAATTCAGAAAGTCTGTGAAGGAG-3' (SEQ ID NO: 10031)

5'-CAAAAUUCAGAAAGUCUGUGAAGGAGC-3' (SEQ ID NO: 14652)

3'-GUUUUAAGUCUUUCAGACACUUCCUCG-5' (SEQ ID NO: 7722)

TABLE 9-continued

"Blunt/Blunt" DsiRNAs Corresponding to Human Anti-C5 DsiRNAs Predicted to have >50% Knockdown Efficacy C5-4598 Target:
5'-CAAAATTCAGAAAGTCTGTGAAGGAGC-3' (SEQ ID NO: 10032)

5'-AAAAUUCAGAAAGUCUGUGAAGGAGCC-3' (SEQ ID NO: 14653)

3'-UUUUAAGUCUUUCAGACACUUCCUCGG-5' (SEQ ID NO: 7723)

C5-4599 Target:
5'-AAAATTCAGAAAGTCTGTGAAGGAGCC-3' (SEQ ID NO: 10033)

5'-AAAUUCAGAAAGUCUGUGAAGGAGCCG-3' (SEQ ID NO: 14654)

3'-UUUAAGUCUUUCAGACACUUCCUCGGC-5' (SEQ ID NO: 7724)

C5-4600 Target:
5'-AAATTCAGAAAGTCTGTGAAGGAGCCG-3' (SEQ ID NO: 10034)

5'-CAGAAAGUCUGUGAAGGAGCCGCGUGC-3' (SEQ ID NO: 14655)

3'-GUCUUUCAGACACUUCCUCGGCGCACG-5' (SEQ ID NO: 7725)

C5-4605 Target:
5'-CAGAAAGTCTGTGAAGGAGCCGCGTGC-3' (SEQ ID NO: 10035)

5'-UGUAGAAGCUGAUUGUGGGCAAAUGCA-3' (SEQ ID NO: 14656)

3'-ACAUCUUCGACUAACACCCGUUUACGU-5' (SEQ ID NO: 7726)

C5-4637 Target:
5'-TGTAGAAGCTGATTGTGGGCAAATGCA-3' (SEQ ID NO: 10036)

5'-GUAGAAGCUGAUUGUGGGCAAAUGCAG-3' (SEQ ID NO: 14657)

3'-CAUCUUCGACUAACACCCGUUUACGUC-5' (SEQ ID NO: 7727)

C5-4638 Target:
5'-GTAGAAGCTGATTGTGGGCAAATGCAG-3' (SEQ ID NO: 10037)

5'-UAGAAGCUGAUUGUGGGCAAAUGCAGG-3' (SEQ ID NO: 14658)

3'-AUCUUCGACUAACACCCGUUUACGUCC-5' (SEQ ID NO: 7728)

C5-4639 Target:
5'-TAGAAGCTGATTGTGGGCAAATGCAGG-3' (SEQ ID NO: 10038)

5'-AGAAGCUGAUUGUGGGCAAAUGCAGGA-3' (SEQ ID NO: 14659)

3'-UCUUCGACUAACACCCGUUUACGUCCU-5' (SEQ ID NO: 7729)

C5-4640 Target:
5'-AGAAGCTGATTGTGGGCAAATGCAGGA-3' (SEQ ID NO: 10039)

5'-GAAGCUGAUUGUGGGCAAAUGCAGGAA-3' (SEQ ID NO: 14660)

3'-CUUCGACUAACACCCGUUUACGUCCUU-5' (SEQ ID NO: 7730)

C5-4641 Target:
5'-GAAGCTGATTGTGGGCAAATGCAGGAA-3' (SEQ ID NO: 10040)

5'-AAGCUGAUUGUGGGCAAAUGCAGGAAG-3' (SEQ ID NO: 14661)

3'-UUCGACUAACACCCGUUUACGUCCUUC-5' (SEQ ID NO: 7731)

C5-4642 Target:
5'-AAGCTGATTGTGGGCAAATGCAGGAAG-3' (SEQ ID NO: 10041)

5'-AGCUGAUUGUGGGCAAAUGCAGGAAGA-3' (SEQ ID NO: 14662)

3'-UCGACUAACACCCGUUUACGUCCUUCU-5' (SEQ ID NO: 7732)

C5-4643 Target:
5'-AGCTGATTGTGGGCAAATGCAGGAAGA-3' (SEQ ID NO: 10042)

5'-GCUGAUUGUGGGCAAAUGCAGGAAGAA-3' (SEQ ID NO: 14663)

3'-CGACUAACACCCGUUUACGUCCUUCUU-5' (SEQ ID NO: 7733)

C5-4644 Target:
5'-GCTGATTGTGGGCAAATGCAGGAAGAA-3' (SEQ ID NO: 10043)

5'-GGAAGAAUUGGAUCUGACAAUCUCUGC-3' (SEQ ID NO: 14664)

3'-CCUUCUUAACCUAGACUGUUAGAGACG-5' (SEQ ID NO: 7734)

C5-4664 Target:
5'-GGAAGAATTGGATCTGACAATCTCTGC-3' (SEQ ID NO: 10044)

5'-GAAGAAUUGGAUCUGACAAUCUCUGCA-3' (SEQ ID NO: 14665)

3'-CUUCUUAACCUAGACUGUUAGAGACGU-5' (SEQ ID NO: 7735)

C5-4665 Target:
5'-GAAGAATTGGATCTGACAATCTCTGCA-3' (SEQ ID NO: 10045)

5'-AAGAAUUGGAUCUGACAAUCUCUGCAG-3' (SEQ ID NO: 14666)

3'-UUCUUAACCUAGACUGUUAGAGACGUC-5' (SEQ ID NO: 7736)

C5-4666 Target:
5'-AAGAATTGGATCTGACAATCTCTGCAG-3' (SEQ ID NO: 10046)

5'-AGAAUUGGAUCUGACAAUCUCUGCAGA-3' (SEQ ID NO: 14667)

3'-UCUUAACCUAGACUGUUAGAGACGUCU-5' (SEQ ID NO: 7737)

C5-4667 Target:
5'-AGAATTGGATCTGACAATCTCTGCAGA-3' (SEQ ID NO: 10047)

5'-GAAUUGGAUCUGACAAUCUCUGCAGAG-3' (SEQ ID NO: 14668)

3'-CUUAACCUAGACUGUUAGAGACGUCUC-5' (SEQ ID NO: 7738)

C5-4668 Target:
5'-GAATTGGATCTGACAATCTCTGCAGAG-3' (SEQ ID NO: 10048)

5'-AAUUGGAUCUGACAAUCUCUGCAGAGA-3' (SEQ ID NO: 14669)

3'-UUAACCUAGACUGUUAGAGACGUCUCU-5' (SEQ ID NO: 7739)

C5-4669 Target:
5'-AATTGGATCTGACAATCTCTGCAGAGA-3' (SEQ ID NO: 10049)

5'-AUUGGAUCUGACAAUCUCUGCAGAGAC-3' (SEQ ID NO: 14670)

3'-UAACCUAGACUGUUAGAGACGUCUCUG-5' (SEQ ID NO: 7740)

C5-4670 Target:
5'-ATTGGATCTGACAATCTCTGCAGAGAC-3' (SEQ ID NO: 10050)

5'-UUGGAUCUGACAAUCUCUGCAGAGACA-3' (SEQ ID NO: 14671)

3'-AACCUAGACUGUUAGAGACGUCUCUGU-5' (SEQ ID NO: 7741)

C5-4671 Target:
5'-TTGGATCTGACAATCTCTGCAGAGACA-3' (SEQ ID NO: 10051)

5'-UGGAUCUGACAAUCUCUGCAGAGACAA-3' (SEQ ID NO: 14672)

3'-ACCUAGACUGUUAGAGACGUCUCUGUU-5' (SEQ ID NO: 7742)

TABLE 9-continued

"Blunt/Blunt" DsiRNAs Corresponding to Human Anti-C5 DsiRNAs Predicted to have >50% Knockdown Efficacy C5-4672 Target:
5'-TGGATCTGACAATCTCTGCAGAGACAA-3' (SEQ ID NO: 10052)

5'-GGAUCUGACAAUCUCUGCAGAGACAAG-3' (SEQ ID NO: 14673)

3'-CCUAGACUGUUAGAGACGUCUCUGUUC-5' (SEQ ID NO: 7743)

C5-4673 Target:
5'-GGATCTGACAATCTCTGCAGAGACAAG-3' (SEQ ID NO: 10053)

5'-GAUCUGACAAUCUCUGCAGAGACAAGA-3' (SEQ ID NO: 14674)

3'-CUAGACUGUUAGAGACGUCUCUGUUCU-5' (SEQ ID NO: 7744)

C5-4674 Target:
5'-GATCTGACAATCTCTGCAGAGACAAGA-3' (SEQ ID NO: 10054)

5'-AUCUGACAAUCUCUGCAGAGACAAGAA-3' (SEQ ID NO: 14675)

3'-UAGACUGUUAGAGACGUCUCUGUUCUU-5' (SEQ ID NO: 7745)

C5-4675 Target:
5'-ATCTGACAATCTCTGCAGAGACAAGAA-3' (SEQ ID NO: 10055)

5'-UCUGACAAUCUCUGCAGAGACAAGAAA-3' (SEQ ID NO: 14676)

3'-AGACUGUUAGAGACGUCUCUGUUCUUU-5' (SEQ ID NO: 7746)

C5-4676 Target:
5'-TCTGACAATCTCTGCAGAGACAAGAAA-3' (SEQ ID NO: 10056)

5'-CAAGAAAACAAACAGCAUGUAAACCAG-3' (SEQ ID NO: 14677)

3'-GUUCUUUUGUUUGUCGUACAUUUGGUC-5' (SEQ ID NO: 7747)

C5-4696 Target:
5'-CAAGAAAACAAACAGCATGTAAACCAG-3' (SEQ ID NO: 10057)

5'-AAGAAAACAAACAGCAUGUAAACCAGA-3' (SEQ ID NO: 14678)

3'-UUCUUUUGUUUGUCGUACAUUUGGUCU-5' (SEQ ID NO: 7748)

C5-4697 Target:
5'-AAGAAAACAAACAGCATGTAAACCAGA-3' (SEQ ID NO: 10058)

5'-GAGAUUGCAUAUGCUUAUAAAGUUAGC-3' (SEQ ID NO: 14679)

3'-CUCUAACGUAUACGAAUAUUUCAAUCG-5' (SEQ ID NO: 7749)

C5-4722 Target:
5'-GAGATTGCATATGCTTATAAAGTTAGC-3' (SEQ ID NO: 10059)

5'-AGAUUGCAUAUGCUUAUAAAGUUAGCA-3' (SEQ ID NO: 14680)

3'-UCUAACGUAUACGAAUAUUUCAAUCGU-5' (SEQ ID NO: 7750)

C5-4723 Target:
5'-AGATTGCATATGCTTATAAAGTTAGCA-3' (SEQ ID NO: 10060)

5'-GAUUGCAUAUGCUUAUAAAGUUAGCAU-3' (SEQ ID NO: 14681)

3'-CUAACGUAUACGAAUAUUUCAAUCGUA-5' (SEQ ID NO: 7751)

C5-4724 Target:
5'-GATTGCATATGCTTATAAAGTTAGCAT-3' (SEQ ID NO: 10061)

5'-AUUGCAUAUGCUUAUAAAGUUAGCAUC-3' (SEQ ID NO: 14682)

3'-UAACGUAUACGAAUAUUUCAAUCGUAG-5' (SEQ ID NO: 7752)

C5-4725 Target:
5'-ATTGCATATGCTTATAAAGTTAGCATC-3' (SEQ ID NO: 10062)

5'-UUGCAUAUGCUUAUAAAGUUAGCAUCA-3' (SEQ ID NO: 14683)

3'-AACGUAUACGAAUAUUUCAAUCGUAGU-5' (SEQ ID NO: 7753)

C5-4726 Target:
5'-TTGCATATGCTTATAAAGTTAGCATCA-3' (SEQ ID NO: 10063)

5'-AAAUGUUUUGUCAAGUACAAGGCAAC-3' (SEQ ID NO: 14684)

3'-UUUACAAAACAGUUCAUGUUCCGUUG-5' (SEQ ID NO: 7754)

C5-4769 Target:
5'-AAATGTTTTGTCAAGTACAAGGCAAC-3' (SEQ ID NO: 10064)

5'-AAUGUUUUGUCAAGUACAAGGCAACC-3' (SEQ ID NO: 14685)

3'-UUACAAAACAGUUCAUGUUCCGUUGG-5' (SEQ ID NO: 7755)

C5-4770 Target:
5'-AATGTTTTGTCAAGTACAAGGCAACC-3' (SEQ ID NO: 10065)

5'-AUGUUUUGUCAAGUACAAGGCAACCC-3' (SEQ ID NO: 14686)

3'-UACAAAACAGUUCAUGUUCCGUUGGG-5' (SEQ ID NO: 7756)

C5-4771 Target:
5'-ATGTTTTGTCAAGTACAAGGCAACCC-3' (SEQ ID NO: 10066)

5'-UGUUUUGUCAAGUACAAGGCAACCCU-3' (SEQ ID NO: 14687)

3'-ACAAAACAGUUCAUGUUCCGUUGGGA-5' (SEQ ID NO: 7757)

C5-4772 Target:
5'-TGTTTTGTCAAGTACAAGGCAACCCT-3' (SEQ ID NO: 10067)

5'-GUUUUGUCAAGUACAAGGCAACCCUU-3' (SEQ ID NO: 14688)

3'-CAAAACAGUUCAUGUUCCGUUGGGAA-5' (SEQ ID NO: 7758)

C5-4773 Target:
5'-GTTTTGTCAAGTACAAGGCAACCCTT-3' (SEQ ID NO: 10068)

5'-UUUUGUCAAGUACAAGGCAACCCUUC-3' (SEQ ID NO: 14689)

3'-AAAACAGUUCAUGUUCCGUUGGGAAG-5' (SEQ ID NO: 7759)

C5-4774 Target:
5'-TTTTGTCAAGTACAAGGCAACCCTTC-3' (SEQ ID NO: 10069)

5'-UUUUGUCAAGUACAAGGCAACCCUUCU-3' (SEQ ID NO: 14690)

3'-AAAACAGUUCAUGUUCCGUUGGGAAGA-5' (SEQ ID NO: 7760)

C5-4775 Target:
5'-TTTTGTCAAGTACAAGGCAACCCTTCT-3' (SEQ ID NO: 10070)

5'-UUUGUCAAGUACAAGGCAACCCUUCUG-3' (SEQ ID NO: 14691)

3'-AAACAGUUCAUGUUCCGUUGGGAAGAC-5' (SEQ ID NO: 7761)

C5-4776 Target:
5'-TTTGTCAAGTACAAGGCAACCCTTCTG-3' (SEQ ID NO: 10071)

5'-UUGUCAAGUACAAGGCAACCCUUCUGG-3' (SEQ ID NO: 14692)

3'-AACAGUUCAUGUUCCGUUGGGAAGACC-5' (SEQ ID NO: 7762)

TABLE 9-continued

"Blunt/Blunt" DsiRNAs Corresponding to Human Anti-C5 DsiRNAs Predicted to have >50% Knockdown Efficacy C5-4777 Target:
5'-TTGTCAAGTACAAGGCAACCCTTCTGG-3' (SEQ ID NO: 10072)

5'-UGUCAAGUACAAGGCAACCCUUCUGGA-3' (SEQ ID NO: 14693)

3'-ACAGUUCAUGUUCCGUUGGGAAGACCU-5' (SEQ ID NO: 7763)

C5-4778 Target:
5'-TGTCAAGTACAAGGCAACCCTTCTGGA-3' (SEQ ID NO: 10073)

5'-GUCAAGUACAAGGCAACCCUUCUGGAU-3' (SEQ ID NO: 14694)

3'-CAGUUCAUGUUCCGUUGGGAAGACCUA-5' (SEQ ID NO: 7764)

C5-4779 Target:
5'-GTCAAGTACAAGGCAACCCTTCTGGAT-3' (SEQ ID NO: 10074)

5'-UCAAGUACAAGGCAACCCUUCUGGAUA-3' (SEQ ID NO: 14695)

3'-AGUUCAUGUUCCGUUGGGAAGACCUAU-5' (SEQ ID NO: 7765)

C5-4780 Target:
5'-TCAAGTACAAGGCAACCCTTCTGGATA-3' (SEQ ID NO: 10075)

5'-CAAGUACAAGGCAACCCUUCUGGAUAU-3' (SEQ ID NO: 14696)

3'-GUUCAUGUUCCGUUGGGAAGACCUAUA-5' (SEQ ID NO: 7766)

C5-4781 Target:
5'-CAAGTACAAGGCAACCCTTCTGGATAT-3' (SEQ ID NO: 10076)

5'-AAGUACAAGGCAACCCUUCUGGAUAUC-3' (SEQ ID NO: 14697)

3'-UUCAUGUUCCGUUGGGAAGACCUAUAG-5' (SEQ ID NO: 7767)

C5-4782 Target:
5'-AAGTACAAGGCAACCCTTCTGGATATC-3' (SEQ ID NO: 10077)

5'-AGUACAAGGCAACCCUUCUGGAUAUCU-3' (SEQ ID NO: 14698)

3'-UCAUGUUCCGUUGGGAAGACCUAUAGA-5' (SEQ ID NO: 7768)

C5-4783 Target:
5'-AGTACAAGGCAACCCTTCTGGATATCT-3' (SEQ ID NO: 10078)

5'-GUACAAGGCAACCCUUCUGGAUAUCUA-3' (SEQ ID NO: 14699)

3'-CAUGUUCCGUUGGGAAGACCUAUAGAU-5' (SEQ ID NO: 7769)

C5-4784 Target:
5'-GTACAAGGCAACCCTTCTGGATATCTA-3' (SEQ ID NO: 10079)

5'-UACAAGGCAACCCUUCUGGAUAUCUAC-3' (SEQ ID NO: 14700)

3'-AUGUUCCGUUGGGAAGACCUAUAGAUG-5' (SEQ ID NO: 7770)

C5-4785 Target:
5'-TACAAGGCAACCCTTCTGGATATCTAC-3' (SEQ ID NO: 10080)

5'-ACAAGGCAACCCUUCUGGAUAUCUACA-3' (SEQ ID NO: 14701)

3'-UGUUCCGUUGGGAAGACCUAUAGAUGU-5' (SEQ ID NO: 7771)

C5-4786 Target:
5'-ACAAGGCAACCCTTCTGGATATCTACA-3' (SEQ ID NO: 10081)

5'-CAAGGCAACCCUUCUGGAUAUCUACAA-3' (SEQ ID NO: 14702)

3'-GUUCCGUUGGGAAGACCUAUAGAUGUU-5' (SEQ ID NO: 7772)

C5-4787 Target:
5'-CAAGGCAACCCTTCTGGATATCTACAA-3' (SEQ ID NO: 10082)

5'-AAGGCAACCCUUCUGGAUAUCUACAAA-3' (SEQ ID NO: 14703)

3'-UUCCGUUGGGAAGACCUAUAGAUGUUU-5' (SEQ ID NO: 7773)

C5-4788 Target:
5'-AAGGCAACCCTTCTGGATATCTACAAA-3' (SEQ ID NO: 10083)

5'-AGGCAACCCUUCUGGAUAUCUACAAAA-3' (SEQ ID NO: 14704)

3'-UCCGUUGGGAAGACCUAUAGAUGUUUU-5' (SEQ ID NO: 7774)

C5-4789 Target:
5'-AGGCAACCCTTCTGGATATCTACAAAA-3' (SEQ ID NO: 10084)

5'-GGCAACCCUUCUGGAUAUCUACAAAAC-3' (SEQ ID NO: 14705)

3'-CCGUUGGGAAGACCUAUAGAUGUUUUG-5' (SEQ ID NO: 7775)

C5-4790 Target:
5'-GGCAACCCTTCTGGATATCTACAAAAC-3' (SEQ ID NO: 10085)

5'-GCAACCCUUCUGGAUAUCUACAAAACU-3' (SEQ ID NO: 14706)

3'-CGUUGGGAAGACCUAUAGAUGUUUUGA-5' (SEQ ID NO: 7776)

C5-4791 Target:
5'-GCAACCCTTCTGGATATCTACAAAACT-3' (SEQ ID NO: 10086)

5'-CAACCCUUCUGGAUAUCUACAAAACUG-3' (SEQ ID NO: 14707)

3'-GUUGGGAAGACCUAUAGAUGUUUUGAC-5' (SEQ ID NO: 7777)

C5-4792 Target:
5'-CAACCCTTCTGGATATCTACAAAACTG-3' (SEQ ID NO: 10087)

5'-AACCCUUCUGGAUAUCUACAAAACUGG-3' (SEQ ID NO: 14708)

3'-UUGGGAAGACCUAUAGAUGUUUUGACC-5' (SEQ ID NO: 7778)

C5-4793 Target:
5'-AACCCTTCTGGATATCTACAAAACTGG-3' (SEQ ID NO: 10088)

5'-ACCCUUCUGGAUAUCUACAAAACUGGG-3' (SEQ ID NO: 14709)

3'-UGGGAAGACCUAUAGAUGUUUUGACCC-5' (SEQ ID NO: 7779)

C5-4794 Target:
5'-ACCCTTCTGGATATCTACAAAACTGGG-3' (SEQ ID NO: 10089)

5'-CCCUUCUGGAUAUCUACAAAACUGGGG-3' (SEQ ID NO: 14710)

3'-GGGAAGACCUAUAGAUGUUUUGACCCC-5' (SEQ ID NO: 7780)

C5-4795 Target:
5'-CCCTTCTGGATATCTACAAAACTGGGG-3' (SEQ ID NO: 10090)

5'-CCUUCUGGAUAUCUACAAAACUGGGGA-3' (SEQ ID NO: 14711)

3'-GGAAGACCUAUAGAUGUUUUGACCCCU-5' (SEQ ID NO: 7781)

C5-4796 Target:
5'-CCTTCTGGATATCTACAAAACTGGGGA-3' (SEQ ID NO: 10091)

5'-CUUCUGGAUAUCUACAAAACUGGGGAA-3' (SEQ ID NO: 14712)

3'-GAAGACCUAUAGAUGUUUUGACCCCUU-5' (SEQ ID NO: 7782)

TABLE 9-continued

"Blunt/Blunt" DsiRNAs Corresponding to Human Anti-C5 DsiRNAs Predicted to have >50% Knockdown Efficacy C5-4797 Target:
5'-CTTCTGGATATCTACAAAACTGGGGAA-3' (SEQ ID NO: 10092)

5'-UUCUGGAUAUCUACAAAACUGGGGAAG-3' (SEQ ID NO: 14713)

3'-AAGACCUAUAGAUGUUUUGACCCCUUC-5' (SEQ ID NO: 7783)

C5-4798 Target:
5'-TTCTGGATATCTACAAAACTGGGGAAG-3' (SEQ ID NO: 10093)

5'-UCUGGAUAUCUACAAAACUGGGGAAGC-3' (SEQ ID NO: 14714)

3'-AGACCUAUAGAUGUUUUGACCCCUUCG-5' (SEQ ID NO: 7784)

C5-4799 Target:
5'-TCTGGATATCTACAAAACTGGGGAAGC-3' (SEQ ID NO: 10094)

5'-CUGGAUAUCUACAAAACUGGGGAAGCU-3' (SEQ ID NO: 14715)

3'-GACCUAUAGAUGUUUUGACCCCUUCGA-5' (SEQ ID NO: 7785)

C5-4800 Target:
5'-CTGGATATCTACAAAACTGGGGAAGCT-3' (SEQ ID NO: 10095)

5'-UGGAUAUCUACAAAACUGGGGAAGCUG-3' (SEQ ID NO: 14716)

3'-ACCUAUAGAUGUUUUGACCCCUUCGAC-5' (SEQ ID NO: 7786)

C5-4801 Target:
5'-TGGATATCTACAAAACTGGGGAAGCTG-3' (SEQ ID NO: 10096)

5'-GGAUAUCUACAAAACUGGGGAAGCUGU-3' (SEQ ID NO: 14717)

3'-CCUAUAGAUGUUUUGACCCCUUCGACA-5' (SEQ ID NO: 7787)

C5-4802 Target:
5'-GGATATCTACAAAACTGGGGAAGCTGT-3' (SEQ ID NO: 10097)

5'-GAUAUCUACAAAACUGGGGAAGCUGUU-3' (SEQ ID NO: 14718)

3'-CUAUAGAUGUUUUGACCCCUUCGACAA-5' (SEQ ID NO: 7788)

C5-4803 Target:
5'-GATATCTACAAAACTGGGGAAGCTGTT-3' (SEQ ID NO: 10098)

5'-AUAUCUACAAAACUGGGGAAGCUGUUG-3' (SEQ ID NO: 14719)

3'-UAUAGAUGUUUUGACCCCUUCGACAAC-5' (SEQ ID NO: 7789)

C5-4804 Target:
5'-ATATCTACAAAACTGGGGAAGCTGTTG-3' (SEQ ID NO: 10099)

5'-UAUCUACAAAACUGGGGAAGCUGUUGC-3' (SEQ ID NO: 14720)

3'-AUAGAUGUUUUGACCCCUUCGACAACG-5' (SEQ ID NO: 7790)

C5-4805 Target:
5'-TATCTACAAAACTGGGGAAGCTGTTGC-3' (SEQ ID NO: 10100)

5'-AUCUACAAAACUGGGGAAGCUGUUGCU-3' (SEQ ID NO: 14721)

3'-UAGAUGUUUUGACCCCUUCGACAACGA-5' (SEQ ID NO: 7791)

C5-4806 Target:
5'-ATCTACAAAACTGGGGAAGCTGTTGCT-3' (SEQ ID NO: 10101)

5'-UCUACAAAACUGGGGAAGCUGUUGCUG-3' (SEQ ID NO: 14722)

3'-AGAUGUUUUGACCCCUUCGACAACGAC-5' (SEQ ID NO: 7792)

C5-4807 Target:
5'-TCTACAAAACTGGGGAAGCTGTTGCTG-3' (SEQ ID NO: 10102)

5'-CUACAAAACUGGGGAAGCUGUUGCUGA-3' (SEQ ID NO: 14723)

3'-GAUGUUUUGACCCCUUCGACAACGACU-5' (SEQ ID NO: 7793)

C5-4808 Target:
5'-CTACAAAACTGGGGAAGCTGTTGCTGA-3' (SEQ ID NO: 10103)

5'-UACAAAACUGGGGAAGCUGUUGCUGAG-3' (SEQ ID NO: 14724)

3'-AUGUUUUGACCCCUUCGACAACGACUC-5' (SEQ ID NO: 7794)

C5-4809 Target:
5'-TACAAAACTGGGGAAGCTGTTGCTGAG-3' (SEQ ID NO: 10104)

5'-ACAAAACUGGGGAAGCUGUUGCUGAGA-3' (SEQ ID NO: 14725)

3'-UGUUUUGACCCCUUCGACAACGACUCU-5' (SEQ ID NO: 7795)

C5-4810 Target:
5'-ACAAAACTGGGGAAGCTGTTGCTGAGA-3' (SEQ ID NO: 10105)

5'-CAAAACUGGGGAAGCUGUUGCUGAGAA-3' (SEQ ID NO: 14726)

3'-GUUUUGACCCCUUCGACAACGACUCUU-5' (SEQ ID NO: 7796)

C5-4811 Target:
5'-CAAAACTGGGGAAGCTGTTGCTGAGAA-3' (SEQ ID NO: 10106)

5'-AAAACUGGGGAAGCUGUUGCUGAGAAA-3' (SEQ ID NO: 14727)

3'-UUUUGACCCCUUCGACAACGACUCUUU-5' (SEQ ID NO: 7797)

C5-4812 Target:
5'-AAAACTGGGGAAGCTGTTGCTGAGAAA-3' (SEQ ID NO: 10107)

5'-AAACUGGGGAAGCUGUUGCUGAGAAAG-3' (SEQ ID NO: 14728)

3'-UUUGACCCCUUCGACAACGACUCUUUC-5' (SEQ ID NO: 7798)

C5-4813 Target:
5'-AAACTGGGGAAGCTGTTGCTGAGAAAG-3' (SEQ ID NO: 10108)

5'-AACUGGGGAAGCUGUUGCUGAGAAAGA-3' (SEQ ID NO: 14729)

3'-UUGACCCCUUCGACAACGACUCUUUCU-5' (SEQ ID NO: 7799)

C5-4814 Target:
5'-AACTGGGGAAGCTGTTGCTGAGAAAGA-3' (SEQ ID NO: 10109)

5'-UUACCUUCAUUAAAAAGGUAACCUGUA-3' (SEQ ID NO: 14730)

3'-AAUGGAAGUAAUUUUUCCAUUGGACAU-5' (SEQ ID NO: 7800)

C5-4849 Target:
5'-TTACCTTCATTAAAAGGTAACCTGTA-3' (SEQ ID NO: 10110)

5'-UACCUUCAUUAAAAAGGUAACCUGUAC-3' (SEQ ID NO: 14731)

3'-AUGGAAGUAAUUUUUCCAUUGGACAUG-5' (SEQ ID NO: 7801)

C5-4850 Target:
5'-TACCTTCATTAAAAGGTAACCTGTAC-3' (SEQ ID NO: 10111)

5'-ACCUUCAUUAAAAAGGUAACCUGUACU-3' (SEQ ID NO: 14732)

3'-UGGAAGUAAUUUUUCCAUUGGACAUGA-5' (SEQ ID NO: 7802)

TABLE 9-continued

"Blunt/Blunt" DsiRNAs Corresponding to Human Anti-C5 DsiRNAs Predicted to have >50% Knockdown Efficacy C5-4851 Target:
5'-ACCTTCATTAAAAAGGTAACCTGTACT-3' (SEQ ID NO: 10112)

5'-CCUUCAUUAAAAAGGUAACCUGUACUA-3' (SEQ ID NO: 14733)

3'-GGAAGUAAUUUUUCCAUUGGACAUGAU-5' (SEQ ID NO: 7803)

C5-4852 Target:
5'-CCTTCATTAAAAAGGTAACCTGTACTA-3' (SEQ ID NO: 10113)

5'-CUUCAUUAAAAAGGUAACCUGUACUAA-3' (SEQ ID NO: 14734)

3'-GAAGUAAUUUUUCCAUUGGACAUGAUU-5' (SEQ ID NO: 7804)

C5-4853 Target:
5'-CTTCATTAAAAAGGTAACCTGTACTAA-3' (SEQ ID NO: 10114)

5'-UAAAAGGAAGACAGUACUUAAUUAUGG-3' (SEQ ID NO: 14735)

3'-AUUUUCCUUCUGUCAUGAAUUAAUACC-5' (SEQ ID NO: 7805)

C5-4891 Target:
5'-TAAAAGGAAGACAGTACTTAATTATGG-3' (SEQ ID NO: 10115)

5'-AAAAGGAAGACAGUACUUAAUUAUGGG-3' (SEQ ID NO: 14736)

3'-UUUUCCUUCUGUCAUGAAUUAAUACCC-5' (SEQ ID NO: 7806)

C5-4892 Target:
5'-AAAAGGAAGACAGTACTTAATTATGGG-3' (SEQ ID NO: 10116)

5'-AAAGGAAGACAGUACUUAAUUAUGGGU-3' (SEQ ID NO: 14737)

3'-UUUCCUUCUGUCAUGAAUUAAUACCCA-5' (SEQ ID NO: 7807)

C5-4893 Target:
5'-AAAGGAAGACAGTACTTAATTATGGGT-3' (SEQ ID NO: 10117)

5'-AAGGAAGACAGUACUUAAUUAUGGGUA-3' (SEQ ID NO: 14738)

3'-UUCCUUCUGUCAUGAAUUAAUACCCAU-5' (SEQ ID NO: 7808)

C5-4894 Target:
5'-AAGGAAGACAGTACTTAATTATGGGTA-3' (SEQ ID NO: 10118)

5'-AGGAAGACAGUACUUAAUUAUGGGUAA-3' (SEQ ID NO: 14739)

3'-UCCUUCUGUCAUGAAUUAAUACCCAUU-5' (SEQ ID NO: 7809)

C5-4895 Target:
5'-AGGAAGACAGTACTTAATTATGGGTAA-3' (SEQ ID NO: 10119)

5'-GGAAGACAGUACUUAAUUAUGGGUAAA-3' (SEQ ID NO: 14740)

3'-CCUUCUGUCAUGAAUUAAUACCCAUUU-5' (SEQ ID NO: 7810)

C5-4896 Target:
5'-GGAAGACAGTACTTAATTATGGGTAAA-3' (SEQ ID NO: 10120)

5'-GAAGACAGUACUUAAUUAUGGGUAAAG-3' (SEQ ID NO: 14741)

3'-CUUCUGUCAUGAAUUAAUACCCAUUUC-5' (SEQ ID NO: 7811)

C5-4897 Target:
5'-GAAGACAGTACTTAATTATGGGTAAAG-3' (SEQ ID NO: 10121)

5'-AAGACAGUACUUAAUUAUGGGUAAAGA-3' (SEQ ID NO: 14742)

3'-UUCUGUCAUGAAUUAAUACCCAUUUCU-5' (SEQ ID NO: 7812)

C5-4898 Target:
5'-AAGACAGTACTTAATTATGGGTAAAGA-3' (SEQ ID NO: 10122)

5'-CCCUCCAGAUAAAAUACAAUUUCAGUU-3' (SEQ ID NO: 14743)

3'-GGGAGGUCUAUUUUAUGUUAAAGUCAA-5' (SEQ ID NO: 7813)

C5-4927 Target:
5'-CCCTCCAGATAAAATACAATTTCAGTT-3' (SEQ ID NO: 10123)

5'-CCUCCAGAUAAAAUACAAUUUCAGUUU-3' (SEQ ID NO: 14744)

3'-GGAGGUCUAUUUUAUGUUAAAGUCAAA-5' (SEQ ID NO: 7814)

C5-4928 Target:
5'-CCTCCAGATAAAATACAATTTCAGTTT-3' (SEQ ID NO: 10124)

5'-UCCAGAUAAAAUACAAUUUCAGUUUCA-3' (SEQ ID NO: 14745)

3'-AGGUCUAUUUUAUGUUAAAGUCAAAGU-5' (SEQ ID NO: 7815)

C5-4930 Target:
5'-TCCAGATAAAATACAATTTCAGTTTCA-3' (SEQ ID NO: 10125)

5'-AGUUUCAGGUACAUCUACCCUUUAGAU-3' (SEQ ID NO: 14746)

3'-UCAAAGUCCAUGUAGAUGGGAAAUCUA-5' (SEQ ID NO: 7816)

C5-4950 Target:
5'-AGTTTCAGGTACATCTACCCTTTAGAT-3' (SEQ ID NO: 10126)

5'-GUUUCAGGUACAUCUACCCUUUAGAUU-3' (SEQ ID NO: 14747)

3'-CAAAGUCCAUGUAGAUGGGAAAUCUAA-5' (SEQ ID NO: 7817)

C5-4951 Target:
5'-GTTTCAGGTACATCTACCCTTTAGATT-3' (SEQ ID NO: 10127)

5'-UUUCAGGUACAUCUACCCUUUAGAUUC-3' (SEQ ID NO: 14748)

3'-AAAGUCCAUGUAGAUGGGAAAUCUAAG-5' (SEQ ID NO: 7818)

C5-4952 Target:
5'-TTTCAGGTACATCTACCCTTTAGATTC-3' (SEQ ID NO: 10128)

5'-UUCAGGUACAUCUACCCUUUAGAUUCC-3' (SEQ ID NO: 14749)

3'-AAGUCCAUGUAGAUGGGAAAUCUAAGG-5' (SEQ ID NO: 7819)

C5-4953 Target:
5'-TTCAGGTACATCTACCCTTTAGATTCC-3' (SEQ ID NO: 10129)

5'-UCAGGUACAUCUACCCUUUAGAUUCCU-3' (SEQ ID NO: 14750)

3'-AGUCCAUGUAGAUGGGAAAUCUAAGGA-5' (SEQ ID NO: 7820)

C5-4954 Target:
5'-TCAGGTACATCTACCCTTTAGATTCCT-3' (SEQ ID NO: 10130)

5'-CAGGUACAUCUACCCUUUAGAUUCCUU-3' (SEQ ID NO: 14751)

3'-GUCCAUGUAGAUGGGAAAUCUAAGGAA-5' (SEQ ID NO: 7821)

C5-4955 Target:
5'-CAGGTACATCTACCCTTTAGATTCCTT-3' (SEQ ID NO: 10131)

5'-AGGUACAUCUACCCUUUAGAUUCCUUG-3' (SEQ ID NO: 14752)

3'-UCCAUGUAGAUGGGAAAUCUAAGGAAC-5' (SEQ ID NO: 7822)

TABLE 9-continued

"Blunt/Blunt" DsiRNAs Corresponding to Human Anti-C5 DsiRNAs Predicted to have >50% Knockdown Efficacy C5-4956 Target:
5'-AGGTACATCTACCCTTTAGATTCCTTG-3' (SEQ ID NO: 10132)

5'-GGUACAUCUACCCUUUAGAUUCCUUGA-3' (SEQ ID NO: 14753)

3'-CCAUGUAGAUGGGAAAUCUAAGGAACU-5' (SEQ ID NO: 7823)

C5-4957 Target:
5'-GGTACATCTACCCTTTAGATTCCTTGA-3' (SEQ ID NO: 10133)

5'-GUACAUCUACCCUUUAGAUUCCUUGAC-3' (SEQ ID NO: 14754)

3'-CAUGUAGAUGGGAAAUCUAAGGAACUG-5' (SEQ ID NO: 7824)

C5-4958 Target:
5'-GTACATCTACCCTTTAGATTCCTTGAC-3' (SEQ ID NO: 10134)

5'-UACAUCUACCCUUUAGAUUCCUUGACC-3' (SEQ ID NO: 14755)

3'-AUGUAGAUGGGAAAUCUAAGGAACUGG-5' (SEQ ID NO: 7825)

C5-4959 Target:
5'-TACATCTACCCTTTAGATTCCTTGACC-3' (SEQ ID NO: 10135)

5'-ACAUCUACCCUUUAGAUUCCUUGACCU-3' (SEQ ID NO: 14756)

3'-UGUAGAUGGGAAAUCUAAGGAACUGGA-5' (SEQ ID NO: 7826)

C5-4960 Target:
5'-ACATCTACCCTTTAGATTCCTTGACCT-3' (SEQ ID NO: 10136)

5'-CAUCUACCCUUUAGAUUCCUUGACCUG-3' (SEQ ID NO: 14757)

3'-GUAGAUGGGAAAUCUAAGGAACUGGAC-5' (SEQ ID NO: 7827)

C5-4961 Target:
5'-CATCTACCCTTTAGATTCCTTGACCTG-3' (SEQ ID NO: 10137)

5'-AUCUACCCUUUAGAUUCCUUGACCUGG-3' (SEQ ID NO: 14758)

3'-UAGAUGGGAAAUCUAAGGAACUGGACC-5' (SEQ ID NO: 7828)

C5-4962 Target:
5'-ATCTACCCTTTAGATTCCTTGACCTGG-3' (SEQ ID NO: 10138)

5'-UCUACCCUUUAGAUUCCUUGACCUGGA-3' (SEQ ID NO: 14759)

3'-AGAUGGGAAAUCUAAGGAACUGGACCU-5' (SEQ ID NO: 7829)

C5-4963 Target:
5'-TCTACCCTTTAGATTCCTTGACCTGGA-3' (SEQ ID NO: 10139)

5'-CUACCCUUUAGAUUCCUUGACCUGGAU-3' (SEQ ID NO: 14760)

3'-GAUGGGAAAUCUAAGGAACUGGACCUA-5' (SEQ ID NO: 7830)

C5-4964 Target:
5'-CTACCCTTTAGATTCCTTGACCTGGAT-3' (SEQ ID NO: 10140)

5'-UACCCUUUAGAUUCCUUGACCUGGAUU-3' (SEQ ID NO: 14761)

3'-AUGGGAAAUCUAAGGAACUGGACCUAA-5' (SEQ ID NO: 7831)

C5-4965 Target:
5'-TACCCTTTAGATTCCTTGACCTGGATT-3' (SEQ ID NO: 10141)

5'-ACCCUUUAGAUUCCUUGACCUGGAUUG-3' (SEQ ID NO: 14762)

3'-UGGGAAAUCUAAGGAACUGGACCUAAC-5' (SEQ ID NO: 7832)

C5-4966 Target:
5'-ACCCTTTAGATTCCTTGACCTGGATTG-3' (SEQ ID NO: 10142)

5'-CCCUUUAGAUUCCUUGACCUGGAUUGA-3' (SEQ ID NO: 14763)

3'-GGGAAAUCUAAGGAACUGGACCUAACU-5' (SEQ ID NO: 7833)

C5-4967 Target:
5'-CCCTTTAGATTCCTTGACCTGGATTGA-3' (SEQ ID NO: 10143)

5'-CCUUUAGAUUCCUUGACCUGGAUUGAA-3' (SEQ ID NO: 14764)

3'-GGAAAUCUAAGGAACUGGACCUAACUU-5' (SEQ ID NO: 7834)

C5-4968 Target:
5'-CCTTTAGATTCCTTGACCTGGATTGAA-3' (SEQ ID NO: 10144)

5'-CUUUAGAUUCCUUGACCUGGAUUGAAU-3' (SEQ ID NO: 14765)

3'-GAAAUCUAAGGAACUGGACCUAACUUA-5' (SEQ ID NO: 7835)

C5-4969 Target:
5'-CTTTAGATTCCTTGACCTGGATTGAAT-3' (SEQ ID NO: 10145)

5'-UUUAGAUUCCUUGACCUGGAUUGAAUA-3' (SEQ ID NO: 14766)

3'-AAAUCUAAGGAACUGGACCUAACUUAU-5' (SEQ ID NO: 7836)

C5-4970 Target:
5'-TTTAGATTCCTTGACCTGGATTGAATA-3' (SEQ ID NO: 10146)

5'-UUAGAUUCCUUGACCUGGAUUGAAUAC-3' (SEQ ID NO: 14767)

3'-AAUCUAAGGAACUGGACCUAACUUAUG-5' (SEQ ID NO: 7837)

C5-4971 Target:
5'-TTAGATTCCTTGACCTGGATTGAATAC-3' (SEQ ID NO: 10147)

5'-UAGAUUCCUUGACCUGGAUUGAAUACU-3' (SEQ ID NO: 14768)

3'-AUCUAAGGAACUGGACCUAACUUAUGA-5' (SEQ ID NO: 7838)

C5-4972 Target:
5'-TAGATTCCTTGACCTGGATTGAATACT-3' (SEQ ID NO: 10148)

5'-AGAUUCCUUGACCUGGAUUGAAUACUG-3' (SEQ ID NO: 14769)

3'-UCUAAGGAACUGGACCUAACUUAUGAC-5' (SEQ ID NO: 7839)

C5-4973 Target:
5'-AGATTCCTTGACCTGGATTGAATACTG-3' (SEQ ID NO: 10149)

5'-GAUUCCUUGACCUGGAUUGAAUACUGG-3' (SEQ ID NO: 14770)

3'-CUAAGGAACUGGACCUAACUUAUGACC-5' (SEQ ID NO: 7840)

C5-4974 Target:
5'-GATTCCTTGACCTGGATTGAATACTGG-3' (SEQ ID NO: 10150)

5'-AUUCCUUGACCUGGAUUGAAUACUGGC-3' (SEQ ID NO: 14771)

3'-UAAGGAACUGGACCUAACUUAUGACCG-5' (SEQ ID NO: 7841)

C5-4975 Target:
5'-ATTCCTTGACCTGGATTGAATACTGGC-3' (SEQ ID NO: 10151)

5'-UUCCUUGACCUGGAUUGAAUACUGGCC-3' (SEQ ID NO: 14772)

3'-AAGGAACUGGACCUAACUUAUGACCGG-5' (SEQ ID NO: 7842)

TABLE 9-continued

"Blunt/Blunt" DsiRNAs Corresponding to Human Anti-C5 DsiRNAs Predicted to have >50% Knockdown Efficacy C5-4976 Target:
5'-TTCCTTGACCTGGATTGAATACTGGCC-3' (SEQ ID NO: 10152)

5'-UCCUUGACCUGGAUUGAAUACUGGCCU-3' (SEQ ID NO: 14773)

3'-AGGAACUGGACCUAACUUAUGACCGGA-5' (SEQ ID NO: 7843)

C5-4977 Target:
5'-TCCTTGACCTGGATTGAATACTGGCCT-3' (SEQ ID NO: 10153)

5'-CCUUGACCUGGAUUGAAUACUGGCCUA-3' (SEQ ID NO: 14774)

3'-GGAACUGGACCUAACUUAUGACCGGAU-5' (SEQ ID NO: 7844)

C5-4978 Target:
5'-CCTTGACCTGGATTGAATACTGGCCTA-3' (SEQ ID NO: 10154)

5'-CUUGACCUGGAUUGAAUACUGGCCUAG-3' (SEQ ID NO: 14775)

3'-GAACUGGACCUAACUUAUGACCGGAUC-5' (SEQ ID NO: 7845)

C5-4979 Target:
5'-CTTGACCTGGATTGAATACTGGCCTAG-3' (SEQ ID NO: 10155)

5'-UUGACCUGGAUUGAAUACUGGCCUAGA-3' (SEQ ID NO: 14776)

3'-AACUGGACCUAACUUAUGACCGGAUCU-5' (SEQ ID NO: 7846)

C5-4980 Target:
5'-TTGACCTGGATTGAATACTGGCCTAGA-3' (SEQ ID NO: 10156)

5'-UGACCUGGAUUGAAUACUGGCCUAGAG-3' (SEQ ID NO: 14777)

3'-ACUGGACCUAACUUAUGACCGGAUCUC-5' (SEQ ID NO: 7847)

C5-4981 Target:
5'-TGACCTGGATTGAATACTGGCCTAGAG-3' (SEQ ID NO: 10157)

5'-GACCUGGAUUGAAUACUGGCCUAGAGA-3' (SEQ ID NO: 14778)

3'-CUGGACCUAACUUAUGACCGGAUCUCU-5' (SEQ ID NO: 7848)

C5-4982 Target:
5'-GACCTGGATTGAATACTGGCCTAGAGA-3' (SEQ ID NO: 10158)

5'-ACCUGGAUUGAAUACUGGCCUAGAGAC-3' (SEQ ID NO: 14779)

3'-UGGACCUAACUUAUGACCGGAUCUCUG-5' (SEQ ID NO: 7849)

C5-4983 Target:
5'-ACCTGGATTGAATACTGGCCTAGAGAC-3' (SEQ ID NO: 10159)

5'-CCUGGAUUGAAUACUGGCCUAGAGACA-3' (SEQ ID NO: 14780)

3'-GGACCUAACUUAUGACCGGAUCUCUGU-5' (SEQ ID NO: 7850)

C5-4984 Target:
5'-CCTGGATTGAATACTGGCCTAGAGACA-3' (SEQ ID NO: 10160)

5'-CUGGAUUGAAUACUGGCCUAGAGACAC-3' (SEQ ID NO: 14781)

3'-GACCUAACUUAUGACCGGAUCUCUGUG-5' (SEQ ID NO: 7851)

C5-4985 Target:
5'-CTGGATTGAATACTGGCCTAGAGACAC-3' (SEQ ID NO: 10161)

5'-CACAACAUGUUCAUCGUGUCAAGCAUU-3' (SEQ ID NO: 14782)

3'-GUGUUGUACAAGUAGCACAGUUCGUAA-5' (SEQ ID NO: 7852)

C5-5009 Target:
5'-CACAACATGTTCATCGTGTCAAGCATT-3' (SEQ ID NO: 10162)

5'-ACAACAUGUUCAUCGUGUCAAGCAUUU-3' (SEQ ID NO: 14783)

3'-UGUUGUACAAGUAGCACAGUUCGUAAA-5' (SEQ ID NO: 7853)

C5-5010 Target:
5'-ACAACATGTTCATCGTGTCAAGCATTT-3' (SEQ ID NO: 10163)

5'-CAACAUGUUCAUCGUGUCAAGCAUUUU-3' (SEQ ID NO: 14784)

3'-GUUGUACAAGUAGCACAGUUCGUAAAA-5' (SEQ ID NO: 7854)

C5-5011 Target:
5'-CAACATGTTCATCGTGTCAAGCATTTT-3' (SEQ ID NO: 10164)

5'-AACAUGUUCAUCGUGUCAAGCAUUUUU-3' (SEQ ID NO: 14785)

3'-UUGUACAAGUAGCACAGUUCGUAAAAA-5' (SEQ ID NO: 7855)

C5-5012 Target:
5'-AACATGTTCATCGTGTCAAGCATTTTT-3' (SEQ ID NO: 10165)

5'-CAUGUUCAUCGUGUCAAGCAUUUUUAG-3' (SEQ ID NO: 14786)

3'-GUACAAGUAGCACAGUUCGUAAAAAUC-5' (SEQ ID NO: 7856)

C5-5014 Target:
5'-CATGTTCATCGTGTCAAGCATTTTTAG-3' (SEQ ID NO: 10166)

5'-AUGUUCAUCGUGUCAAGCAUUUUUAGC-3' (SEQ ID NO: 14787)

3'-UACAAGUAGCACAGUUCGUAAAAAUCG-5' (SEQ ID NO: 7857)

C5-5015 Target:
5'-ATGTTCATCGTGTCAAGCATTTTTAGC-3' (SEQ ID NO: 10167)

5'-UGUUCAUCGUGUCAAGCAUUUUUAGCU-3' (SEQ ID NO: 14788)

3'-ACAAGUAGCACAGUUCGUAAAAAUCGA-5' (SEQ ID NO: 7858)

C5-5016 Target:
5'-TGTTCATCGTGTCAAGCATTTTTAGCT-3' (SEQ ID NO: 10168)

5'-GUUCAUCGUGUCAAGCAUUUUUAGCUA-3' (SEQ ID NO: 14789)

3'-CAAGUAGCACAGUUCGUAAAAAUCGAU-5' (SEQ ID NO: 7859)

C5-5017 Target:
5'-GTTCATCGTGTCAAGCATTTTTAGCTA-3' (SEQ ID NO: 10169)

5'-UCAUCGUGUCAAGCAUUUUUAGCUAAU-3' (SEQ ID NO: 14790)

3'-AGUAGCACAGUUCGUAAAAAUCGAUUA-5' (SEQ ID NO: 7860)

C5-5019 Target:
5'-TCATCGTGTCAAGCATTTTTAGCTAAT-3' (SEQ ID NO: 10170)

5'-CAUCGUGUCAAGCAUUUUUAGCUAAUU-3' (SEQ ID NO: 14791)

3'-GUAGCACAGUUCGUAAAAAUCGAUUAA-5' (SEQ ID NO: 7861)

C5-5020 Target:
5'-CATCGTGTCAAGCATTTTTAGCTAATT-3' (SEQ ID NO: 10171)

5'-AUCGUGUCAAGCAUUUUUAGCUAAUUU-3' (SEQ ID NO: 14792)

3'-UAGCACAGUUCGUAAAAAUCGAUUAAA-5' (SEQ ID NO: 7862)

TABLE 9-continued

"Blunt/Blunt" DsiRNAs Corresponding to Human Anti-C5 DsiRNAs Predicted to have >50% Knockdown Efficacy C5-5021 Target:
5'-ATCGTGTCAAGCATTTTTAGCTAATTT-3' (SEQ ID NO: 10172)

5'-CGUGUCAAGCAUUUUUAGCUAAUUUAG-3' (SEQ ID NO: 14793)

3'-GCACAGUUCGUAAAAAUCGAUUAAAUC-5' (SEQ ID NO: 7863)

C5-5023 Target:
5'-CGTGTCAAGCATTTTTAGCTAATTTAG-3' (SEQ ID NO: 10173)

5'-GUGUCAAGCAUUUUUAGCUAAUUUAGA-3' (SEQ ID NO: 14794)

3'-CACAGUUCGUAAAAAUCGAUUAAAUCU-5' (SEQ ID NO: 7864)

C5-5024 Target:
5'-GTGTCAAGCATTTTTAGCTAATTTAGA-3' (SEQ ID NO: 10174)

5'-UGUCAAGCAUUUUUAGCUAAUUUAGAU-3' (SEQ ID NO: 14795)

3'-ACAGUUCGUAAAAAUCGAUUAAAUCUA-5' (SEQ ID NO: 7865)

C5-5025 Target:
5'-TGTCAAGCATTTTTAGCTAATTTAGAT-3' (SEQ ID NO: 10175)

5'-GUCAAGCAUUUUUAGCUAAUUUAGAUG-3' (SEQ ID NO: 14796)

3'-CAGUUCGUAAAAAUCGAUUAAAUCUAC-5' (SEQ ID NO: 7866)

C5-5026 Target:
5'-GTCAAGCATTTTTAGCTAATTTAGATG-3' (SEQ ID NO: 10176)

5'-CAAGCAUUUUUAGCUAAUUUAGAUGAA-3' (SEQ ID NO: 14797)

3'-GUUCGUAAAAAUCGAUUAAAUCUACUU-5' (SEQ ID NO: 7867)

C5-5028 Target:
5'-CAAGCATTTTTAGCTAATTTAGATGAA-3' (SEQ ID NO: 10177)

5'-AAGCAUUUUUAGCUAAUUUAGAUGAAU-3' (SEQ ID NO: 14798)

3'-UUCGUAAAAAUCGAUUAAAUCUACUUA-5' (SEQ ID NO: 7868)

C5-5029 Target:
5'-AAGCATTTTTAGCTAATTTAGATGAAT-3' (SEQ ID NO: 10178)

5'-AGCAUUUUUAGCUAAUUUAGAUGAAUU-3' (SEQ ID NO: 14799)

3'-UCGUAAAAAUCGAUUAAAUCUACUUAA-5' (SEQ ID NO: 7869)

C5-5030 Target:
5'-AGCATTTTTAGCTAATTTAGATGAATT-3' (SEQ ID NO: 10179)

5'-GCAUUUUUAGCUAAUUUAGAUGAAUUU-3' (SEQ ID NO: 14800)

3'-CGUAAAAAUCGAUUAAAUCUACUUAAA-5' (SEQ ID NO: 7870)

C5-5031 Target:
5'-GCATTTTTAGCTAATTTAGATGAATTT-3' (SEQ ID NO: 10180)

5'-CAUUUUUAGCUAAUUUAGAUGAAUUUG-3' (SEQ ID NO: 14801)

3'-GUAAAAAUCGAUUAAAUCUACUUAAAC-5' (SEQ ID NO: 7871)

C5-5032 Target:
5'-CATTTTTAGCTAATTTAGATGAATTTG-3' (SEQ ID NO: 10181)

5'-AUUUUUAGCUAAUUUAGAUGAAUUUGC-3' (SEQ ID NO: 14802)

3'-UAAAAAUCGAUUAAAUCUACUUAAACG-5' (SEQ ID NO: 7872)

C5-5033 Target:
5'-ATTTTTAGCTAATTTAGATGAATTTGC-3' (SEQ ID NO: 10182)

5'-UUUUUAGCUAAUUUAGAUGAAUUUGCC-3' (SEQ ID NO: 14803)

3'-AAAAAUCGAUUAAAUCUACUUAAACGG-5' (SEQ ID NO: 7873)

C5-5034 Target:
5'-TTTTTAGCTAATTTAGATGAATTTGCC-3' (SEQ ID NO: 10183)

5'-UUUUAGCUAAUUUAGAUGAAUUUGCCG-3' (SEQ ID NO: 14804)

3'-AAAAUCGAUUAAAUCUACUUAAACGGC-5' (SEQ ID NO: 7874)

C5-5035 Target:
5'-TTTTAGCTAATTTAGATGAATTTGCCG-3' (SEQ ID NO: 10184)

5'-UUUAGCUAAUUUAGAUGAAUUUGCCGA-3' (SEQ ID NO: 14805)

3'-AAAUCGAUUAAAUCUACUUAAACGGCU-5' (SEQ ID NO: 7875)

C5-5036 Target:
5'-TTTAGCTAATTTAGATGAATTTGCCGA-3' (SEQ ID NO: 10185)

5'-UUAGCUAAUUUAGAUGAAUUUGCCGAA-3' (SEQ ID NO: 14806)

3'-AAUCGAUUAAAUCUACUUAAACGGCUU-5' (SEQ ID NO: 7876)

C5-5037 Target:
5'-TTAGCTAATTTAGATGAATTTGCCGAA-3' (SEQ ID NO: 10186)

5'-UAGCUAAUUUAGAUGAAUUUGCCGAAG-3' (SEQ ID NO: 14807)

3'-AUCGAUUAAAUCUACUUAAACGGCUUC-5' (SEQ ID NO: 7877)

C5-5038 Target:
5'-TAGCTAATTTAGATGAATTTGCCGAAG-3' (SEQ ID NO: 10187)

5'-AGCUAAUUUAGAUGAAUUUGCCGAAGA-3' (SEQ ID NO: 14808)

3'-UCGAUUAAAUCUACUUAAACGGCUUCU-5' (SEQ ID NO: 7878)

C5-5039 Target:
5'-AGCTAATTTAGATGAATTTGCCGAAGA-3' (SEQ ID NO: 10188)

5'-AUAUCUUUUUAAAUGGAUGCUAAAAUU-3' (SEQ ID NO: 14809)

3'-UAUAGAAAAAUUUACCUACGAUUUUAA-5' (SEQ ID NO: 7879)

C5-5065 Target:
5'-ATATCTTTTTAAATGGATGCTAAAATT-3' (SEQ ID NO: 10189)

5'-UAUCUUUUUAAAUGGAUGCUAAAAUUC-3' (SEQ ID NO: 14810)

3'-AUAGAAAAAUUUACCUACGAUUUUAAG-5' (SEQ ID NO: 7880)

C5-5066 Target:
5'-TATCTTTTTAAATGGATGCTAAAATTC-3' (SEQ ID NO: 10190)

5'-AUCUUUUUAAAUGGAUGCUAAAAUUCC-3' (SEQ ID NO: 14811)

3'-UAGAAAAAUUUACCUACGAUUUUAAGG-5' (SEQ ID NO: 7881)

C5-5067 Target:
5'-ATCTTTTTAAATGGATGCTAAAATTCC-3' (SEQ ID NO: 10191)

5'-UCUUUUUAAAUGGAUGCUAAAAUUCCU-3' (SEQ ID NO: 14812)

3'-AGAAAAAUUUACCUACGAUUUUAAGGA-5' (SEQ ID NO: 7882)

TABLE 9-continued

"Blunt/Blunt" DsiRNAs Corresponding to Human Anti-C5 DsiRNAs Predicted to have >50% Knockdown Efficacy C5-5068 Target:
5'-TCTTTTTAAATGGATGCTAAAATTCCT-3' (SEQ ID NO: 10192)

5'-CUUUUUAAAUGGAUGCUAAAAUUCCUG-3' (SEQ ID NO: 14813)

3'-GAAAAAUUUACCUACGAUUUUAAGGAC-5' (SEQ ID NO: 7883)

C5-5069 Target:
5'-CTTTTTAAATGGATGCTAAAATTCCTG-3' (SEQ ID NO: 10193)

5'-UUUUUAAAUGGAUGCUAAAAUUCCUGA-3' (SEQ ID NO: 14814)

3'-AAAAAUUUACCUACGAUUUUAAGGACU-5' (SEQ ID NO: 7884)

C5-5070 Target:
5'-TTTTTAAATGGATGCTAAAATTCCTGA-3' (SEQ ID NO: 10194)

5'-UUUUAAAUGGAUGCUAAAAUUCCUGAA-3' (SEQ ID NO: 14815)

3'-AAAAUUUACCUACGAUUUUAAGGACUU-5' (SEQ ID NO: 7885)

C5-5071 Target:
5'-TTTTAAATGGATGCTAAAATTCCTGAA-3' (SEQ ID NO: 10195)

5'-UUUAAAUGGAUGCUAAAAUUCCUGAAG-3' (SEQ ID NO: 14816)

3'-AAAUUUACCUACGAUUUUAAGGACUUC-5' (SEQ ID NO: 7886)

C5-5072 Target:
5'-TTTAAATGGATGCTAAAATTCCTGAAG-3' (SEQ ID NO: 10196)

5'-UUAAAUGGAUGCUAAAAUUCCUGAAGU-3' (SEQ ID NO: 14817)

3'-AAUUUACCUACGAUUUUAAGGACUUCA-5' (SEQ ID NO: 7887)

C5-5073 Target:
5'-TTAAATGGATGCTAAAATTCCTGAAGT-3' (SEQ ID NO: 10197)

5'-UAAAUGGAUGCUAAAAUUCCUGAAGUU-3' (SEQ ID NO: 14818)

3'-AUUUACCUACGAUUUUAAGGACUUCAA-5' (SEQ ID NO: 7888)

C5-5074 Target:
5'-TAAATGGATGCTAAAATTCCTGAAGTT-3' (SEQ ID NO: 10198)

5'-AAAUGGAUGCUAAAAUUCCUGAAGUUC-3' (SEQ ID NO: 14819)

3'-UUUUACCUACGAUUUUAAGGACUUCAAG-5' (SEQ ID NO: 7889)

C5-5075 Target:
5'-AAATGGATGCTAAAATTCCTGAAGTTC-3' (SEQ ID NO: 10199)

5'-AUGGAUGCUAAAAUUCCUGAAGUUCAG-3' (SEQ ID NO: 14820)

3'-UACCUACGAUUUUAAGGACUUCAAGUC-5' (SEQ ID NO: 7890)

C5-5077 Target:
5'-ATGGATGCTAAAATTCCTGAAGTTCAG-3' (SEQ ID NO: 10200)

5'-UGGAUGCUAAAAUUCCUGAAGUUCAGC-3' (SEQ ID NO: 14821)

3'-ACCUACGAUUUUAAGGACUUCAAGUCG-5' (SEQ ID NO: 7891)

C5-5078 Target:
5'-TGGATGCTAAAATTCCTGAAGTTCAGC-3' (SEQ ID NO: 10201)

5'-GGAUGCUAAAAUUCCUGAAGUUCAGCU-3' (SEQ ID NO: 14822)

3'-CCUACGAUUUUAAGGACUUCAAGUCGA-5' (SEQ ID NO: 7892)

C5-5079 Target:
5'-GGATGCTAAAATTCCTGAAGTTCAGCT-3' (SEQ ID NO: 10202)

5'-GAUGCUAAAAUUCCUGAAGUUCAGCUG-3' (SEQ ID NO: 14823)

3'-CUACGAUUUUAAGGACUUCAAGUCGAC-5' (SEQ ID NO: 7893)

C5-5080 Target:
5'-GATGCTAAAATTCCTGAAGTTCAGCTG-3' (SEQ ID NO: 10203)

5'-AUGCUAAAAUUCCUGAAGUUCAGCUGC-3' (SEQ ID NO: 14824)

3'-UACGAUUUUAAGGACUUCAAGUCGACG-5' (SEQ ID NO: 7894)

C5-5081 Target:
5'-ATGCTAAAATTCCTGAAGTTCAGCTGC-3' (SEQ ID NO: 10204)

5'-UGCUAAAAUUCCUGAAGUUCAGCUGCA-3' (SEQ ID NO: 14825)

3'-ACGAUUUUAAGGACUUCAAGUCGACGU-5' (SEQ ID NO: 7895)

C5-5082 Target:
5'-TGCTAAAATTCCTGAAGTTCAGCTGCA-3' (SEQ ID NO: 10205)

5'-GCUAAAAUUCCUGAAGUUCAGCUGCAU-3' (SEQ ID NO: 14826)

3'-CGAUUUUAAGGACUUCAAGUCGACGUA-5' (SEQ ID NO: 7896)

C5-5083 Target:
5'-GCTAAAATTCCTGAAGTTCAGCTGCAT-3' (SEQ ID NO: 10206)

5'-CUAAAAUUCCUGAAGUUCAGCUGCAUA-3' (SEQ ID NO: 14827)

3'-GAUUUUAAGGACUUCAAGUCGACGUAU-5' (SEQ ID NO: 7897)

C5-5084 Target:
5'-CTAAAATTCCTGAAGTTCAGCTGCATA-3' (SEQ ID NO: 10207)

5'-UAAAAUUCCUGAAGUUCAGCUGCAUAC-3' (SEQ ID NO: 14828)

3'-AUUUUAAGGACUUCAAGUCGACGUAUG-5' (SEQ ID NO: 7898)

C5-5085 Target:
5'-TAAAATTCCTGAAGTTCAGCTGCATAC-3' (SEQ ID NO: 10208)

5'-AAAAUUCCUGAAGUUCAGCUGCAUACA-3' (SEQ ID NO: 14829)

3'-UUUUAAGGACUUCAAGUCGACGUAUGU-5' (SEQ ID NO: 7899)

C5-5086 Target:
5'-AAAATTCCTGAAGTTCAGCTGCATACA-3' (SEQ ID NO: 10209)

5'-AAAUUCCUGAAGUUCAGCUGCAUACAG-3' (SEQ ID NO: 14830)

3'-UUUAAGGACUUCAAGUCGACGUAUGUC-5' (SEQ ID NO: 7900)

C5-5087 Target:
5'-AAATTCCTGAAGTTCAGCTGCATACAG-3' (SEQ ID NO: 10210)

5'-AAUUCCUGAAGUUCAGCUGCAUACAGU-3' (SEQ ID NO: 14831)

3'-UUAAGGACUUCAAGUCGACGUAUGUCA-5' (SEQ ID NO: 7901)

C5-5088 Target:
5'-AATTCCTGAAGTTCAGCTGCATACAGT-3' (SEQ ID NO: 10211)

5'-AUUCCUGAAGUUCAGCUGCAUACAGUU-3' (SEQ ID NO: 14832)

3'-UAAGGACUUCAAGUCGACGUAUGUCAA-5' (SEQ ID NO: 7902)

TABLE 9-continued

"Blunt/Blunt" DsiRNAs Corresponding to Human Anti-C5 DsiRNAs Predicted to have >50% Knockdown Efficacy C5-5089 Target:
5'-ATTCCTGAAGTTCAGCTGCATACAGTT-3' (SEQ ID NO: 10212)

5'-UUCCUGAAGUUCAGCUGCAUACAGUUU-3' (SEQ ID NO: 14833)

3'-AAGGACUUCAAGUCGACGUAUGUCAAA-5' (SEQ ID NO: 7903)

C5-5090 Target:
5'-TTCCTGAAGTTCAGCTGCATACAGTTT-3' (SEQ ID NO: 10213)

5'-UCCUGAAGUUCAGCUGCAUACAGUUUG-3' (SEQ ID NO: 14834)

3'-AGGACUUCAAGUCGACGUAUGUCAAAC-5' (SEQ ID NO: 7904)

C5-5091 Target:
5'-TCCTGAAGTTCAGCTGCATACAGTTTG-3' (SEQ ID NO: 10214)

5'-CCUGAAGUUCAGCUGCAUACAGUUUGC-3' (SEQ ID NO: 14835)

3'-GGACUUCAAGUCGACGUAUGUCAAACG-5' (SEQ ID NO: 7905)

C5-5092 Target:
5'-CCTGAAGTTCAGCTGCATACAGTTTGC-3' (SEQ ID NO: 10215)

5'-CUGAAGUUCAGCUGCAUACAGUUUGCA-3' (SEQ ID NO: 14836)

3'-GACUUCAAGUCGACGUAUGUCAAACGU-5' (SEQ ID NO: 7906)

C5-5093 Target:
5'-CTGAAGTTCAGCTGCATACAGTTTGCA-3' (SEQ ID NO: 10216)

5'-UGAAGUUCAGCUGCAUACAGUUUGCAC-3' (SEQ ID NO: 14837)

3'-ACUUCAAGUCGACGUAUGUCAAACGUG-5' (SEQ ID NO: 7907)

C5-5094 Target:
5'-TGAAGTTCAGCTGCATACAGTTTGCAC-3' (SEQ ID NO: 10217)

5'-GAAGUUCAGCUGCAUACAGUUUGCACU-3' (SEQ ID NO: 14838)

3'-CUUCAAGUCGACGUAUGUCAAACGUGA-5' (SEQ ID NO: 7908)

C5-5095 Target:
5'-GAAGTTCAGCTGCATACAGTTTGCACT-3' (SEQ ID NO: 10218)

5'-AAGUUCAGCUGCAUACAGUUUGCACUU-3' (SEQ ID NO: 14839)

3'-UUCAAGUCGACGUAUGUCAAACGUGAA-5' (SEQ ID NO: 7909)

C5-5096 Target:
5'-AAGTTCAGCTGCATACAGTTTGCACTT-3' (SEQ ID NO: 10219)

5'-AGUUCAGCUGCAUACAGUUUGCACUUA-3' (SEQ ID NO: 14840)

3'-UCAAGUCGACGUAUGUCAAACGUGAAU-5' (SEQ ID NO: 7910)

C5-5097 Target:
5'-AGTTCAGCTGCATACAGTTTGCACTTA-3' (SEQ ID NO: 10220)

5'-GUUCAGCUGCAUACAGUUUGCACUUAU-3' (SEQ ID NO: 14841)

3'-CAAGUCGACGUAUGUCAAACGUGAAUA-5' (SEQ ID NO: 7911)

C5-5098 Target:
5'-GTTCAGCTGCATACAGTTTGCACTTAT-3' (SEQ ID NO: 10221)

5'-UUCAGCUGCAUACAGUUUGCACUUAUG-3' (SEQ ID NO: 14842)

3'-AAGUCGACGUAUGUCAAACGUGAAUAC-5' (SEQ ID NO: 7912)

C5-5099 Target:
5'-TTCAGCTGCATACAGTTTGCACTTATG-3' (SEQ ID NO: 10222)

5'-UCAGCUGCAUACAGUUUGCACUUAUGG-3' (SEQ ID NO: 14843)

3'-AGUCGACGUAUGUCAAACGUGAAUACC-5' (SEQ ID NO: 7913)

C5-5100 Target:
5'-TCAGCTGCATACAGTTTGCACTTATGG-3' (SEQ ID NO: 10223)

5'-CAGCUGCAUACAGUUUGCACUUAUGGA-3' (SEQ ID NO: 14844)

3'-GUCGACGUAUGUCAAACGUGAAUACCU-5' (SEQ ID NO: 7914)

C5-5101 Target:
5'-CAGCTGCATACAGTTTGCACTTATGGA-3' (SEQ ID NO: 10224)

5'-AGCUGCAUACAGUUUGCACUUAUGGAC-3' (SEQ ID NO: 14845)

3'-UCGACGUAUGUCAAACGUGAAUACCUG-5' (SEQ ID NO: 7915)

C5-5102 Target:
5'-AGCTGCATACAGTTTGCACTTATGGAC-3' (SEQ ID NO: 10225)

5'-GCUGCAUACAGUUUGCACUUAUGGACU-3' (SEQ ID NO: 14846)

3'-CGACGUAUGUCAAACGUGAAUACCUGA-5' (SEQ ID NO: 7916)

C5-5103 Target:
5'-GCTGCATACAGTTTGCACTTATGGACT-3' (SEQ ID NO: 10226)

5'-CUGCAUACAGUUUGCACUUAUGGACUC-3' (SEQ ID NO: 14847)

3'-GACGUAUGUCAAACGUGAAUACCUGAG-5' (SEQ ID NO: 7917)

C5-5104 Target:
5'-CTGCATACAGTTTGCACTTATGGACTC-3' (SEQ ID NO: 10227)

5'-UGCAUACAGUUUGCACUUAUGGACUCC-3' (SEQ ID NO: 14848)

3'-ACGUAUGUCAAACGUGAAUACCUGAGG-5' (SEQ ID NO: 7918)

C5-5105 Target:
5'-TGCATACAGTTTGCACTTATGGACTCC-3' (SEQ ID NO: 10228)

5'-GCAUACAGUUUGCACUUAUGGACUCCU-3' (SEQ ID NO: 14849)

3'-CGUAUGUCAAACGUGAAUACCUGAGGA-5' (SEQ ID NO: 7919)

C5-5106 Target:
5'-GCATACAGTTTGCACTTATGGACTCCT-3' (SEQ ID NO: 10229)

5'-CAUACAGUUUGCACUUAUGGACUCCUG-3' (SEQ ID NO: 14850)

3'-GUAUGUCAAACGUGAAUACCUGAGGAC-5' (SEQ ID NO: 7920)

C5-5107 Target:
5'-CATACAGTTTGCACTTATGGACTCCTG-3' (SEQ ID NO: 10230)

5'-AUACAGUUUGCACUUAUGGACUCCUGU-3' (SEQ ID NO: 14851)

3'-UAUGUCAAACGUGAAUACCUGAGGACA-5' (SEQ ID NO: 7921)

C5-5108 Target:
5'-ATACAGTTTGCACTTATGGACTCCTGT-3' (SEQ ID NO: 10231)

5'-UACAGUUUGCACUUAUGGACUCCUGUU-3' (SEQ ID NO: 14852)

3'-AUGUCAAACGUGAAUACCUGAGGACAA-5' (SEQ ID NO: 7922)

TABLE 9-continued

"Blunt/Blunt" DsiRNAs Corresponding to Human Anti-C5
DsiRNAs Predicted to have >50% Knockdown Efficacy C5-5109 Target:
5'-TACAGTTTGCACTTATGGACTCCTGTT-3' (SEQ ID NO: 10232)

5'-ACAGUUUGCACUUAUGGACUCCUGUUG-3' (SEQ ID NO: 14853)

3'-UGUCAAACGUGAAUACCUGAGGACAAC-5' (SEQ ID NO: 7923)

C5-5110 Target:
5'-ACAGTTTGCACTTATGGACTCCTGTTG-3' (SEQ ID NO: 10233)

5'-CAGUUUGCACUUAUGGACUCCUGUUGU-3' (SEQ ID NO: 14854)

3'-GUCAAACGUGAAUACCUGAGGACAACA-5' (SEQ ID NO: 7924)

C5-5111 Target:
5'-CAGTTTGCACTTATGGACTCCTGTTGT-3' (SEQ ID NO: 10234)

5'-AGUUUGCACUUAUGGACUCCUGUUGUU-3' (SEQ ID NO: 14855)

3'-UCAAACGUGAAUACCUGAGGACAACAA-5' (SEQ ID NO: 7925)

C5-5112 Target:
5'-AGTTTGCACTTATGGACTCCTGTTGTT-3' (SEQ ID NO: 10235)

5'-GUUUGCACUUAUGGACUCCUGUUGUUG-3' (SEQ ID NO: 14856)

3'-CAAACGUGAAUACCUGAGGACAACAAC-5' (SEQ ID NO: 7926)

C5-5113 Target:
5'-GTTTGCACTTATGGACTCCTGTTGTTG-3' (SEQ ID NO: 10236)

5'-UUUGCACUUAUGGACUCCUGUUGUUGA-3' (SEQ ID NO: 14857)

3'-AAACGUGAAUACCUGAGGACAACAACU-5' (SEQ ID NO: 7927)

C5-5114 Target:
5'-TTTGCACTTATGGACTCCTGTTGTTGA-3' (SEQ ID NO: 10237)

5'-UUGCACUUAUGGACUCCUGUUGUUGAA-3' (SEQ ID NO: 14858)

3'-AACGUGAAUACCUGAGGACAACAACUU-5' (SEQ ID NO: 7928)

C5-5115 Target:
5'-TTGCACTTATGGACTCCTGTTGTTGAA-3' (SEQ ID NO: 10238)

5'-UGCACUUAUGGACUCCUGUUGUUGAAG-3' (SEQ ID NO: 14859)

3'-ACGUGAAUACCUGAGGACAACAACUUC-5' (SEQ ID NO: 7929)

C5-5116 Target:
5'-TGCACTTATGGACTCCTGTTGTTGAAG-3' (SEQ ID NO: 10239)

5'-GCACUUAUGGACUCCUGUUGUUGAAGU-3' (SEQ ID NO: 14860)

3'-CGUGAAUACCUGAGGACAACAACUUCA-5' (SEQ ID NO: 7930)

C5-5117 Target:
5'-GCACTTATGGACTCCTGTTGTTGAAGT-3' (SEQ ID NO: 10240)

5'-CACUUAUGGACUCCUGUUGUUGAAGUU-3' (SEQ ID NO: 14861)

3'-GUGAAUACCUGAGGACAACAACUUCAA-5' (SEQ ID NO: 7931)

C5-5118 Target:
5'-CACTTATGGACTCCTGTTGTTGAAGTT-3' (SEQ ID NO: 10241)

5'-ACUUAUGGACUCCUGUUGUUGAAGUUC-3' (SEQ ID NO: 14862)

3'-UGAAUACCUGAGGACAACAACUUCAAG-5' (SEQ ID NO: 7932)

C5-5119 Target:
5'-ACTTATGGACTCCTGTTGTTGAAGTTC-3' (SEQ ID NO: 10242)

5'-CUUAUGGACUCCUGUUGUUGAAGUUCG-3' (SEQ ID NO: 14863)

3'-GAAUACCUGAGGACAACAACUUCAAGC-5' (SEQ ID NO: 7933)

C5-5120 Target:
5'-CTTATGGACTCCTGTTGTTGAAGTTCG-3' (SEQ ID NO: 10243)

5'-UAUGGACUCCUGUUGUUGAAGUUCGUU-3' (SEQ ID NO: 14864)

3'-AUACCUGAGGACAACAACUUCAAGCAA-5' (SEQ ID NO: 7934)

C5-5122 Target:
5'-TATGGACTCCTGTTGTTGAAGTTCGTT-3' (SEQ ID NO: 10244)

5'-AUAGCUGGUCUUAUUUGUAAAGCUCAC-3' (SEQ ID NO: 14865)

3'-UAUCGACCAGAAUAAACAUUUCGAGUG-5' (SEQ ID NO: 7935)

C5-5178 Target:
5'-ATAGCTGGTCTTATTTGTAAAGCTCAC-3' (SEQ ID NO: 10245)

5'-UAGCUGGUCUUAUUUGUAAAGCUCACU-3' (SEQ ID NO: 14866)

3'-AUCGACCAGAAUAAACAUUUCGAGUGA-5' (SEQ ID NO: 7936)

C5-5179 Target:
5'-TAGCTGGTCTTATTTGTAAAGCTCACT-3' (SEQ ID NO: 10246)

5'-AGCUGGUCUUAUUUGUAAAGCUCACUU-3' (SEQ ID NO: 14867)

3'-UCGACCAGAAUAAACAUUUCGAGUGAA-5' (SEQ ID NO: 7937)

C5-5180 Target:
5'-AGCTGGTCTTATTTGTAAAGCTCACTT-3' (SEQ ID NO: 10247)

5'-GCUGGUCUUAUUUGUAAAGCUCACUUU-3' (SEQ ID NO: 14868)

3'-CGACCAGAAUAAACAUUUCGAGUGAAA-5' (SEQ ID NO: 7938)

C5-5181 Target:
5'-GCTGGTCTTATTTGTAAAGCTCACTTT-3' (SEQ ID NO: 10248)

5'-CUGGUCUUAUUUGUAAAGCUCACUUUA-3' (SEQ ID NO: 14869)

3'-GACCAGAAUAAACAUUUCGAGUGAAAU-5' (SEQ ID NO: 7939)

C5-5182 Target:
5'-CTGGTCTTATTTGTAAAGCTCACTTTA-3' (SEQ ID NO: 10249)

5'-UGGUCUUAUUUGUAAAGCUCACUUUAC-3' (SEQ ID NO: 14870)

3'-ACCAGAAUAAACAUUUCGAGUGAAAUG-5' (SEQ ID NO: 7940)

C5-5183 Target:
5'-TGGTCTTATTTGTAAAGCTCACTTTAC-3' (SEQ ID NO: 10250)

5'-GGUCUUAUUUGUAAAGCUCACUUUACU-3' (SEQ ID NO: 14871)

3'-CCAGAAUAAACAUUUCGAGUGAAAUGA-5' (SEQ ID NO: 7941)

C5-5184 Target:
5'-GGTCTTATTTGTAAAGCTCACTTTACT-3' (SEQ ID NO: 10251)

5'-GUCUUAUUUGUAAAGCUCACUUUACUU-3' (SEQ ID NO: 14872)

3'-CAGAAUAAACAUUUCGAGUGAAAUGAA-5' (SEQ ID NO: 7942)

TABLE 9-continued

"Blunt/Blunt" DsiRNAs Corresponding to Human Anti-C5
DsiRNAs Predicted to have >50% Knockdown Efficacy C5-5185 Target:
5'-GTCTTATTTGTAAAGCTCACTTTACTT-3' (SEQ ID NO: 10252)

5'-UCUUAUUUGUAAAGCUCACUUUACUUA-3' (SEQ ID NO: 14873)

3'-AGAAUAAACAUUUCGAGUGAAAUGAAU-5' (SEQ ID NO: 7943)

C5-5186 Target:
5'-TCTTATTTGTAAAGCTCACTTTACTTA-3' (SEQ ID NO: 10253)

5'-CUUAUUUGUAAAGCUCACUUUACUUAG-3' (SEQ ID NO: 14874)

3'-GAAUAAACAUUUCGAGUGAAAUGAAUC-5' (SEQ ID NO: 7944)

C5-5187 Target:
5'-CTTATTTGTAAAGCTCACTTTACTTAG-3' (SEQ ID NO: 10254)

5'-UUAUUUGUAAAGCUCACUUUACUUAGA-3' (SEQ ID NO: 14875)

3'-AAUAAACAUUUCGAGUGAAAUGAAUCU-5' (SEQ ID NO: 7945)

C5-5188 Target:
5'-TTATTTGTAAAGCTCACTTTACTTAGA-3' (SEQ ID NO: 10255)

5'-UAUUUGUAAAGCUCACUUUACUUAGAA-3' (SEQ ID NO: 14876)

3'-AUAAACAUUUCGAGUGAAAUGAAUCUU-5' (SEQ ID NO: 7946)

C5-5189 Target:
5'-TATTTGTAAAGCTCACTTTACTTAGAA-3' (SEQ ID NO: 10256)

5'-AUUUGUAAAGCUCACUUUACUUAGAAU-3' (SEQ ID NO: 14877)

3'-UAAACAUUUCGAGUGAAAUGAAUCUUA-5' (SEQ ID NO: 7947)

C5-5190 Target:
5'-ATTTGTAAAGCTCACTTTACTTAGAAT-3' (SEQ ID NO: 10257)

5'-UUUGUAAAGCUCACUUUACUUAGAAUU-3' (SEQ ID NO: 14878)

3'-AAACAUUUCGAGUGAAAUGAAUCUUAA-5' (SEQ ID NO: 7948)

C5-5191 Target:
5'-TTTGTAAAGCTCACTTTACTTAGAATT-3' (SEQ ID NO: 10258)

5'-UUGUAAAGCUCACUUUACUUAGAAUUA-3' (SEQ ID NO: 14879)

3'-AACAUUUCGAGUGAAAUGAAUCUUAAU-5' (SEQ ID NO: 7949)

C5-5192 Target:
5'-TTGTAAAGCTCACTTTACTTAGAATTA-3' (SEQ ID NO: 10259)

5'-UGUAAAGCUCACUUUACUUAGAAUUAG-3' (SEQ ID NO: 14880)

3'-ACAUUUCGAGUGAAAUGAAUCUUAAUC-5' (SEQ ID NO: 7950)

C5-5193 Target:
5'-TGTAAAGCTCACTTTACTTAGAATTAG-3' (SEQ ID NO: 10260)

5'-GUAAAGCUCACUUUACUUAGAAUUAGU-3' (SEQ ID NO: 14881)

3'-CAUUUCGAGUGAAAUGAAUCUUAAUCA-5' (SEQ ID NO: 7951)

C5-5194 Target:
5'-GTAAAGCTCACTTTACTTAGAATTAGT-3' (SEQ ID NO: 10261)

5'-UAAAGCUCACUUUACUUAGAAUUAGUG-3' (SEQ ID NO: 14882)

3'-AUUUCGAGUGAAAUGAAUCUUAAUCAC-5' (SEQ ID NO: 7952)

C5-5195 Target:
5'-TAAAGCTCACTTTACTTAGAATTAGTG-3' (SEQ ID NO: 10262)

5'-AAAGCUCACUUUACUUAGAAUUAGUGG-3' (SEQ ID NO: 14883)

3'-UUUCGAGUGAAAUGAAUCUUAAUCACC-5' (SEQ ID NO: 7953)

C5-5196 Target:
5'-AAAGCTCACTTTACTTAGAATTAGTGG-3' (SEQ ID NO: 10263)

5'-AAGCUCACUUUACUUAGAAUUAGUGGC-3' (SEQ ID NO: 14884)

3'-UUCGAGUGAAAUGAAUCUUAAUCACCG-5' (SEQ ID NO: 7954)

C5-5197 Target:
5'-AAGCTCACTTTACTTAGAATTAGTGGC-3' (SEQ ID NO: 10264)

5'-AGCUCACUUUACUUAGAAUUAGUGGCA-3' (SEQ ID NO: 14885)

3'-UCGAGUGAAAUGAAUCUUAAUCACCGU-5' (SEQ ID NO: 7955)

C5-5198 Target:
5'-AGCTCACTTTACTTAGAATTAGTGGCA-3' (SEQ ID NO: 10265)

5'-GCUCACUUUACUUAGAAUUAGUGGCAC-3' (SEQ ID NO: 14886)

3'-CGAGUGAAAUGAAUCUUAAUCACCGUG-5' (SEQ ID NO: 7956)

C5-5199 Target:
5'-GCTCACTTTACTTAGAATTAGTGGCAC-3' (SEQ ID NO: 10266)

5'-CUCACUUUACUUAGAAUUAGUGGCACU-3' (SEQ ID NO: 14887)

3'-GAGUGAAAUGAAUCUUAAUCACCGUGA-5' (SEQ ID NO: 7957)

C5-5200 Target:
5'-CTCACTTTACTTAGAATTAGTGGCACT-3' (SEQ ID NO: 10267)

5'-UCACUUUACUUAGAAUUAGUGGCACUU-3' (SEQ ID NO: 14888)

3'-AGUGAAAUGAAUCUUAAUCACCGUGAA-5' (SEQ ID NO: 7958)

C5-5201 Target:
5'-TCACTTTACTTAGAATTAGTGGCACTT-3' (SEQ ID NO: 10268)

5'-CACUUUACUUAGAAUUAGUGGCACUUG-3' (SEQ ID NO: 14889)

3'-GUGAAAUGAAUCUUAAUCACCGUGAAC-5' (SEQ ID NO: 7959)

C5-5202 Target:
5'-CACTTTACTTAGAATTAGTGGCACTTG-3' (SEQ ID NO: 10269)

5'-ACUUUACUUAGAAUUAGUGGCACUUGC-3' (SEQ ID NO: 14890)

3'-UGAAAUGAAUCUUAAUCACCGUGAACG-5' (SEQ ID NO: 7960)

C5-5203 Target:
5'-ACTTTACTTAGAATTAGTGGCACTTGC-3' (SEQ ID NO: 10270)

5'-CUUUACUUAGAAUUAGUGGCACUUGCU-3' (SEQ ID NO: 14891)

3'-GAAAUGAAUCUUAAUCACCGUGAACGA-5' (SEQ ID NO: 7961)

C5-5204 Target:
5'-CTTTACTTAGAATTAGTGGCACTTGCT-3' (SEQ ID NO: 10271)

5'-UUUACUUAGAAUUAGUGGCACUUGCUU-3' (SEQ ID NO: 14892)

3'-AAAUGAAUCUUAAUCACCGUGAACGAA-5' (SEQ ID NO: 7962)

TABLE 9-continued

"Blunt/Blunt" DsiRNAs Corresponding to Human Anti-C5 DsiRNAs Predicted to have >50% Knockdown Efficacy C5-5205 Target:
5'-TTTACTTAGAATTAGTGGCACTTGCTT-3' (SEQ ID NO: 10272)

5'-UUACUUAGAAUUAGUGGCACUUGCUUU-3' (SEQ ID NO: 14893)

3'-AAUGAAUCUUAAUCACCGUGAACGAAA-5' (SEQ ID NO: 7963)

C5-5206 Target:
5'-TTACTTAGAATTAGTGGCACTTGCTTT-3' (SEQ ID NO: 10273)

5'-UACUUAGAAUUAGUGGCACUUGCUUUU-3' (SEQ ID NO: 14894)

3'-AUGAAUCUUAAUCACCGUGAACGAAAA-5' (SEQ ID NO: 7964)

C5-5207 Target:
5'-TACTTAGAATTAGTGGCACTTGCTTTT-3' (SEQ ID NO: 10274)

5'-ACUUAGAAUUAGUGGCACUUGCUUUUA-3' (SEQ ID NO: 14895)

3'-UGAAUCUUAAUCACCGUGAACGAAAAU-5' (SEQ ID NO: 7965)

C5-5208 Target:
5'-ACTTAGAATTAGTGGCACTTGCTTTTA-3' (SEQ ID NO: 10275)

5'-CUUAGAAUUAGUGGCACUUGCUUUUAU-3' (SEQ ID NO: 14896)

3'-GAAUCUUAAUCACCGUGAACGAAAAUA-5' (SEQ ID NO: 7966)

C5-5209 Target:
5'-CTTAGAATTAGTGGCACTTGCTTTTAT-3' (SEQ ID NO: 10276)

5'-UUAGAAUUAGUGGCACUUGCUUUUAUU-3' (SEQ ID NO: 14897)

3'-AAUCUUAAUCACCGUGAACGAAAAUAA-5' (SEQ ID NO: 7967)

C5-5210 Target:
5'-TTAGAATTAGTGGCACTTGCTTTTATT-3' (SEQ ID NO: 10277)

5'-UAGAAUUAGUGGCACUUGCUUUUAUUA-3' (SEQ ID NO: 14898)

3'-AUCUUAAUCACCGUGAACGAAAAUAAU-5' (SEQ ID NO: 7968)

C5-5211 Target:
5'-TAGAATTAGTGGCACTTGCTTTTATTA-3' (SEQ ID NO: 10278)

5'-AGAAUUAGUGGCACUUGCUUUUAUUAG-3' (SEQ ID NO: 14899)

3'-UCUUAAUCACCGUGAACGAAAAUAAUC-5' (SEQ ID NO: 7969)

C5-5212 Target:
5'-AGAATTAGTGGCACTTGCTTTTATTAG-3' (SEQ ID NO: 10279)

5'-GAAUUAGUGGCACUUGCUUUUAUUAGA-3' (SEQ ID NO: 14900)

3'-CUUAAUCACCGUGAACGAAAAUAAUCU-5' (SEQ ID NO: 7970)

C5-5213 Target:
5'-GAATTAGTGGCACTTGCTTTTATTAGA-3' (SEQ ID NO: 10280)

5'-AAUUAGUGGCACUUGCUUUUAUUAGAG-3' (SEQ ID NO: 14901)

3'-UUAAUCACCGUGAACGAAAAUAAUCUC-5' (SEQ ID NO: 7971)

C5-5214 Target:
5'-AATTAGTGGCACTTGCTTTTATTAGAG-3' (SEQ ID NO: 10281)

5'-AUUAGUGGCACUUGCUUUUAUUAGAGA-3' (SEQ ID NO: 14902)

3'-UAAUCACCGUGAACGAAAAUAAUCUCU-5' (SEQ ID NO: 7972)

C5-5215 Target:
5'-ATTAGTGGCACTTGCTTTTATTAGAGA-3' (SEQ ID NO: 10282)

5'-UUAGUGGCACUUGCUUUUAUUAGAGAA-3' (SEQ ID NO: 14903)

3'-AAUCACCGUGAACGAAAAUAAUCUCUU-5' (SEQ ID NO: 7973)

C5-5216 Target:
5'-TTAGTGGCACTTGCTTTTATTAGAGAA-3' (SEQ ID NO: 10283)

5'-UAGUGGCACUUGCUUUUAUUAGAGAAU-3' (SEQ ID NO: 14904)

3'-AUCACCGUGAACGAAAAUAAUCUCUUA-5' (SEQ ID NO: 7974)

C5-5217 Target:
5'-TAGTGGCACTTGCTTTTATTAGAGAAT-3' (SEQ ID NO: 10284)

5'-AGUGGCACUUGCUUUUAUUAGAGAAUG-3' (SEQ ID NO: 14905)

3'-UCACCGUGAACGAAAAUAAUCUCUUAC-5' (SEQ ID NO: 7975)

C5-5218 Target:
5'-AGTGGCACTTGCTTTTATTAGAGAATG-3' (SEQ ID NO: 10285)

5'-GUGGCACUUGCUUUUAUUAGAGAAUGA-3' (SEQ ID NO: 14906)

3'-CACCGUGAACGAAAAUAAUCUCUUACU-5' (SEQ ID NO: 7976)

C5-5219 Target:
5'-GTGGCACTTGCTTTTATTAGAGAATGA-3' (SEQ ID NO: 10286)

5'-UGGCACUUGCUUUUAUUAGAGAAUGAU-3' (SEQ ID NO: 14907)

3'-ACCGUGAACGAAAAUAAUCUCUUACUA-5' (SEQ ID NO: 7977)

C5-5220 Target:
5'-TGGCACTTGCTTTTATTAGAGAATGAT-3' (SEQ ID NO: 10287)

5'-GGCACUUGCUUUUAUUAGAGAAUGAUU-3' (SEQ ID NO: 14908)

3'-CCGUGAACGAAAAUAAUCUCUUACUAA-5' (SEQ ID NO: 7978)

C5-5221 Target:
5'-GGCACTTGCTTTTATTAGAGAATGATT-3' (SEQ ID NO: 10288)

5'-GCACUUGCUUUUAUUAGAGAAUGAUUU-3' (SEQ ID NO: 14909)

3'-CGUGAACGAAAAUAAUCUCUUACUAAA-5' (SEQ ID NO: 7979)

C5-5222 Target:
5'-GCACTTGCTTTTATTAGAGAATGATTT-3' (SEQ ID NO: 10289)

5'-CACUUGCUUUUAUUAGAGAAUGAUUUC-3' (SEQ ID NO: 14910)

3'-GUGAACGAAAAUAAUCUCUUACUAAAG-5' (SEQ ID NO: 7980)

C5-5223 Target:
5'-CACTTGCTTTTATTAGAGAATGATTTC-3' (SEQ ID NO: 10290)

5'-GCUUUUAUUAGAGAAUGAUUUCAAAUG-3' (SEQ ID NO: 14911)

3'-CGAAAAUAAUCUCUUACUAAAGUUUAC-5' (SEQ ID NO: 7981)

C5-5228 Target:
5'-GCTTTTATTAGAGAATGATTTCAAATG-3' (SEQ ID NO: 10291)

5'-AUGCUGUAACUUUCUGAAAUAACAUGG-3' (SEQ ID NO: 14912)

3'-UACGACAUUGAAAGACUUUAUUGUACC-5' (SEQ ID NO: 7982)

TABLE 9-continued

"Blunt/Blunt" DsiRNAs Corresponding to Human Anti-C5 DsiRNAs Predicted to have >50% Knockdown Efficacy C5-5252 Target:
5'-ATGCTGTAACTTTCTGAAATAACATGG-3' (SEQ ID NO: 10292)

5'-UGCUGUAACUUUCUGAAAUAACAUGGC-3' (SEQ ID NO: 14913)

3'-ACGACAUUGAAAGACUUUAUUGUACCG-5' (SEQ ID NO: 7983)

C5-5253 Target:
5'-TGCTGTAACTTTCTGAAATAACATGGC-3' (SEQ ID NO: 10293)

5'-GCUGUAACUUUCUGAAAUAACAUGGCC-3' (SEQ ID NO: 14914)

3'-CGACAUUGAAAGACUUUAUUGUACCGG-5' (SEQ ID NO: 7984)

C5-5254 Target:
5'-GCTGTAACTTTCTGAAATAACATGGCC-3' (SEQ ID NO: 10294)

5'-CUGUAACUUUCUGAAAUAACAUGGCCU-3' (SEQ ID NO: 14915)

3'-GACAUUGAAAGACUUUAUUGUACCGGA-5' (SEQ ID NO: 7985)

C5-5255 Target:
5'-CTGTAACTTTCTGAAATAACATGGCCT-3' (SEQ ID NO: 10295)

5'-UGUAACUUUCUGAAAUAACAUGGCCUU-3' (SEQ ID NO: 14916)

3'-ACAUUGAAAGACUUUAUUGUACCGGAA-5' (SEQ ID NO: 7986)

C5-5256 Target:
5'-TGTAACTTTCTGAAATAACATGGCCTT-3' (SEQ ID NO: 10296)

5'-GUAACUUUCUGAAAUAACAUGGCCUUG-3' (SEQ ID NO: 14917)

3'-CAUUGAAAGACUUUAUUGUACCGGAAC-5' (SEQ ID NO: 7987)

C5-5257 Target:
5'-GTAACTTTCTGAAATAACATGGCCTTG-3' (SEQ ID NO: 10297)

5'-UAACUUUCUGAAAUAACAUGGCCUUGG-3' (SEQ ID NO: 14918)

3'-AUUGAAAGACUUUAUUGUACCGGAACC-5' (SEQ ID NO: 7988)

C5-5258 Target:
5'-TAACTTTCTGAAATAACATGGCCTTGG-3' (SEQ ID NO: 10298)

5'-AACUUUCUGAAAUAACAUGGCCUUGGA-3' (SEQ ID NO: 14919)

3'-UUGAAAGACUUUAUUGUACCGGAACCU-5' (SEQ ID NO: 7989)

C5-5259 Target:
5'-AACTTTCTGAAATAACATGGCCTTGGA-3' (SEQ ID NO: 10299)

5'-ACUUUCUGAAAUAACAUGGCCUUGGAG-3' (SEQ ID NO: 14920)

3'-UGAAAGACUUUAUUGUACCGGAACCUC-5' (SEQ ID NO: 7990)

C5-5260 Target:
5'-ACTTTCTGAAATAACATGGCCTTGGAG-3' (SEQ ID NO: 10300)

5'-CUUUCUGAAAUAACAUGGCCUUGGAGG-3' (SEQ ID NO: 14921)

3'-GAAAGACUUUAUUGUACCGGAACCUCC-5' (SEQ ID NO: 7991)

C5-5261 Target:
5'-CTTTCTGAAATAACATGGCCTTGGAGG-3' (SEQ ID NO: 10301)

5'-UUUCUGAAAUAACAUGGCCUUGGAGGG-3' (SEQ ID NO: 14922)

3'-AAAGACUUUAUUGUACCGGAACCUCCC-5' (SEQ ID NO: 7992)

C5-5262 Target:
5'-TTTCTGAAATAACATGGCCTTGGAGGG-3' (SEQ ID NO: 10302)

5'-UUCUGAAAUAACAUGGCCUUGGAGGGC-3' (SEQ ID NO: 14923)

3'-AAGACUUUAUUGUACCGGAACCUCCCG-5' (SEQ ID NO: 7993)

C5-5263 Target:
5'-TTCTGAAATAACATGGCCTTGGAGGGC-3' (SEQ ID NO: 10303)

5'-UCUGAAAUAACAUGGCCUUGGAGGGCA-3' (SEQ ID NO: 14924)

3'-AGACUUUAUUGUACCGGAACCUCCCGU-5' (SEQ ID NO: 7994)

C5-5264 Target:
5'-TCTGAAATAACATGGCCTTGGAGGGCA-3' (SEQ ID NO: 10304)

5'-CUGAAAUAACAUGGCCUUGGAGGGCAU-3' (SEQ ID NO: 14925)

3'-GACUUUAUUGUACCGGAACCUCCCGUA-5' (SEQ ID NO: 7995)

C5-5265 Target:
5'-CTGAAATAACATGGCCTTGGAGGGCAT-3' (SEQ ID NO: 10305)

5'-UGAAAUAACAUGGCCUUGGAGGGCAUG-3' (SEQ ID NO: 14926)

3'-ACUUUAUUGUACCGGAACCUCCCGUAC-5' (SEQ ID NO: 7996)

C5-5266 Target:
5'-TGAAATAACATGGCCTTGGAGGGCATG-3' (SEQ ID NO: 10306)

5'-GAAAUAACAUGGCCUUGGAGGGCAUGA-3' (SEQ ID NO: 14927)

3'-CUUUAUUGUACCGGAACCUCCCGUACU-5' (SEQ ID NO: 7997)

C5-5267 Target:
5'-GAAATAACATGGCCTTGGAGGGCATGA-3' (SEQ ID NO: 10307)

5'-AAAUAACAUGGCCUUGGAGGGCAUGAA-3' (SEQ ID NO: 14928)

3'-UUUAUUGUACCGGAACCUCCCGUACUU-5' (SEQ ID NO: 7998)

C5-5268 Target:
5'-AAATAACATGGCCTTGGAGGGCATGAA-3' (SEQ ID NO: 10308)

5'-AAUAACAUGGCCUUGGAGGGCAUGAAG-3' (SEQ ID NO: 14929)

3'-UUAUUGUACCGGAACCUCCCGUACUUC-5' (SEQ ID NO: 7999)

C5-5269 Target:
5'-AATAACATGGCCTTGGAGGGCATGAAG-3' (SEQ ID NO: 10309)

5'-AUAACAUGGCCUUGGAGGGCAUGAAGA-3' (SEQ ID NO: 14930)

3'-UAUUGUACCGGAACCUCCCGUACUUCU-5' (SEQ ID NO: 8000)

C5-5270 Target:
5'-ATAACATGGCCTTGGAGGGCATGAAGA-3' (SEQ ID NO: 10310)

5'-UAACAUGGCCUUGGAGGGCAUGAAGAC-3' (SEQ ID NO: 14931)

3'-AUUGUACCGGAACCUCCCGUACUUCUG-5' (SEQ ID NO: 8001)

C5-5271 Target:
5'-TAACATGGCCTTGGAGGGCATGAAGAC-3' (SEQ ID NO: 10311)

5'-AACAUGGCCUUGGAGGGCAUGAAGACA-3' (SEQ ID NO: 14932)

3'-UUGUACCGGAACCUCCCGUACUUCUGU-5' (SEQ ID NO: 8002)

TABLE 9-continued

"Blunt/Blunt" DsiRNAs Corresponding to Human Anti-C5
DsiRNAs Predicted to have >50% Knockdown Efficacy C5-5272 Target:
5'-AACATGGCCTTGGAGGGCATGAAGACA-3' (SEQ ID NO: 10312)

5'-ACAUGGCCUUGGAGGGCAUGAAGACAG-3' (SEQ ID NO: 14933)

3'-UGUACCGGAACCUCCCGUACUUCUGUC-5' (SEQ ID NO: 8003)

C5-5273 Target:
5'-ACATGGCCTTGGAGGGCATGAAGACAG-3' (SEQ ID NO: 10313)

5'-CAUGGCCUUGGAGGGCAUGAAGACAGA-3' (SEQ ID NO: 14934)

3'-GUACCGGAACCUCCCGUACUUCUGUCU-5' (SEQ ID NO: 8004)

C5-5274 Target:
5'-CATGGCCTTGGAGGGCATGAAGACAGA-3' (SEQ ID NO: 10314)

5'-AUGGCCUUGGAGGGCAUGAAGACAGAU-3' (SEQ ID NO: 14935)

3'-UACCGGAACCUCCCGUACUUCUGUCUA-5' (SEQ ID NO: 8005)

C5-5275 Target:
5'-ATGGCCTTGGAGGGCATGAAGACAGAT-3' (SEQ ID NO: 10315)

5'-UGGCCUUGGAGGGCAUGAAGACAGAUA-3' (SEQ ID NO: 14936)

3'-ACCGGAACCUCCCGUACUUCUGUCUAU-5' (SEQ ID NO: 8006)

C5-5276 Target:
5'-TGGCCTTGGAGGGCATGAAGACAGATA-3' (SEQ ID NO: 10316)

5'-GGCCUUGGAGGGCAUGAAGACAGAUAC-3' (SEQ ID NO: 14937)

3'-CCGGAACCUCCCGUACUUCUGUCUAUG-5' (SEQ ID NO: 8007)

C5-5277 Target:
5'-GGCCTTGGAGGGCATGAAGACAGATAC-3' (SEQ ID NO: 10317)

5'-GCCUUGGAGGGCAUGAAGACAGAUACU-3' (SEQ ID NO: 14938)

3'-CGGAACCUCCCGUACUUCUGUCUAUGA-5' (SEQ ID NO: 8008)

C5-5278 Target:
5'-GCCTTGGAGGGCATGAAGACAGATACT-3' (SEQ ID NO: 10318)

5'-CCUUGGAGGGCAUGAAGACAGAUACUC-3' (SEQ ID NO: 14939)

3'-GGAACCUCCCGUACUUCUGUCUAUGAG-5' (SEQ ID NO: 8009)

C5-5279 Target:
5'-CCTTGGAGGGCATGAAGACAGATACTC-3' (SEQ ID NO: 10319)

5'-CUUGGAGGGCAUGAAGACAGAUACUCC-3' (SEQ ID NO: 14940)

3'-GAACCUCCCGUACUUCUGUCUAUGAGG-5' (SEQ ID NO: 8010)

C5-5280 Target:
5'-CTTGGAGGGCATGAAGACAGATACTCC-3' (SEQ ID NO: 10320)

5'-UUGGAGGGCAUGAAGACAGAUACUCCU-3' (SEQ ID NO: 14941)

3'-AACCUCCCGUACUUCUGUCUAUGAGGA-5' (SEQ ID NO: 8011)

C5-5281 Target:
5'-TTGGAGGGCATGAAGACAGATACTCCT-3' (SEQ ID NO: 10321)

5'-UGGAGGGCAUGAAGACAGAUACUCCUC-3' (SEQ ID NO: 14942)

3'-ACCUCCCGUACUUCUGUCUAUGAGGAG-5' (SEQ ID NO: 8012)

C5-5282 Target:
5'-TGGAGGGCATGAAGACAGATACTCCTC-3' (SEQ ID NO: 10322)

5'-GGAGGGCAUGAAGACAGAUACUCCUCC-3' (SEQ ID NO: 14943)

3'-CCUCCCGUACUUCUGUCUAUGAGGAGG-5' (SEQ ID NO: 8013)

C5-5283 Target:
5'-GGAGGGCATGAAGACAGATACTCCTCC-3' (SEQ ID NO: 10323)

5'-GAGGGCAUGAAGACAGAUACUCCUCCA-3' (SEQ ID NO: 14944)

3'-CUCCCGUACUUCUGUCUAUGAGGAGGU-5' (SEQ ID NO: 8014)

C5-5284 Target:
5'-GAGGGCATGAAGACAGATACTCCTCCA-3' (SEQ ID NO: 10324)

5'-AGGGCAUGAAGACAGAUACUCCUCCAA-3' (SEQ ID NO: 14945)

3'-UCCCGUACUUCUGUCUAUGAGGAGGUU-5' (SEQ ID NO: 8015)

C5-5285 Target:
5'-AGGGCATGAAGACAGATACTCCTCCAA-3' (SEQ ID NO: 10325)

5'-GGGCAUGAAGACAGAUACUCCUCCAAG-3' (SEQ ID NO: 14946)

3'-CCCGUACUUCUGUCUAUGAGGAGGUUC-5' (SEQ ID NO: 8016)

C5-5286 Target:
5'-GGGCATGAAGACAGATACTCCTCCAAG-3' (SEQ ID NO: 10326)

5'-GGCAUGAAGACAGAUACUCCUCCAAGG-3' (SEQ ID NO: 14947)

3'-CCGUACUUCUGUCUAUGAGGAGGUUCC-5' (SEQ ID NO: 8017)

C5-5287 Target:
5'-GGCATGAAGACAGATACTCCTCCAAGG-3' (SEQ ID NO: 10327)

5'-GCAUGAAGACAGAUACUCCUCCAAGGU-3' (SEQ ID NO: 14948)

3'-CGUACUUCUGUCUAUGAGGAGGUUCCA-5' (SEQ ID NO: 8018)

C5-5288 Target:
5'-GCATGAAGACAGATACTCCTCCAAGGT-3' (SEQ ID NO: 10328)

5'-CAUGAAGACAGAUACUCCUCCAAGGUU-3' (SEQ ID NO: 14949)

3'-GUACUUCUGUCUAUGAGGAGGUUCCAA-5' (SEQ ID NO: 8019)

C5-5289 Target:
5'-CATGAAGACAGATACTCCTCCAAGGTT-3' (SEQ ID NO: 10329)

5'-AUGAAGACAGAUACUCCUCCAAGGUUA-3' (SEQ ID NO: 14950)

3'-UACUUCUGUCUAUGAGGAGGUUCCAAU-5' (SEQ ID NO: 8020)

C5-5290 Target:
5'-ATGAAGACAGATACTCCTCCAAGGTTA-3' (SEQ ID NO: 10330)

5'-UGAAGACAGAUACUCCUCCAAGGUUAU-3' (SEQ ID NO: 14951)

3'-ACUUCUGUCUAUGAGGAGGUUCCAAUA-5' (SEQ ID NO: 8021)

C5-5291 Target:
5'-TGAAGACAGATACTCCTCCAAGGTTAT-3' (SEQ ID NO: 10331)

5'-GAAGACAGAUACUCCUCCAAGGUUAUU-3' (SEQ ID NO: 14952)

3'-CUUCUGUCUAUGAGGAGGUUCCAAUAA-5' (SEQ ID NO: 8022)

TABLE 9-continued

"Blunt/Blunt" DsiRNAs Corresponding to Human Anti-C5 DsiRNAs Predicted to have >50% Knockdown Efficacy C5-5292 Target:
5'-GAAGACAGATACTCCTCCAAGGTTATT-3' (SEQ ID NO: 10332)

5'-AAGACAGAUACUCCUCCAAGGUUAUUG-3' (SEQ ID NO: 14953)

3'-UUCUGUCUAUGAGGAGGUUCCAAUAAC-5' (SEQ ID NO: 8023)

C5-5293 Target:
5'-AAGACAGATACTCCTCCAAGGTTATTG-3' (SEQ ID NO: 10333)

5'-AGACAGAUACUCCUCCAAGGUUAUUGG-3' (SEQ ID NO: 14954)

3'-UCUGUCUAUGAGGAGGUUCCAAUAACC-5' (SEQ ID NO: 8024)

C5-5294 Target:
5'-AGACAGATACTCCTCCAAGGTTATTGG-3' (SEQ ID NO: 10334)

5'-ACAGAUACUCCUCCAAGGUUAUUGGAC-3' (SEQ ID NO: 14955)

3'-UGUCUAUGAGGAGGUUCCAAUAACCUG-5' (SEQ ID NO: 8025)

C5-5296 Target:
5'-ACAGATACTCCTCCAAGGTTATTGGAC-3' (SEQ ID NO: 10335)

5'-CAGAUACUCCUCCAAGGUUAUUGGACA-3' (SEQ ID NO: 14956)

3'-GUCUAUGAGGAGGUUCCAAUAACCUGU-5' (SEQ ID NO: 8026)

C5-5297 Target:
5'-CAGATACTCCTCCAAGGTTATTGGACA-3' (SEQ ID NO: 10336)

5'-AGAUACUCCUCCAAGGUUAUUGGACAC-3' (SEQ ID NO: 14957)

3'-UCUAUGAGGAGGUUCCAAUAACCUGUG-5' (SEQ ID NO: 8027)

C5-5298 Target:
5'-AGATACTCCTCCAAGGTTATTGGACAC-3' (SEQ ID NO: 10337)

5'-GAUACUCCUCCAAGGUUAUUGGACACC-3' (SEQ ID NO: 14958)

3'-CUAUGAGGAGGUUCCAAUAACCUGUGG-5' (SEQ ID NO: 8028)

C5-5299 Target:
5'-GATACTCCTCCAAGGTTATTGGACACC-3' (SEQ ID NO: 10338)

5'-AUACUCCUCCAAGGUUAUUGGACACCG-3' (SEQ ID NO: 14959)

3'-UAUGAGGAGGUUCCAAUAACCUGUGGC-5' (SEQ ID NO: 8029)

C5-5300 Target:
5'-ATACTCCTCCAAGGTTATTGGACACCG-3' (SEQ ID NO: 10339)

5'-UACUCCUCCAAGGUUAUUGGACACCGG-3' (SEQ ID NO: 14960)

3'-AUGAGGAGGUUCCAAUAACCUGUGGCC-5' (SEQ ID NO: 8030)

C5-5301 Target:
5'-TACTCCTCCAAGGTTATTGGACACCGG-3' (SEQ ID NO: 10340)

5'-ACUCCUCCAAGGUUAUUGGACACCGGA-3' (SEQ ID NO: 14961)

3'-UGAGGAGGUUCCAAUAACCUGUGGCCU-5' (SEQ ID NO: 8031)

C5-5302 Target:
5'-ACTCCTCCAAGGTTATTGGACACCGGA-3' (SEQ ID NO: 10341)

5'-CUCCUCCAAGGUUAUUGGACACCGGAA-3' (SEQ ID NO: 14962)

3'-GAGGAGGUUCCAAUAACCUGUGGCCUU-5' (SEQ ID NO: 8032)

C5-5303 Target:
5'-CTCCTCCAAGGTTATTGGACACCGGAA-3' (SEQ ID NO: 10342)

5'-UCCUCCAAGGUUAUUGGACACCGGAAA-3' (SEQ ID NO: 14963)

3'-AGGAGGUUCCAAUAACCUGUGGCCUUU-5' (SEQ ID NO: 8033)

C5-5304 Target:
5'-TCCTCCAAGGTTATTGGACACCGGAAA-3' (SEQ ID NO: 10343)

5'-CCUCCAAGGUUAUUGGACACCGGAAAC-3' (SEQ ID NO: 14964)

3'-GGAGGUUCCAAUAACCUGUGGCCUUUG-5' (SEQ ID NO: 8034)

C5-5305 Target:
5'-CCTCCAAGGTTATTGGACACCGGAAAC-3' (SEQ ID NO: 10344)

5'-CUCCAAGGUUAUUGGACACCGGAAACA-3' (SEQ ID NO: 14965)

3'-GAGGUUCCAAUAACCUGUGGCCUUUGU-5' (SEQ ID NO: 8035)

C5-5306 Target:
5'-CTCCAAGGTTATTGGACACCGGAAACA-3' (SEQ ID NO: 10345)

5'-UCCAAGGUUAUUGGACACCGGAAACAA-3' (SEQ ID NO: 14966)

3'-AGGUUCCAAUAACCUGUGGCCUUUGUU-5' (SEQ ID NO: 8036)

C5-5307 Target:
5'-TCCAAGGTTATTGGACACCGGAAACAA-3' (SEQ ID NO: 10346)

5'-CCAAGGUUAUUGGACACCGGAAACAAU-3' (SEQ ID NO: 14967)

3'-GGUUCCAAUAACCUGUGGCCUUUGUUA-5' (SEQ ID NO: 8037)

C5-5308 Target:
5'-CCAAGGTTATTGGACACCGGAAACAAT-3' (SEQ ID NO: 10347)

5'-CAAGGUUAUUGGACACCGGAAACAAUA-3' (SEQ ID NO: 14968)

3'-GUUCCAAUAACCUGUGGCCUUUGUUAU-5' (SEQ ID NO: 8038)

C5-5309 Target:
5'-CAAGGTTATTGGACACCGGAAACAATA-3' (SEQ ID NO: 10348)

5'-AAGGUUAUUGGACACCGGAAACAAUAA-3' (SEQ ID NO: 14969)

3'-UUCCAAUAACCUGUGGCCUUUGUUAUU-5' (SEQ ID NO: 8039)

C5-5310 Target:
5'-AAGGTTATTGGACACCGGAAACAATAA-3' (SEQ ID NO: 10349)

5'-AGGUUAUUGGACACCGGAAACAAUAAA-3' (SEQ ID NO: 14970)

3'-UCCAAUAACCUGUGGCCUUUGUUAUUU-5' (SEQ ID NO: 8040)

C5-5311 Target:
5'-AGGTTATTGGACACCGGAAACAATAAA-3' (SEQ ID NO: 10350)

5'-GGUUAUUGGACACCGGAAACAAUAAAU-3' (SEQ ID NO: 14971)

3'-CCAAUAACCUGUGGCCUUUGUUAUUUA-5' (SEQ ID NO: 8041)

C5-5312 Target:
5'-GGTTATTGGACACCGGAAACAATAAAT-3' (SEQ ID NO: 10351)

5'-GUUAUUGGACACCGGAAACAAUAAAUU-3' (SEQ ID NO: 14972)

3'-CAAUAACCUGUGGCCUUUGUUAUUUAA-5' (SEQ ID NO: 8042)

TABLE 9-continued

"Blunt/Blunt" DsiRNAs Corresponding to Human Anti-C5 DsiRNAs Predicted to have >50% Knockdown Efficacy C5-5313 Target:
5'-GTTATTGGACACCGGAAACAATAAATT-3' (SEQ ID NO: 10352)

5'-UUAUUGGACACCGGAAACAAUAAAUUG-3' (SEQ ID NO: 14973)

3'-AAUAACCUGUGGCCUUUGUUAUUUAAC-5' (SEQ ID NO: 8043)

C5-5314 Target:
5'-TTATTGGACACCGGAAACAATAAATTG-3' (SEQ ID NO: 10353)

5'-UAUUGGACACCGGAAACAAUAAAUUGG-3' (SEQ ID NO: 14974)

3'-AUAACCUGUGGCCUUUGUUAUUUAACC-5' (SEQ ID NO: 8044)

C5-5315 Target:
5'-TATTGGACACCGGAAACAATAAATTGG-3' (SEQ ID NO: 10354)

5'-AUUGGACACCGGAAACAAUAAAUUGGA-3' (SEQ ID NO: 14975)

3'-UAACCUGUGGCCUUUGUUAUUUAACCU-5' (SEQ ID NO: 8045)

C5-5316 Target:
5'-ATTGGACACCGGAAACAATAAATTGGA-3' (SEQ ID NO: 10355)

5'-UUGGACACCGGAAACAAUAAAUUGGAA-3' (SEQ ID NO: 14976)

3'-AACCUGUGGCCUUUGUUAUUUAACCUU-5' (SEQ ID NO: 8046)

C5-5317 Target:
5'-TTGGACACCGGAAACAATAAATTGGAA-3' (SEQ ID NO: 10356)

5'-UGGACACCGGAAACAAUAAAUUGGAAC-3' (SEQ ID NO: 14977)

3'-ACCUGUGGCCUUUGUUAUUUAACCUUG-5' (SEQ ID NO: 8047)

C5-5318 Target:
5'-TGGACACCGGAAACAATAAATTGGAAC-3' (SEQ ID NO: 10357)

5'-GGACACCGGAAACAAUAAAUUGGAACA-3' (SEQ ID NO: 14978)

3'-CCUGUGGCCUUUGUUAUUUAACCUUGU-5' (SEQ ID NO: 8048)

C5-5319 Target:
5'-GGACACCGGAAACAATAAATTGGAACA-3' (SEQ ID NO: 10358)

5'-UGGAACACCUCCUCAAACCUACCACUC-3' (SEQ ID NO: 14979)

3'-ACCUUGUGGAGGAGUUUGGAUGGUGAG-5' (SEQ ID NO: 8049)

C5-5339 Target:
5'-TGGAACACCTCCTCAAACCTACCACTC-3' (SEQ ID NO: 10359)

5'-GGAACACCUCCUCAAACCUACCACUCA-3' (SEQ ID NO: 14980)

3'-CCUUGUGGAGGAGUUUGGAUGGUGAGU-5' (SEQ ID NO: 8050)

C5-5340 Target:
5'-GGAACACCTCCTCAAACCTACCACTCA-3' (SEQ ID NO: 10360)

5'-GAACACCUCCUCAAACCUACCACUCAG-3' (SEQ ID NO: 14981)

3'-CUUGUGGAGGAGUUUGGAUGGUGAGUC-5' (SEQ ID NO: 8051)

C5-5341 Target:
5'-GAACACCTCCTCAAACCTACCACTCAG-3' (SEQ ID NO: 10361)

5'-AACACCUCCUCAAACCUACCACUCAGG-3' (SEQ ID NO: 14982)

3'-UUGUGGAGGAGUUUGGAUGGUGAGUCC-5' (SEQ ID NO: 8052)

C5-5342 Target:
5'-AACACCTCCTCAAACCTACCACTCAGG-3' (SEQ ID NO: 10362)

5'-ACACCUCCUCAAACCUACCACUCAGGA-3' (SEQ ID NO: 14983)

3'-UGUGGAGGAGUUUGGAUGGUGAGUCCU-5' (SEQ ID NO: 8053)

C5-5343 Target:
5'-ACACCTCCTCAAACCTACCACTCAGGA-3' (SEQ ID NO: 10363)

5'-CACCUCCUCAAACCUACCACUCAGGAA-3' (SEQ ID NO: 14984)

3'-GUGGAGGAGUUUGGAUGGUGAGUCCUU-5' (SEQ ID NO: 8054)

C5-5344 Target:
5'-CACCTCCTCAAACCTACCACTCAGGAA-3' (SEQ ID NO: 10364)

5'-GGGCCGAAAGAACAGUCCAUUGAAAGG-3' (SEQ ID NO: 14985)

3'-CCCGGCUUUCUUGUCAGGUAACUUUCC-5' (SEQ ID NO: 8055)

C5-5380 Target:
5'-GGGCCGAAAGAACAGTCCATTGAAAGG-3' (SEQ ID NO: 10365)

5'-GGCCGAAAGAACAGUCCAUUGAAAGGG-3' (SEQ ID NO: 14986)

3'-CCGGCUUUCUUGUCAGGUAACUUUCCC-5' (SEQ ID NO: 8056)

C5-5381 Target:
5'-GGCCGAAAGAACAGTCCATTGAAAGGG-3' (SEQ ID NO: 10366)

5'-GCCGAAAGAACAGUCCAUUGAAAGGGA-3' (SEQ ID NO: 14987)

3'-CGGCUUUCUUGUCAGGUAACUUUCCCU-5' (SEQ ID NO: 8057)

C5-5382 Target:
5'-GCCGAAAGAACAGTCCATTGAAAGGGA-3' (SEQ ID NO: 10367)

5'-CCGAAAGAACAGUCCAUUGAAAGGGAG-3' (SEQ ID NO: 14988)

3'-GGCUUUCUUGUCAGGUAACUUUCCCUC-5' (SEQ ID NO: 8058)

C5-5383 Target:
5'-CCGAAAGAACAGTCCATTGAAAGGGAG-3' (SEQ ID NO: 10368)

5'-CGAAAGAACAGUCCAUUGAAAGGGAGU-3' (SEQ ID NO: 14989)

3'-GCUUUCUUGUCAGGUAACUUUCCCUCA-5' (SEQ ID NO: 8059)

C5-5384 Target:
5'-CGAAAGAACAGTCCATTGAAAGGGAGT-3' (SEQ ID NO: 10369)

5'-AGGGAGUAUUACAAAAACAUGGCCUUU-3' (SEQ ID NO: 14990)

3'-UCCCUCAUAAUGUUUUUGUACCGGAAA-5' (SEQ ID NO: 8060)

C5-5404 Target:
5'-AGGGAGTATTACAAAAACATGGCCTTT-3' (SEQ ID NO: 10370)

5'-GGGAGUAUUACAAAAACAUGGCCUUUG-3' (SEQ ID NO: 14991)

3'-CCCUCAUAAUGUUUUUGUACCGGAAAC-5' (SEQ ID NO: 8061)

C5-5405 Target:
5'-GGGAGTATTACAAAAACATGGCCTTTG-3' (SEQ ID NO: 10371)

5'-GGAGUAUUACAAAAACAUGGCCUUUGC-3' (SEQ ID NO: 14992)

3'-CCUCAUAAUGUUUUUGUACCGGAAACG-5' (SEQ ID NO: 8062)

TABLE 9-continued

"Blunt/Blunt" DsiRNAs Corresponding to Human Anti-C5 DsiRNAs Predicted to have >50% Knockdown Efficacy C5-5406 Target:
5'-GGAGTATTACAAAAACATGGCCTTTGC-3' (SEQ ID NO: 10372)

5'-GAGUAUUACAAAAACAUGGCCUUUGCU-3' (SEQ ID NO: 14993)

3'-CUCAUAAUGUUUUUGUACCGGAAACGA-5' (SEQ ID NO: 8063)

C5-5407 Target:
5'-GAGTATTACAAAAACATGGCCTTTGCT-3' (SEQ ID NO: 10373)

5'-AGUAUUACAAAAACAUGGCCUUUGCUU-3' (SEQ ID NO: 14994)

3'-UCAUAAUGUUUUUGUACCGGAAACGAA-5' (SEQ ID NO: 8064)

C5-5408 Target:
5'-AGTATTACAAAAACATGGCCTTTGCTT-3' (SEQ ID NO: 10374)

5'-GUAUUACAAAAACAUGGCCUUUGCUUG-3' (SEQ ID NO: 14995)

3'-CAUAAUGUUUUUGUACCGGAAACGAAC-5' (SEQ ID NO: 8065)

C5-5409 Target:
5'-GTATTACAAAAACATGGCCTTTGCTTG-3' (SEQ ID NO: 10375)

5'-UAUUACAAAAACAUGGCCUUUGCUUGA-3' (SEQ ID NO: 14996)

3'-AUAAUGUUUUUGUACCGGAAACGAACU-5' (SEQ ID NO: 8066)

C5-5410 Target:
5'-TATTACAAAAACATGGCCTTTGCTTGA-3' (SEQ ID NO: 10376)

5'-AUUACAAAAACAUGGCCUUUGCUUGAA-3' (SEQ ID NO: 14997)

3'-UAAUGUUUUUGUACCGGAAACGAACUU-5' (SEQ ID NO: 8067)

C5-5411 Target:
5'-ATTACAAAAACATGGCCTTTGCTTGAA-3' (SEQ ID NO: 10377)

5'-UUACAAAAACAUGGCCUUUGCUUGAAA-3' (SEQ ID NO: 14998)

3'-AAUGUUUUUGUACCGGAAACGAACUUU-5' (SEQ ID NO: 8068)

C5-5412 Target:
5'-TTACAAAAACATGGCCTTTGCTTGAAA-3' (SEQ ID NO: 10378)

5'-UACAAAAACAUGGCCUUUGCUUGAAAG-3' (SEQ ID NO: 14999)

3'-AUGUUUUUGUACCGGAAACGAACUUUC-5' (SEQ ID NO: 8069)

C5-5413 Target:
5'-TACAAAAACATGGCCTTTGCTTGAAAG-3' (SEQ ID NO: 10379)

5'-ACAAAAACAUGGCCUUUGCUUGAAAGA-3' (SEQ ID NO: 15000)

3'-UGUUUUUGUACCGGAAACGAACUUUCU-5' (SEQ ID NO: 8070)

C5-5414 Target:
5'-ACAAAAACATGGCCTTTGCTTGAAAGA-3' (SEQ ID NO: 10380)

5'-CAAAAACAUGGCCUUUGCUUGAAAGAA-3' (SEQ ID NO: 15001)

3'-GUUUUUGUACCGGAAACGAACUUUCUU-5' (SEQ ID NO: 8071)

C5-5415 Target:
5'-CAAAAACATGGCCTTTGCTTGAAAGAA-3' (SEQ ID NO: 10381)

5'-AAAAACAUGGCCUUUGCUUGAAAGAAA-3' (SEQ ID NO: 15002)

3'-UUUUUGUACCGGAAACGAACUUUCUUU-5' (SEQ ID NO: 8072)

C5-5416 Target:
5'-AAAAACATGGCCTTTGCTTGAAAGAAA-3' (SEQ ID NO: 10382)

5'-AAAACAUGGCCUUUGCUUGAAAGAAAA-3' (SEQ ID NO: 15003)

3'-UUUUGUACCGGAAACGAACUUUCUUUU-5' (SEQ ID NO: 8073)

C5-5417 Target:
5'-AAAACATGGCCTTTGCTTGAAAGAAAA-3' (SEQ ID NO: 10383)

5'-AAACAUGGCCUUUGCUUGAAAGAAAAU-3' (SEQ ID NO: 15004)

3'-UUUGUACCGGAAACGAACUUUCUUUUA-5' (SEQ ID NO: 8074)

C5-5418 Target:
5'-AAACATGGCCTTTGCTTGAAAGAAAAT-3' (SEQ ID NO: 10384)

5'-AACAUGGCCUUUGCUUGAAAGAAAAUA-3' (SEQ ID NO: 15005)

3'-UUGUACCGGAAACGAACUUUCUUUUAU-5' (SEQ ID NO: 8075)

C5-5419 Target:
5'-AACATGGCCTTTGCTTGAAAGAAAATA-3' (SEQ ID NO: 10385)

5'-ACAUGGCCUUUGCUUGAAAGAAAAUAC-3' (SEQ ID NO: 15006)

3'-UGUACCGGAAACGAACUUUCUUUUAUG-5' (SEQ ID NO: 8076)

C5-5420 Target:
5'-ACATGGCCTTTGCTTGAAAGAAAATAC-3' (SEQ ID NO: 10386)

5'-CAUGGCCUUUGCUUGAAAGAAAAUACC-3' (SEQ ID NO: 15007)

3'-GUACCGGAAACGAACUUUCUUUUAUGG-5' (SEQ ID NO: 8077)

C5-5421 Target:
5'-CATGGCCTTTGCTTGAAAGAAAATACC-3' (SEQ ID NO: 10387)

5'-AUGGCCUUUGCUUGAAAGAAAAUACCA-3' (SEQ ID NO: 15008)

3'-UACCGGAAACGAACUUUCUUUUAUGGU-5' (SEQ ID NO: 8078)

C5-5422 Target:
5'-ATGGCCTTTGCTTGAAAGAAAATACCA-3' (SEQ ID NO: 10388)

5'-UGGCCUUUGCUUGAAAGAAAAUACCAA-3' (SEQ ID NO: 15009)

3'-ACCGGAAACGAACUUUCUUUUAUGGUU-5' (SEQ ID NO: 8079)

C5-5423 Target:
5'-TGGCCTTTGCTTGAAAGAAAATACCAA-3' (SEQ ID NO: 10389)

5'-GGCCUUUGCUUGAAAGAAAAUACCAAG-3' (SEQ ID NO: 15010)

3'-CCGGAAACGAACUUUCUUUUAUGGUUC-5' (SEQ ID NO: 8080)

C5-5424 Target:
5'-GGCCTTTGCTTGAAAGAAAATACCAAG-3' (SEQ ID NO: 10390)

5'-GCCUUUGCUUGAAAGAAAAUACCAAGG-3' (SEQ ID NO: 15011)

3'-CGGAAACGAACUUUCUUUUAUGGUUCC-5' (SEQ ID NO: 8081)

C5-5425 Target:
5'-GCCTTTGCTTGAAAGAAAATACCAAGG-3' (SEQ ID NO: 10391)

5'-CCUUUGCUUGAAAGAAAAUACCAAGGA-3' (SEQ ID NO: 15012)

3'-GGAAACGAACUUUCUUUUAUGGUUCCU-5' (SEQ ID NO: 8082)

TABLE 9-continued

"Blunt/Blunt" DsiRNAs Corresponding to Human Anti-C5 DsiRNAs Predicted to have >50% Knockdown Efficacy C5-5426 Target:
5'-CCTTTGCTTGAAAGAAAATACCAAGGA-3' (SEQ ID NO: 10392)

5'-CUUUGCUUGAAAGAAAAUACCAAGGAA-3' (SEQ ID NO: 15013)

3'-GAAACGAACUUUCUUUUAUGGUUCCUU-5' (SEQ ID NO: 8083)

C5-5427 Target:
5'-CTTTGCTTGAAAGAAAATACCAAGGAA-3' (SEQ ID NO: 10393)

5'-UUUGCUUGAAAGAAAAUACCAAGGAAC-3' (SEQ ID NO: 15014)

3'-AAACGAACUUUCUUUUAUGGUUCCUUG-5' (SEQ ID NO: 8084)

C5-5428 Target:
5'-TTTGCTTGAAAGAAAATACCAAGGAAC-3' (SEQ ID NO: 10394)

5'-GAACAGGAAACUGAUCAUUAAAGCCUG-3' (SEQ ID NO: 15015)

3'-CUUGUCCUUUGACUAGUAAUUUCGGAC-5' (SEQ ID NO: 8085)

C5-5451 Target:
5'-GAACAGGAAACTGATCATTAAAGCCTG-3' (SEQ ID NO: 10395)

5'-AACAGGAAACUGAUCAUUAAAGCCUGA-3' (SEQ ID NO: 15016)

3'-UUGUCCUUUGACUAGUAAUUUCGGACU-5' (SEQ ID NO: 8086)

C5-5452 Target:
5'-AACAGGAAACTGATCATTAAAGCCTGA-3' (SEQ ID NO: 10396)

5'-ACAGGAAACUGAUCAUUAAAGCCUGAG-3' (SEQ ID NO: 15017)

3'-UGUCCUUUGACUAGUAAUUUCGGACUC-5' (SEQ ID NO: 8087)

C5-5453 Target:
5'-ACAGGAAACTGATCATTAAAGCCTGAG-3' (SEQ ID NO: 10397)

5'-CAGGAAACUGAUCAUUAAAGCCUGAGU-3' (SEQ ID NO: 15018)

3'-GUCCUUUGACUAGUAAUUUCGGACUCA-5' (SEQ ID NO: 8088)

C5-5454 Target:
5'-CAGGAAACTGATCATTAAAGCCTGAGT-3' (SEQ ID NO: 10398)

5'-AGGAAACUGAUCAUUAAAGCCUGAGUU-3' (SEQ ID NO: 15019)

3'-UCCUUUGACUAGUAAUUUCGGACUCAA-5' (SEQ ID NO: 8089)

C5-5455 Target:
5'-AGGAAACTGATCATTAAAGCCTGAGTT-3' (SEQ ID NO: 10399)

5'-GGAAACUGAUCAUUAAAGCCUGAGUUU-3' (SEQ ID NO: 15020)

3'-CCUUUGACUAGUAAUUUCGGACUCAAA-5' (SEQ ID NO: 8090)

C5-5456 Target:
5'-GGAAACTGATCATTAAAGCCTGAGTTT-3' (SEQ ID NO: 10400)

5'-GAAACUGAUCAUUAAAGCCUGAGUUUG-3' (SEQ ID NO: 15021)

3'-CUUUGACUAGUAAUUUCGGACUCAAAC-5' (SEQ ID NO: 8091)

TABLE 9-continued

"Blunt/Blunt" DsiRNAs Corresponding to Human Anti-C5 DsiRNAs Predicted to have >50% Knockdown Efficacy C5-5457 Target:
5'-GAAACTGATCATTAAAGCCTGAGTTTG-3' (SEQ ID NO: 10401)

5'-AAACUGAUCAUUAAAGCCUGAGUUUGC-3' (SEQ ID NO: 15022)

3'-UUUGACUAGUAAUUUCGGACUCAAACG-5' (SEQ ID NO: 8092)

C5-5458 Target:
5'-AAACTGATCATTAAAGCCTGAGTTTGC-3' (SEQ ID NO: 10402)

5'-AACUGAUCAUUAAAGCCUGAGUUUGCU-3' (SEQ ID NO: 15023)

3'-UUGACUAGUAAUUUCGGACUCAAACGA-5' (SEQ ID NO: 8093)

C5-5459 Target:
5'-AACTGATCATTAAAGCCTGAGTTTGCT-3' (SEQ ID NO: 10403)

5'-ACUGAUCAUUAAAGCCUGAGUUUGCUU-3' (SEQ ID NO: 15024)

3'-UGACUAGUAAUUUCGGACUCAAACGAA-5' (SEQ ID NO: 8094)

C5-5460 Target:
5'-ACTGATCATTAAAGCCTGAGTTTGCTT-3' (SEQ ID NO: 10404)

5'-CUGAUCAUUAAAGCCUGAGUUUGCUUU-3' (SEQ ID NO: 15025)

3'-GACUAGUAAUUUCGGACUCAAACGAAA-5' (SEQ ID NO: 8095)

C5-5461 Target:
5'-CTGATCATTAAAGCCTGAGTTTGCTTT-3' (SEQ ID NO: 10405)

5'-UGAUCAUUAAAGCCUGAGUUUGCUUUC-3' (SEQ ID NO: 15026)

3'-ACUAGUAAUUUCGGACUCAAACGAAAG-5' (SEQ ID NO: 8096)

C5-5462 Target:
5'-TGATCATTAAAGCCTGAGTTTGCTTTC-3' (SEQ ID NO: 10406)

5'-GAUCAUUAAAGCCUGAGUUUGCUUUCA-3' (SEQ ID NO: 15027)

3'-CUAGUAAUUUCGGACUCAAACGAAAGU-5' (SEQ ID NO: 8097)

C5-5463 Target:
5'-GATCATTAAAGCCTGAGTTTGCTTTCA-3' (SEQ ID NO: 10407)

5'-CAUUAAAGCCUGAGUUUGCUUUCAAAA-3' (SEQ ID NO: 15028)

3'-GUAAUUUCGGACUCAAACGAAAGUUUU-5' (SEQ ID NO: 8098)

C5-5466 Target:
5'-CATTAAAGCCTGAGTTTGCTTTCAAAA-3' (SEQ ID NO: 10408)

5'-AUUAAAGCCUGAGUUUGCUUUCAAAAA-3' (SEQ ID NO: 15029)

3'-UAAUUUCGGACUCAAACGAAAGUUUUU-5' (SEQ ID NO: 8099)

C5-5467 Target:
5'-ATTAAAGCCTGAGTTTGCTTTCAAAAA-3' (SEQ ID NO: 10409)

TABLE 10

DsiRNA Component 19 Nucleotide Target Sequences of Human Anti-C5 DsiRNAs Predicted to have >50% Knockdown Efficacy

| | | | | |
|---|---|---|---|---|
| C5-40 | 19 nt | Target #1: | 5'-CUGCUACCUCCAACCAUGG-3' | (SEQ ID NO: 15030) |
| C5-40 | 19 nt | Target #2: | 5'-CCUGCUACCUCCAACCAUG-3' | (SEQ ID NO: 17340) |
| C5-40 | 19 nt | Target #3: | 5'-UCCUGCUACCUCCAACCAU-3' | (SEQ ID NO: 19650) |
| C5-41 | 19 nt | Target #1: | 5'-UGCUACCUCCAACCAUGGG-3' | (SEQ ID NO: 15031) |
| C5-41 | 19 nt | Target #2: | 5'-CUGCUACCUCCAACCAUGG-3' | (SEQ ID NO: 17341) |

TABLE 10-continued

DsiRNA Component 19 Nucleotide Target Sequences of Human Anti-C5
DsiRNAs Predicted to have >50% Knockdown Efficacy

| | | | | |
|---|---|---|---|---|
| C5-41 | 19 nt | Target #3: | 5'-CCUGCUACCUCCAACCAUG-3' | (SEQ ID NO: 19651) |
| C5-42 | 19 nt | Target #1: | 5'-GCUACCUCCAACCAUGGGC-3' | (SEQ ID NO: 15032) |
| C5-42 | 19 nt | Target #2: | 5'-UGCUACCUCCAACCAUGGG-3' | (SEQ ID NO: 17342) |
| C5-42 | 19 nt | Target #3: | 5'-CUGCUACCUCCAACCAUGG-3' | (SEQ ID NO: 19652) |
| C5-43 | 19 nt | Target #1: | 5'-CUACCUCCAACCAUGGGCC-3' | (SEQ ID NO: 15033) |
| C5-43 | 19 nt | Target #2: | 5'-GCUACCUCCAACCAUGGGC-3' | (SEQ ID NO: 17343) |
| C5-43 | 19 nt | Target #3: | 5'-UGCUACCUCCAACCAUGGG-3' | (SEQ ID NO: 19653) |
| C5-46 | 19 nt | Target #1: | 5'-CCUCCAACCAUGGGCCUUU-3' | (SEQ ID NO: 15034) |
| C5-46 | 19 nt | Target #2: | 5'-ACCUCCAACCAUGGGCCUU-3' | (SEQ ID NO: 17344) |
| C5-46 | 19 nt | Target #3: | 5'-UACCUCCAACCAUGGGCCU-3' | (SEQ ID NO: 19654) |
| C5-47 | 19 nt | Target #1: | 5'-CUCCAACCAUGGGCCUUUU-3' | (SEQ ID NO: 15035) |
| C5-47 | 19 nt | Target #2: | 5'-CCUCCAACCAUGGGCCUUU-3' | (SEQ ID NO: 17345) |
| C5-47 | 19 nt | Target #3: | 5'-ACCUCCAACCAUGGGCCUU-3' | (SEQ ID NO: 19655) |
| C5-48 | 19 nt | Target #1: | 5'-UCCAACCAUGGGCCUUUUG-3' | (SEQ ID NO: 15036) |
| C5-48 | 19 nt | Target #2: | 5'-CUCCAACCAUGGGCCUUUU-3' | (SEQ ID NO: 17346) |
| C5-48 | 19 nt | Target #3: | 5'-CCUCCAACCAUGGGCCUUU-3' | (SEQ ID NO: 19656) |
| C5-49 | 19 nt | Target #1: | 5'-CCAACCAUGGGCCUUUUGG-3' | (SEQ ID NO: 15037) |
| C5-49 | 19 nt | Target #2: | 5'-UCCAACCAUGGGCCUUUUG-3' | (SEQ ID NO: 17347) |
| C5-49 | 19 nt | Target #3: | 5'-CUCCAACCAUGGGCCUUUU-3' | (SEQ ID NO: 19657) |
| C5-50 | 19 nt | Target #1: | 5'-CAACCAUGGGCCUUUUGGG-3' | (SEQ ID NO: 15038) |
| C5-50 | 19 nt | Target #2: | 5'-CCAACCAUGGGCCUUUUGG-3' | (SEQ ID NO: 17348) |
| C5-50 | 19 nt | Target #3: | 5'-UCCAACCAUGGGCCUUUUG-3' | (SEQ ID NO: 19658) |
| C5-51 | 19 nt | Target #1: | 5'-AACCAUGGGCCUUUUGGGA-3' | (SEQ ID NO: 15039) |
| C5-51 | 19 nt | Target #2: | 5'-CAACCAUGGGCCUUUUGGG-3' | (SEQ ID NO: 17349) |
| C5-51 | 19 nt | Target #3: | 5'-CCAACCAUGGGCCUUUUGG-3' | (SEQ ID NO: 19659) |
| C5-52 | 19 nt | Target #1: | 5'-ACCAUGGGCCUUUUGGGAA-3' | (SEQ ID NO: 15040) |
| C5-52 | 19 nt | Target #2: | 5'-AACCAUGGGCCUUUUGGGA-3' | (SEQ ID NO: 17350) |
| C5-52 | 19 nt | Target #3: | 5'-CAACCAUGGGCCUUUUGGG-3' | (SEQ ID NO: 19660) |
| C5-53 | 19 nt | Target #1: | 5'-CCAUGGGCCUUUUGGGAAU-3' | (SEQ ID NO: 15041) |
| C5-53 | 19 nt | Target #2: | 5'-ACCAUGGGCCUUUUGGGAA-3' | (SEQ ID NO: 17351) |
| C5-53 | 19 nt | Target #3: | 5'-AACCAUGGGCCUUUUGGGA-3' | (SEQ ID NO: 19661) |
| C5-54 | 19 nt | Target #1: | 5'-CAUGGGCCUUUUGGGAAUA-3' | (SEQ ID NO: 15042) |
| C5-54 | 19 nt | Target #2: | 5'-CCAUGGGCCUUUUGGGAAU-3' | (SEQ ID NO: 17352) |
| C5-54 | 19 nt | Target #3: | 5'-ACCAUGGGCCUUUUGGGAA-3' | (SEQ ID NO: 19662) |
| C5-55 | 19 nt | Target #1: | 5'-AUGGGCCUUUUGGGAAUAC-3' | (SEQ ID NO: 15043) |
| C5-55 | 19 nt | Target #2: | 5'-CAUGGGCCUUUUGGGAAUA-3' | (SEQ ID NO: 17353) |
| C5-55 | 19 nt | Target #3: | 5'-CCAUGGGCCUUUUGGGAAU-3' | (SEQ ID NO: 19663) |
| C5-56 | 19 nt | Target #1: | 5'-UGGGCCUUUUGGGAAUACU-3' | (SEQ ID NO: 15044) |
| C5-56 | 19 nt | Target #2: | 5'-AUGGGCCUUUUGGGAAUAC-3' | (SEQ ID NO: 17354) |
| C5-56 | 19 nt | Target #3: | 5'-CAUGGGCCUUUUGGGAAUA-3' | (SEQ ID NO: 19664) |
| C5-57 | 19 nt | Target #1: | 5'-GGGCCUUUUGGGAAUACUU-3' | (SEQ ID NO: 15045) |
| C5-57 | 19 nt | Target #2: | 5'-UGGGCCUUUUGGGAAUACU-3' | (SEQ ID NO: 17355) |
| C5-57 | 19 nt | Target #3: | 5'-AUGGGCCUUUUGGGAAUAC-3' | (SEQ ID NO: 19665) |
| C5-58 | 19 nt | Target #1: | 5'-GGCCUUUUGGGAAUACUUU-3' | (SEQ ID NO: 15046) |
| C5-58 | 19 nt | Target #2: | 5'-GGGCCUUUUGGGAAUACUU-3' | (SEQ ID NO: 17356) |
| C5-58 | 19 nt | Target #3: | 5'-UGGGCCUUUUGGGAAUACU-3' | (SEQ ID NO: 19666) |
| C5-59 | 19 nt | Target #1: | 5'-GCCUUUUGGGAAUACUUUG-3' | (SEQ ID NO: 10547) |
| C5-59 | 19 nt | Target #2: | 5'-GGCCUUUUGGGAAUACUUU-3' | (SEQ ID NO: 17357) |
| C5-59 | 19 nt | Target #3: | 5'-GGGCCUUUUGGGAAUACUU-3' | (SEQ ID NO: 19667) |
| C5-60 | 19 nt | Target #1: | 5'-CCUUUUGGGAAUACUUUGU-3' | (SEQ ID NO: 15048) |
| C5-60 | 19 nt | Target #2: | 5'-GCCUUUUGGGAAUACUUUG-3' | (SEQ ID NO: 17358) |
| C5-60 | 19 nt | Target #3: | 5'-GGCCUUUUGGGAAUACUUU-3' | (SEQ ID NO: 19668) |
| C5-61 | 19 nt | Target #1: | 5'-CUUUUGGGAAUACUUUGUU-3' | (SEQ ID NO: 15049) |
| C5-61 | 19 nt | Target #2: | 5'-CCUUUUGGGAAUACUUUGU-3' | (SEQ ID NO: 17359) |
| C5-61 | 19 nt | Target #3: | 5'-GCCUUUUGGGAAUACUUUG-3' | (SEQ ID NO: 19669) |
| C5-62 | 19 nt | Target #1: | 5'-UUUUGGGAAUACUUUGUUU-3' | (SEQ ID NO: 15050) |
| C5-62 | 19 nt | Target #2: | 5'-CUUUUGGGAAUACUUUGUU-3' | (SEQ ID NO: 17360) |
| C5-62 | 19 nt | Target #3: | 5'-CCUUUUGGGAAUACUUUGU-3' | (SEQ ID NO: 19670) |
| C5-63 | 19 nt | Target #1: | 5'-UUUGGGAAUACUUUGUUUU-3' | (SEQ ID NO: 15051) |
| C5-63 | 19 nt | Target #2: | 5'-UUUUGGGAAUACUUUGUUU-3' | (SEQ ID NO: 17361) |
| C5-63 | 19 nt | Target #3: | 5'-CUUUUGGGAAUACUUUGUU-3' | (SEQ ID NO: 19671) |
| C5-64 | 19 nt | Target #1: | 5'-UUGGGAAUACUUUGUUUUU-3' | (SEQ ID NO: 15052) |
| C5-64 | 19 nt | Target #2: | 5'-UUUGGGAAUACUUUGUUUU-3' | (SEQ ID NO: 17362) |
| C5-64 | 19 nt | Target #3: | 5'-UUUUGGGAAUACUUUGUUU-3' | (SEQ ID NO: 19672) |
| C5-65 | 19 nt | Target #1: | 5'-UGGGAAUACUUUGUUUUUU-3' | (SEQ ID NO: 15053) |
| C5-65 | 19 nt | Target #2: | 5'-UUGGGAAUACUUUGUUUUU-3' | (SEQ ID NO: 17363) |
| C5-65 | 19 nt | Target #3: | 5'-UUUGGGAAUACUUUGUUUU-3' | (SEQ ID NO: 19673) |
| C5-66 | 19 nt | Target #1: | 5'-GGGAAUACUUUGUUUUUUA-3' | (SEQ ID NO: 15054) |
| C5-66 | 19 nt | Target #2: | 5'-UGGGAAUACUUUGUUUUUU-3' | (SEQ ID NO: 17364) |
| C5-66 | 19 nt | Target #3: | 5'-UUGGGAAUACUUUGUUUUU-3' | (SEQ ID NO: 19674) |
| C5-67 | 19 nt | Target #1: | 5'-GGAAUACUUUGUUUUUUAA-3' | (SEQ ID NO: 15055) |
| C5-67 | 19 nt | Target #2: | 5'-GGGAAUACUUUGUUUUUUA-3' | (SEQ ID NO: 17365) |
| C5-67 | 19 nt | Target #3: | 5'-UGGGAAUACUUUGUUUUUU-3' | (SEQ ID NO: 19675) |
| C5-68 | 19 nt | Target #1: | 5'-GAAUACUUUGUUUUUUAAU-3' | (SEQ ID NO: 15056) |
| C5-68 | 19 nt | Target #2: | 5'-GGAAUACUUUGUUUUUUAA-3' | (SEQ ID NO: 17366) |
| C5-68 | 19 nt | Target #3: | 5'-GGGAAUACUUUGUUUUUUA-3' | (SEQ ID NO: 19676) |
| C5-69 | 19 nt | Target #1: | 5'-AAUACUUUGUUUUUUAAUC-3' | (SEQ ID NO: 15057) |

TABLE 10-continued

DsiRNA Component 19 Nucleotide Target Sequences of Human Anti-C5
DsiRNAs Predicted to have >50% Knockdown Efficacy

| | | | | |
|---|---|---|---|---|
| C5-69 | 19 nt | Target #2: | 5'-GAAUACUUUGUUUUUAAU-3' | (SEQ ID NO: 17367) |
| C5-69 | 19 nt | Target #3: | 5'-GGAAUACUUUGUUUUUAA-3' | (SEQ ID NO: 19677) |
| C5-70 | 19 nt | Target #1: | 5'-AUACUUUGUUUUUAAUCU-3' | (SEQ ID NO: 15058) |
| C5-70 | 19 nt | Target #2: | 5'-AAUACUUUGUUUUUAAUC-3' | (SEQ ID NO: 17368) |
| C5-70 | 19 nt | Target #3: | 5'-GAAUACUUUGUUUUUAAU-3' | (SEQ ID NO: 19678) |
| C5-71 | 19 nt | Target #1: | 5'-UACUUUGUUUUUAAUCUU-3' | (SEQ ID NO: 15059) |
| C5-71 | 19 nt | Target #2: | 5'-AUACUUUGUUUUUAAUCU-3' | (SEQ ID NO: 17369) |
| C5-71 | 19 nt | Target #3: | 5'-AAUACUUUGUUUUUAAUC-3' | (SEQ ID NO: 19679) |
| C5-72 | 19 nt | Target #1: | 5'-ACUUUGUUUUUAAUCUUC-3' | (SEQ ID NO: 15060) |
| C5-72 | 19 nt | Target #2: | 5'-UACUUUGUUUUUAAUCUU-3' | (SEQ ID NO: 17370) |
| C5-72 | 19 nt | Target #3: | 5'-AUACUUUGUUUUUAAUCU-3' | (SEQ ID NO: 19680) |
| C5-73 | 19 nt | Target #1: | 5'-CUUUGUUUUUAAUCUUCC-3' | (SEQ ID NO: 15061) |
| C5-73 | 19 nt | Target #2: | 5'-ACUUUGUUUUUAAUCUUC-3' | (SEQ ID NO: 17371) |
| C5-73 | 19 nt | Target #3: | 5'-UACUUUGUUUUUAAUCUU-3' | (SEQ ID NO: 19681) |
| C5-74 | 19 nt | Target #1: | 5'-UUUGUUUUUAAUCUUCCU-3' | (SEQ ID NO: 15062) |
| C5-74 | 19 nt | Target #2: | 5'-CUUUGUUUUUAAUCUUCC-3' | (SEQ ID NO: 17372) |
| C5-74 | 19 nt | Target #3: | 5'-ACUUUGUUUUUAAUCUUC-3' | (SEQ ID NO: 19682) |
| C5-75 | 19 nt | Target #1: | 5'-UUGUUUUUAAUCUUCCUG-3' | (SEQ ID NO: 15063) |
| C5-75 | 19 nt | Target #2: | 5'-UUUGUUUUUAAUCUUCCU-3' | (SEQ ID NO: 17373) |
| C5-75 | 19 nt | Target #3: | 5'-CUUUGUUUUUAAUCUUCC-3' | (SEQ ID NO: 19683) |
| C5-76 | 19 nt | Target #1: | 5'-UGUUUUUAAUCUUCCUGG-3' | (SEQ ID NO: 15064) |
| C5-76 | 19 nt | Target #2: | 5'-UUGUUUUUAAUCUUCCUG-3' | (SEQ ID NO: 17374) |
| C5-76 | 19 nt | Target #3: | 5'-UUUGUUUUUAAUCUUCCU-3' | (SEQ ID NO: 19684) |
| C5-77 | 19 nt | Target #1: | 5'-GUUUUUAAUCUUCCUGGG-3' | (SEQ ID NO: 15065) |
| C5-77 | 19 nt | Target #2: | 5'-UGUUUUUAAUCUUCCUGG-3' | (SEQ ID NO: 17375) |
| C5-77 | 19 nt | Target #3: | 5'-UUGUUUUUAAUCUUCCUG-3' | (SEQ ID NO: 19685) |
| C5-103 | 19 nt | Target #1: | 5'-UGGGGACAGGAGCAAACAU-3' | (SEQ ID NO: 15066) |
| C5-103 | 19 nt | Target #2: | 5'-CUGGGGACAGGAGCAAACA-3' | (SEQ ID NO: 17376) |
| C5-103 | 19 nt | Target #3: | 5'-CCUGGGGACAGGAGCAAAC-3' | (SEQ ID NO: 19686) |
| C5-104 | 19 nt | Target #1: | 5'-GGGGACAGGAGCAAACAUA-3' | (SEQ ID NO: 15067) |
| C5-104 | 19 nt | Target #2: | 5'-UGGGGACAGGAGCAAACAU-3' | (SEQ ID NO: 17377) |
| C5-104 | 19 nt | Target #3: | 5'-CUGGGGACAGGAGCAAACA-3' | (SEQ ID NO: 19687) |
| C5-105 | 19 nt | Target #1: | 5'-GGGACAGGAGCAAACAUAU-3' | (SEQ ID NO: 15068) |
| C5-105 | 19 nt | Target #2: | 5'-GGGGACAGGAGCAAACAUA-3' | (SEQ ID NO: 17378) |
| C5-105 | 19 nt | Target #3: | 5'-UGGGGACAGGAGCAAACAU-3' | (SEQ ID NO: 19688) |
| C5-106 | 19 nt | Target #1: | 5'-GGACAGGAGCAAACAUAUG-3' | (SEQ ID NO: 15069) |
| C5-106 | 19 nt | Target #2: | 5'-GGGACAGGAGCAAACAUAU-3' | (SEQ ID NO: 17379) |
| C5-106 | 19 nt | Target #3: | 5'-GGGGACAGGAGCAAACAUA-3' | (SEQ ID NO: 19689) |
| C5-107 | 19 nt | Target #1: | 5'-GACAGGAGCAAACAUAUGU-3' | (SEQ ID NO: 15070) |
| C5-107 | 19 nt | Target #2: | 5'-GGACAGGAGCAAACAUAUG-3' | (SEQ ID NO: 17380) |
| C5-107 | 19 nt | Target #3: | 5'-GGGACAGGAGCAAACAUAU-3' | (SEQ ID NO: 19690) |
| C5-108 | 19 nt | Target #1: | 5'-ACAGGAGCAAACAUAUGUC-3' | (SEQ ID NO: 15071) |
| C5-108 | 19 nt | Target #2: | 5'-GACAGGAGCAAACAUAUGU-3' | (SEQ ID NO: 17381) |
| C5-108 | 19 nt | Target #3: | 5'-GGACAGGAGCAAACAUAUG-3' | (SEQ ID NO: 19691) |
| C5-109 | 19 nt | Target #1: | 5'-CAGGAGCAAACAUAUGUCA-3' | (SEQ ID NO: 15072) |
| C5-109 | 19 nt | Target #2: | 5'-ACAGGAGCAAACAUAUGUC-3' | (SEQ ID NO: 17382) |
| C5-109 | 19 nt | Target #3: | 5'-GACAGGAGCAAACAUAUGU-3' | (SEQ ID NO: 19692) |
| C5-110 | 19 nt | Target #1: | 5'-AGGAGCAAACAUAUGUCAU-3' | (SEQ ID NO: 15073) |
| C5-110 | 19 nt | Target #2: | 5'-CAGGAGCAAACAUAUGUCA-3' | (SEQ ID NO: 17383) |
| C5-110 | 19 nt | Target #3: | 5'-ACAGGAGCAAACAUAUGUC-3' | (SEQ ID NO: 19693) |
| C5-111 | 19 nt | Target #1: | 5'-GGAGCAAACAUAUGUCAUU-3' | (SEQ ID NO: 15074) |
| C5-111 | 19 nt | Target #2: | 5'-AGGAGCAAACAUAUGUCAU-3' | (SEQ ID NO: 17384) |
| C5-111 | 19 nt | Target #3: | 5'-CAGGAGCAAACAUAUGUCA-3' | (SEQ ID NO: 19694) |
| C5-112 | 19 nt | Target #1: | 5'-GAGCAAACAUAUGUCAUUU-3' | (SEQ ID NO: 15075) |
| C5-112 | 19 nt | Target #2: | 5'-GGAGCAAACAUAUGUCAUU-3' | (SEQ ID NO: 17385) |
| C5-112 | 19 nt | Target #3: | 5'-AGGAGCAAACAUAUGUCAU-3' | (SEQ ID NO: 19695) |
| C5-113 | 19 nt | Target #1: | 5'-AGCAAACAUAUGUCAUUUC-3' | (SEQ ID NO: 15076) |
| C5-113 | 19 nt | Target #2: | 5'-GAGCAAACAUAUGUCAUUU-3' | (SEQ ID NO: 17386) |
| C5-113 | 19 nt | Target #3: | 5'-GGAGCAAACAUAUGUCAUU-3' | (SEQ ID NO: 19696) |
| C5-114 | 19 nt | Target #1: | 5'-GCAAACAUAUGUCAUUUCA-3' | (SEQ ID NO: 15077) |
| C5-114 | 19 nt | Target #2: | 5'-AGCAAACAUAUGUCAUUUC-3' | (SEQ ID NO: 17387) |
| C5-114 | 19 nt | Target #3: | 5'-GAGCAAACAUAUGUCAUUU-3' | (SEQ ID NO: 19697) |
| C5-115 | 19 nt | Target #1: | 5'-CAAACAUAUGUCAUUUCAG-3' | (SEQ ID NO: 15078) |
| C5-115 | 19 nt | Target #2: | 5'-GCAAACAUAUGUCAUUUCA-3' | (SEQ ID NO: 17388) |
| C5-115 | 19 nt | Target #3: | 5'-AGCAAACAUAUGUCAUUUC-3' | (SEQ ID NO: 19698) |
| C5-116 | 19 nt | Target #1: | 5'-AAACAUAUGUCAUUUCAGC-3' | (SEQ ID NO: 15079) |
| C5-116 | 19 nt | Target #2: | 5'-CAAACAUAUGUCAUUUCAG-3' | (SEQ ID NO: 17389) |
| C5-116 | 19 nt | Target #3: | 5'-GCAAACAUAUGUCAUUUCA-3' | (SEQ ID NO: 19699) |
| C5-117 | 19 nt | Target #1: | 5'-AACAUAUGUCAUUUCAGCA-3' | (SEQ ID NO: 15080) |
| C5-117 | 19 nt | Target #2: | 5'-AAACAUAUGUCAUUUCAGC-3' | (SEQ ID NO: 17390) |
| C5-117 | 19 nt | Target #3: | 5'-CAAACAUAUGUCAUUUCAG-3' | (SEQ ID NO: 19700) |
| C5-118 | 19 nt | Target #1: | 5'-ACAUAUGUCAUUUCAGCAC-3' | (SEQ ID NO: 15081) |
| C5-118 | 19 nt | Target #2: | 5'-AACAUAUGUCAUUUCAGCA-3' | (SEQ ID NO: 17391) |
| C5-118 | 19 nt | Target #3: | 5'-AAACAUAUGUCAUUUCAGC-3' | (SEQ ID NO: 19701) |
| C5-119 | 19 nt | Target #1: | 5'-CAUAUGUCAUUUCAGCACC-3' | (SEQ ID NO: 15082) |
| C5-119 | 19 nt | Target #2: | 5'-ACAUAUGUCAUUUCAGCAC-3' | (SEQ ID NO: 17392) |
| C5-119 | 19 nt | Target #3: | 5'-AACAUAUGUCAUUUCAGCA-3' | (SEQ ID NO: 19702) |

TABLE 10-continued

DsiRNA Component 19 Nucleotide Target Sequences of Human Anti-C5
DsiRNAs Predicted to have >50% Knockdown Efficacy TABLE 10-continued DsiRNA Component 19 Nucleotide Target Sequences of Human Anti-C5
DsiRNAs Predicted to have >50% Knockdown Efficacy

| | | | | |
|---|---|---|---|---|
| C5-146 | 19 nt | Target #3: | 5'-AUUCCGUGUUGGAGCAUCU-3' | (SEQ ID NO: 19728) |
| C5-147 | 19 nt | Target #1: | 5'-CCGUGUUGGAGCAUCUGAA-3' | (SEQ ID NO: 15109) |
| C5-147 | 19 nt | Target #2: | 5'-UCCGUGUUGGAGCAUCUGA-3' | (SEQ ID NO: 17419) |
| C5-147 | 19 nt | Target #3: | 5'-UUCCGUGUUGGAGCAUCUG-3' | (SEQ ID NO: 19729) |
| C5-148 | 19 nt | Target #1: | 5'-CGUGUUGGAGCAUCUGAAA-3' | (SEQ ID NO: 15110) |
| C5-148 | 19 nt | Target #2: | 5'-CCGUGUUGGAGCAUCUGAA-3' | (SEQ ID NO: 17420) |
| C5-148 | 19 nt | Target #3: | 5'-UCCGUGUUGGAGCAUCUGA-3' | (SEQ ID NO: 19730) |
| C5-149 | 19 nt | Target #1: | 5'-GUGUUGGAGCAUCUGAAAA-3' | (SEQ ID NO: 15111) |
| C5-149 | 19 nt | Target #2: | 5'-CGUGUUGGAGCAUCUGAAA-3' | (SEQ ID NO: 17421) |
| C5-149 | 19 nt | Target #3: | 5'-CCGUGUUGGAGCAUCUGAA-3' | (SEQ ID NO: 19731) |
| C5-181 | 19 nt | Target #1: | 5'-GUUUAUGGAUACACUGAAG-3' | (SEQ ID NO: 15112) |
| C5-181 | 19 nt | Target #2: | 5'-AGUUUAUGGAUACACUGAA-3' | (SEQ ID NO: 17422) |
| C5-181 | 19 nt | Target #3: | 5'-AAGUUUAUGGAUACACUGA-3' | (SEQ ID NO: 19732) |
| C5-184 | 19 nt | Target #1: | 5'-UAUGGAUACACUGAAGCAU-3' | (SEQ ID NO: 15113) |
| C5-184 | 19 nt | Target #2: | 5'-UUAUGGAUACACUGAAGCA-3' | (SEQ ID NO: 17423) |
| C5-184 | 19 nt | Target #3: | 5'-UUUAUGGAUACACUGAAGC-3' | (SEQ ID NO: 19733) |
| C5-186 | 19 nt | Target #1: | 5'-UGGAUACACUGAAGCAUUU-3' | (SEQ ID NO: 15114) |
| C5-186 | 19 nt | Target #2: | 5'-AUGGAUACACUGAAGCAUU-3' | (SEQ ID NO: 17424) |
| C5-186 | 19 nt | Target #3: | 5'-UAUGGAUACACUGAAGCAU-3' | (SEQ ID NO: 19734) |
| C5-195 | 19 nt | Target #1: | 5'-UGAAGCAUUUGAUGCAACA-3' | (SEQ ID NO: 15115) |
| C5-195 | 19 nt | Target #2: | 5'-CUGAAGCAUUUGAUGCAAC-3' | (SEQ ID NO: 17425) |
| C5-195 | 19 nt | Target #3: | 5'-ACUGAAGCAUUUGAUGCAA-3' | (SEQ ID NO: 19735) |
| C5-197 | 19 nt | Target #1: | 5'-AAGCAUUUGAUGCAACAAU-3' | (SEQ ID NO: 15116) |
| C5-197 | 19 nt | Target #2: | 5'-GAAGCAUUUGAUGCAACAA-3' | (SEQ ID NO: 17426) |
| C5-197 | 19 nt | Target #3: | 5'-UGAAGCAUUUGAUGCAACA-3' | (SEQ ID NO: 19736) |
| C5-199 | 19 nt | Target #1: | 5'-GCAUUUGAUGCAACAAUCU-3' | (SEQ ID NO: 15117) |
| C5-199 | 19 nt | Target #2: | 5'-AGCAUUUGAUGCAACAAUC-3' | (SEQ ID NO: 17427) |
| C5-199 | 19 nt | Target #3: | 5'-AAGCAUUUGAUGCAACAAU-3' | (SEQ ID NO: 19737) |
| C5-201 | 19 nt | Target #1: | 5'-AUUUGAUGCAACAAUCUCU-3' | (SEQ ID NO: 15118) |
| C5-201 | 19 nt | Target #2: | 5'-CAUUUGAUGCAACAAUCUC-3' | (SEQ ID NO: 17428) |
| C5-201 | 19 nt | Target #3: | 5'-GCAUUUGAUGCAACAAUCU-3' | (SEQ ID NO: 19738) |
| C5-202 | 19 nt | Target #1: | 5'-UUUGAUGCAACAAUCUCUA-3' | (SEQ ID NO: 15119) |
| C5-202 | 19 nt | Target #2: | 5'-AUUUGAUGCAACAAUCUCU-3' | (SEQ ID NO: 17429) |
| C5-202 | 19 nt | Target #3: | 5'-CAUUUGAUGCAACAAUCUC-3' | (SEQ ID NO: 19739) |
| C5-203 | 19 nt | Target #1: | 5'-UUGAUGCAACAAUCUCUAU-3' | (SEQ ID NO: 15120) |
| C5-203 | 19 nt | Target #2: | 5'-UUUGAUGCAACAAUCUCUA-3' | (SEQ ID NO: 17430) |
| C5-203 | 19 nt | Target #3: | 5'-AUUUGAUGCAACAAUCUCU-3' | (SEQ ID NO: 19740) |
| C5-208 | 19 nt | Target #1: | 5'-GCAACAAUCUCUAUUAAAA-3' | (SEQ ID NO: 15121) |
| C5-208 | 19 nt | Target #2: | 5'-UGCAACAAUCUCUAUUAAA-3' | (SEQ ID NO: 17431) |
| C5-208 | 19 nt | Target #3: | 5'-AUGCAACAAUCUCUAUUAA-3' | (SEQ ID NO: 19741) |
| C5-209 | 19 nt | Target #1: | 5'-CAACAAUCUCUAUUAAAAG-3' | (SEQ ID NO: 15122) |
| C5-209 | 19 nt | Target #2: | 5'-GCAACAAUCUCUAUUAAAA-3' | (SEQ ID NO: 17432) |
| C5-209 | 19 nt | Target #3: | 5'-UGCAACAAUCUCUAUUAAA-3' | (SEQ ID NO: 19742) |
| C5-210 | 19 nt | Target #1: | 5'-AACAAUCUCUAUUAAAAGU-3' | (SEQ ID NO: 15123) |
| C5-210 | 19 nt | Target #2: | 5'-CAACAAUCUCUAUUAAAAG-3' | (SEQ ID NO: 17433) |
| C5-210 | 19 nt | Target #3: | 5'-GCAACAAUCUCUAUUAAAA-3' | (SEQ ID NO: 19743) |
| C5-213 | 19 nt | Target #1: | 5'-AAUCUCUAUUAAAAGUUAU-3' | (SEQ ID NO: 15124) |
| C5-213 | 19 nt | Target #2: | 5'-CAAUCUCUAUUAAAAGUUA-3' | (SEQ ID NO: 17434) |
| C5-213 | 19 nt | Target #3: | 5'-ACAAUCUCUAUUAAAAGUU-3' | (SEQ ID NO: 19744) |
| C5-214 | 19 nt | Target #1: | 5'-AUCUCUAUUAAAAGUUAUC-3' | (SEQ ID NO: 15125) |
| C5-214 | 19 nt | Target #2: | 5'-AAUCUCUAUUAAAAGUUAU-3' | (SEQ ID NO: 17435) |
| C5-214 | 19 nt | Target #3: | 5'-CAAUCUCUAUUAAAAGUUA-3' | (SEQ ID NO: 19745) |
| C5-215 | 19 nt | Target #1: | 5'-UCUCUAUUAAAAGUUAUCC-3' | (SEQ ID NO: 15126) |
| C5-215 | 19 nt | Target #2: | 5'-AUCUCUAUUAAAAGUUAUC-3' | (SEQ ID NO: 17436) |
| C5-215 | 19 nt | Target #3: | 5'-AAUCUCUAUUAAAAGUUAU-3' | (SEQ ID NO: 19746) |
| C5-216 | 19 nt | Target #1: | 5'-CUCUAUUAAAAGUUAUCCU-3' | (SEQ ID NO: 15127) |
| C5-216 | 19 nt | Target #2: | 5'-UCUCUAUUAAAAGUUAUCC-3' | (SEQ ID NO: 17437) |
| C5-216 | 19 nt | Target #3: | 5'-AUCUCUAUUAAAAGUUAUC-3' | (SEQ ID NO: 19747) |
| C5-217 | 19 nt | Target #1: | 5'-UCUAUUAAAAGUUAUCCUG-3' | (SEQ ID NO: 15128) |
| C5-217 | 19 nt | Target #2: | 5'-CUCUAUUAAAAGUUAUCCU-3' | (SEQ ID NO: 17438) |
| C5-217 | 19 nt | Target #3: | 5'-UCUCUAUUAAAAGUUAUCC-3' | (SEQ ID NO: 19748) |
| C5-219 | 19 nt | Target #1: | 5'-UAUUAAAAGUUAUCCUGAU-3' | (SEQ ID NO: 15129) |
| C5-219 | 19 nt | Target #2: | 5'-CUAUUAAAAGUUAUCCUGA-3' | (SEQ ID NO: 17439) |
| C5-219 | 19 nt | Target #3: | 5'-UCUAUUAAAAGUUAUCCUG-3' | (SEQ ID NO: 19749) |
| C5-221 | 19 nt | Target #1: | 5'-UUAAAAGUUAUCCUGAUAA-3' | (SEQ ID NO: 15130) |
| C5-221 | 19 nt | Target #2: | 5'-AUUAAAAGUUAUCCUGAUA-3' | (SEQ ID NO: 17440) |
| C5-221 | 19 nt | Target #3: | 5'-UAUUAAAAGUUAUCCUGAU-3' | (SEQ ID NO: 19750) |
| C5-222 | 19 nt | Target #1: | 5'-UAAAAGUUAUCCUGAUAAA-3' | (SEQ ID NO: 15131) |
| C5-222 | 19 nt | Target #2: | 5'-UUAAAAGUUAUCCUGAUAA-3' | (SEQ ID NO: 17441) |
| C5-222 | 19 nt | Target #3: | 5'-AUUAAAAGUUAUCCUGAUA-3' | (SEQ ID NO: 19751) |
| C5-225 | 19 nt | Target #1: | 5'-AAGUUAUCCUGAUAAAAAA-3' | (SEQ ID NO: 15132) |
| C5-225 | 19 nt | Target #2: | 5'-AAAGUUAUCCUGAUAAAAA-3' | (SEQ ID NO: 17442) |
| C5-225 | 19 nt | Target #3: | 5'-AAAAGUUAUCCUGAUAAAA-3' | (SEQ ID NO: 19752) |
| C5-226 | 19 nt | Target #1: | 5'-AGUUAUCCUGAUAAAAAAU-3' | (SEQ ID NO: 15133) |
| C5-226 | 19 nt | Target #2: |

TABLE 10-continued

DsiRNA Component 19 Nucleotide Target Sequences of Human Anti-C5
DsiRNAs Predicted to have >50% Knockdown Efficac TABLE 10-continued DsiRNA Component 19 Nucleotide Target Sequences of Human Anti-C5
DsiRNAs Predicted to have >50% Knockdown Efficac TABLE 10-continued DsiRNA Component 19 Nucleotide Target Sequences of Human Anti-C5
DsiRNAs Predicted to have >50% Knockdown Efficacy

| | |

TABLE 10-continued

DsiRNA Component 19 Nucleotide Target Sequences of Human Anti-C5
DsiRNAs Predicted to have >50% Knockdown Efficac TABLE 10-continued DsiRNA Component 19 Nucleotide Target Sequences of Human Anti-C5
DsiRNAs Predicted to have >50% Knockdown Efficacy

| |

TABLE 10-continued

DsiRNA Component 19 Nucleotide Target Sequences of Human Anti-C5
DsiRNAs Predicted to have >50% Knockdown Efficacy

| ID | Length

TABLE 10-continued

DsiRNA Component 19 Nucleotide Target Sequences of Human Anti-C5
DsiRNAs Predicted to have >50% Knockdown Efficac TABLE 10-continued DsiRNA Component 19 Nucleotide Target Sequences of Human Anti-C5
DsiRNAs Predicted to have >50% Knockdown Efficacy

| | | | | |
|---|---|---|---|---|
| C5-623 | 19 nt | Target #1: | 5'-UUCCGUCUAAUCCUAGAUA-3' | (SEQ ID NO: 15314) |
| C5-623 | 19 nt | Target #2: | 5'-AUUCCGUCUAAUCCUAGAU-3' | (SEQ ID NO: 17624) |
| C5-623 | 19 nt | Target #3: | 5'-GAUUCCGUCUAAUCCUAGA-3' | (SEQ ID NO: 19934) |
| C5-624 | 19 nt | Target #1: | 5'-UCCGUCUAAUCCUAGAUAU-3' | (SEQ ID NO: 15315) |
| C5-624 | 19 nt | Target #2: | 5'-UUCCGUCUAAUCCUAGAUA-3' | (SEQ ID NO: 17625) |
| C5-624 | 19 nt | Target #3: | 5'-AUUCCGUCUAAUCCUAGAU-3' | (SEQ ID NO: 19935) |
| C5-625 | 19 nt | Target #1: | 5'-CCGUCUAAUCCUAGAUAUG-3' | (SEQ ID NO: 15316) |
| C5-625 | 19 nt | Target #2: | 5'-UCCGUCUAAUCCUAGAUAU-3' | (SEQ ID NO: 17626) |
| C5-625 | 19 nt | Target #3: | 5'-UUCCGUCUAAUCCUAGAUA-3' | (SEQ ID NO: 19936) |
| C5-626 | 19 nt | Target #1: | 5'-CGUCUAAUCCUAGAUAUGG-3' | (SEQ ID NO: 15317) |
| C5-626 | 19 nt | Target #2: | 5'-CCGUCUAAUCCUAGAUAUG-3' | (SEQ ID NO: 17627) |
| C5-626 | 19 nt | Target #3: | 5'-UCCGUCUAAUCCUAGAUAU-3' | (SEQ ID NO: 19937) |
| C5-627 | 19 nt | Target #1: | 5'-GUCUAAUCCUAGAUAUGGU-3' | (SEQ ID NO: 15318) |
| C5-627 | 19 nt | Target #2: | 5'-CGUCUAAUCCUAGAUAUGG-3' | (SEQ ID NO: 17628) |
| C5-627 | 19 nt | Target #3: | 5'-CCGUCUAAUCCUAGAUAUG-3' | (SEQ ID NO: 19938) |
| C5-628 | 19 nt | Target #1: | 5'-UCUAAUCCUAGAUAUGGUA-3' | (SEQ ID NO: 15319) |
| C5-628 | 19 nt | Target #2: | 5'-GUCUAAUCCUAGAUAUGGU-3' | (SEQ ID NO: 17629) |
| C5-628 | 19 nt | Target #3: | 5'-CGUCUAAUCCUAGAUAUGG-3' | (SEQ ID NO: 19939) |
| C5-629 | 19 nt | Target #1: | 5'-CUAAUCCUAGAUAUGGUAU-3' | (SEQ ID NO: 15320) |
| C5-629 | 19 nt | Target #2: | 5'-UCUAAUCCUAGAUAUGGUA-3' | (SEQ ID NO: 17630) |
| C5-629 | 19 nt | Target #3: | 5'-GUCUAAUCCUAGAUAUGGU-3' | (SEQ ID NO: 19940) |
| C5-630 | 19 nt | Target #1: | 5'-UAAUCCUAGAUAUGGUAUG-3' | (SEQ ID NO: 15321) |
| C5-630 | 19 nt | Target #2: | 5'-CUAAUCCUAGAUAUGGUAU-3' | (SEQ ID NO: 17631) |
| C5-630 | 19 nt | Target #3: | 5'-UCUAAUCCUAGAUAUGGUA-3' | (SEQ ID NO: 19941) |
| C5-631 | 19 nt | Target #1: | 5'-AAUCCUAGAUAUGGUAUGU-3' | (SEQ ID NO: 15322) |
| C5-631 | 19 nt | Target #2: | 5'-UAAUCCUAGAUAUGGUAUG-3' | (SEQ ID NO: 17632) |
| C5-631 | 19 nt | Target #3: | 5'-CUAAUCCUAGAUAUGGUAU-3' | (SEQ ID NO: 19942) |
| C5-632 | 19 nt | Target #1: | 5'-AUCCUAGAUAUGGUAUGUG-3' | (SEQ ID NO: 15323) |
| C5-632 | 19 nt | Target #2: | 5'-AAUCCUAGAUAUGGUAUGU-3' | (SEQ ID NO: 17633) |
| C5-632 | 19 nt | Target #3: | 5'-UAAUCCUAGAUAUGGUAUG-3' | (SEQ ID NO: 19943) |
| C5-633 | 19 nt | Target #1: | 5'-UCCUAGAUAUGGUAUGUGG-3' | (SEQ ID NO: 15324) |
| C5-633 | 19 nt | Target #2: | 5'-AUCCUAGAUAUGGUAUGUG-3' | (SEQ ID NO: 17634) |
| C5-633 | 19 nt | Target #3: | 5'-AAUCCUAGAUAUGGUAUGU-3' | (SEQ ID NO: 19944) |
| C5-634 | 19 nt | Target #1: | 5'-CCUAGAUAUGGUAUGUGGA-3' | (SEQ ID NO: 15325) |
| C5-634 | 19 nt | Target #2: | 5'-UCCUAGAUAUGGUAUGUGG-3' | (SEQ ID NO: 17635) |
| C5-634 | 19 nt | Target #3: | 5'-AUCCUAGAUAUGGUAUGUG-3' | (SEQ ID NO: 19945) |
| C5-659 | 19 nt | Target #1: | 5'-AGGCUAAAUAUAAAGAGGA-3' | (SEQ ID NO: 15326) |
| C5-659 | 19 nt | Target #2: | 5'-AAGGCUAAAUAUAAAGAGG-3' | (SEQ ID NO: 17636) |
| C5-659 | 19 nt | Target #3: | 5'-CAAGGCUAAAUAUAAAGAG-3' | (SEQ ID NO: 19946) |
| C5-660 | 19 nt | Target #1: | 5'-GGCUAAAUAUAAAGAGGAC-3' | (SEQ ID NO: 15327) |
| C5-660 | 19 nt | Target #2: | 5'-AGGCUAAAUAUAAAGAGGA-3' | (SEQ ID NO: 17637) |
| C5-660 | 19 nt | Target #3: | 5'-AAGGCUAAAUAUAAAGAGG-3' | (SEQ ID NO: 19947) |
| C5-661 | 19 nt | Target #1: | 5'-GCUAAAUAUAAAGAGGACU-3' | (SEQ ID NO: 15328) |
| C5-661 | 19 nt | Target #2: | 5'-GGCUAAAUAUAAAGAGGAC-3' | (SEQ ID NO: 17638) |
| C5-661 | 19 nt | Target #3: | 5'-AGGCUAAAUAUAAAGAGGA-3' | (SEQ ID NO: 19948) |
| C5-662 | 19 nt | Target #1: | 5'-CUAAAUAUAAAGAGGACUU-3' | (SEQ ID NO: 15329) |
| C5-662 | 19 nt | Target #2: | 5'-GCUAAAUAUAAAGAGGACU-3' | (SEQ ID NO: 17639) |
| C5-662 | 19 nt | Target #3: | 5'-GGCUAAAUAUAAAGAGGAC-3' | (SEQ ID NO: 19949) |
| C5-663 | 19 nt | Target #1: | 5'-UAAAUAUAAAGAGGACUUU-3' | (SEQ ID NO: 15330) |
| C5-663 | 19 nt | Target #2: | 5'-CUAAAUAUAAAGAGGACUU-3' | (SEQ ID NO: 17640) |
| C5-663 | 19 nt | Target #3: | 5'-GCUAAAUAUAAAGAGGACU-3' | (SEQ ID NO: 19950) |
| C5-664 | 19 nt | Target #1: | 5'-AAAUAUAAAGAGGACUUUU-3' | (SEQ ID NO: 15331) |
| C5-664 | 19 nt | Target #2: | 5'-UAAAUAUAAAGAGGACUUU-3' | (SEQ ID NO: 17641) |
| C5-664 | 19 nt | Target #3: | 5'-CUAAAUAUAAAGAGGACUU-3' | (SEQ ID NO: 19951) |
| C5-665 | 19 nt | Target #1: | 5'-AAUAUAAAGAGGACUUUUC-3' | (SEQ ID NO: 15332) |
| C5-665 | 19 nt | Target #2: | 5'-AAAUAUAAAGAGGACUUUU-3' | (SEQ ID NO: 17642) |
| C5-665 | 19 nt | Target #3: | 5'-UAAAUAUAAAGAGGACUUU-3' | (SEQ ID NO: 19952) |
| C5-666 | 19 nt | Target #1: | 5'-AUAUAAAGAGGACUUUUCA-3' | (SEQ ID NO: 15333) |
| C5-666 | 19 nt | Target #2: | 5'-AAUAUAAAGAGGACUUUUC-3' | (SEQ ID NO: 17643) |
| C5-666 | 19 nt | Target #3: | 5'-AAAUAUAAAGAGGACUUUU-3' | (SEQ ID NO: 19953) |
| C5-667 | 19 nt | Target #1: | 5'-UAUAAAGAGGACUUUUCAA-3' | (SEQ ID NO: 15334) |
| C5-667 | 19 nt | Target #2: | 5'-AUAUAAAGAGGACUUUUCA-3' | (SEQ ID NO: 17644) |
| C5-667 | 19 nt | Target #3: | 5'-AAUAUAAAGAGGACUUUUC-3' | (SEQ ID NO: 19954) |
| C5-668 | 19 nt | Target #1: | 5'-AUAAAGAGGACUUUUCAAC-3' | (SEQ ID NO: 15335) |
| C5-668 | 19 nt | Target #2: | 5'-UAUAAAGAGGACUUUUCAA-3' | (SEQ ID NO: 17645) |
| C5-668 | 19 nt | Target #3: | 5'-AUAUAAAGAGGACUUUUCA-3' | (SEQ ID NO: 19955) |
| C5-669 | 19 nt | Target #1: | 5'-UAAAGAGGACUUUUCAACA-3' | (SEQ ID NO: 15336) |
| C5-669 | 19 nt | Target #2: | 5'-AUAAAGAGGACUUUUCAAC-3' | (SEQ ID NO: 17646) |
| C5-669 | 19 nt | Target #3: | 5'-UAUAAAGAGGACUUUUCAA-3' | (SEQ ID NO: 19956) |
| C5-670 | 19 nt | Target #1: | 5'-AAAGAGGACUUUUCAACAA-3' | (SEQ ID NO: 15337) |
| C5-670 | 19 nt | Target #2: | 5'-UAAAGAGGACUUUUCAACA-3' | (SEQ ID NO: 17647) |
| C5-670 | 19 nt | Target #3: | 5'-AUAAAGAGGACUUUUCAAC-3' | (SEQ ID NO: 19957) |
| C5-671 | 19 nt | Target #1: | 5'-AAGAGGACUUUUCAACAAC-3' | (SEQ ID NO: 15338) |
| C5-671 | 19 nt | Target #2: | 5'-AAAGAGGACUUUUCAACAA-3' | (SEQ ID NO: 17648) |
| C5-671 | 19 nt | Target #3: | 5'-UAAAGAGGACUUUUCAACA-3' | (SEQ ID NO: 19958) |
| C5-672 | 19 nt | Target #1: | 5'-AGAGGACUUUUCAACAACU-3' | (SEQ ID NO: 15339) |
| C5-672 | 19 nt | Target #2: | 5'-AAGAGGACUUUUCAACAAC-3' | (SEQ ID NO: 17649) |

TABLE 10-continued

DsiRNA Component 19 Nucleotide Target Sequences of Human Anti-C5
DsiRNAs Predicted to have >50% Knockdown Efficacy

|

TABLE 10-continued

DsiRNA Component 19 Nucleotide Target Sequences of Human Anti-C5
DsiRNAs Predicted to have >50% Knockdown Efficac TABLE 10-continued DsiRNA Component 19 Nucleotide Target Sequences of Human Anti-C5
DsiRNAs Predicted to have >50% Knockdown Efficacy

| |

TABLE 10-continued

DsiRNA Component 19 Nucleotide Target Sequences of Human Anti-C5
DsiRNAs Predicted to have >50% Knockdown Efficac TABLE 10-continued DsiRNA Component 19 Nucleotide Target Sequences of Human Anti-C5
DsiRNAs Predicted to have >50% Knockdown Efficacy

```
C5-886   19 nt   Target #2:   5'-UGAUCAAAAAGAAAUGAUG-3'   (SEQ ID NO: 17752)
C5-886   19 nt   Target #3:   5'-AUGAUCAAAAAGAAAUGAU-3'   (SEQ ID NO: 20062)
C5-887   19 nt   Target #1:   5'-AUCAAAAAGAAAUGAUGCA-3'   (SEQ ID NO: 15443)
C5-887   19 nt   Target #2:   5'-GAUCAAAAAGAAAUGAUGC-3'   (SEQ ID NO: 17753)
C5-887   19 nt   Target #3:   5'-UGAUCAAAAAGAAAUGAUG-3'   (SEQ ID NO: 20063)
C5-888   19 nt   Target #1:   5'-UCAAAAAGAAAUGAUGCAA-3'   (SEQ ID NO: 15444)
C5-888   19 nt   Target #2:   5'-AUCAAAAAGAAAUGAUGCA-3'   (SEQ ID NO: 17754)
C5-888   19 nt   Target #3:   5'-GAUCAAAAAGAAAUGAUGC-3'   (SEQ ID NO: 20064)
C5-889   19 nt   Target #1:   5'-CAAAAAGAAAUGAUGCAAA-3'   (SEQ ID NO: 15445)
C5-889   19 nt   Target #2:   5'-UCAAAAAGAAAUGAUGCAA-3'   (SEQ ID NO: 17755)
C5-889   19 nt   Target #3:   5'-AUCAAAAAGAAAUGAUGCA-3'   (SEQ ID NO: 20065)
C5-890   19 nt   Target #1:   5'-AAAAAGAAAUGAUGCAAAC-3'   (SEQ ID NO: 15446)
C5-890   19 nt   Target #2:   5'-CAAAAAGAAAUGAUGCAAA-3'   (SEQ ID NO: 17756)
C5-890   19 nt   Target #3:   5'-UCAAAAAGAAAUGAUGCAA-3'   (SEQ ID NO: 20066)
C5-891   19 nt   Target #1:   5'-AAAAGAAAUGAUGCAAACA-3'   (SEQ ID NO: 15447)
C5-891   19 nt   Target #2:   5'-AAAAAGAAAUGAUGCAAAC-3'   (SEQ ID NO: 17757)
C5-891   19 nt   Target #3:   5'-CAAAAAGAAAUGAUGCAAA-3'   (SEQ ID NO: 20067)
C5-892   19 nt   Target #1:   5'-AAAGAAAUGAUGCAAACAG-3'   (SEQ ID NO: 15448)
C5-892   19 nt   Target #2:   5'-AAAAGAAAUGAUGCAAACA-3'   (SEQ ID NO: 17758)
C5-892   19 nt   Target #3:   5'-AAAAAGAAAUGAUGCAAAC-3'   (SEQ ID NO: 20068)
C5-893   19 nt   Target #1:   5'-AAGAAAUGAUGCAAACAGC-3'   (SEQ ID NO: 15449)
C5-893   19 nt   Target #2:   5'-AAAGAAAUGAUGCAAACAG-3'   (SEQ ID NO: 17759)
C5-893   19 nt   Target #3:   5'-AAAAGAAAUGAUGCAAACA-3'   (SEQ ID NO: 20069)
C5-894   19 nt   Target #1:   5'-AGAAAUGAUGCAAACAGCA-3'   (SEQ ID NO: 15450)
C5-894   19 nt   Target #2:   5'-AAGAAAUGAUGCAAACAGC-3'   (SEQ ID NO: 17760)
C5-894   19 nt   Target #3:   5'-AAAGAAAUGAUGCAAACAG-3'   (SEQ ID NO: 20070)
C5-895   19 nt   Target #1:   5'-GAAAUGAUGCAAACAGCAA-3'   (SEQ ID NO: 15451)
C5-895   19 nt   Target #2:   5'-AGAAAUGAUGCAAACAGCA-3'   (SEQ ID NO: 17761)
C5-895   19 nt   Target #3:   5'-AAGAAAUGAUGCAAACAGC-3'   (SEQ ID NO: 20071)
C5-896   19 nt   Target #1:   5'-AAAUGAUGCAAACAGCAAU-3'   (SEQ ID NO: 15452)
C5-896   19 nt   Target #2:   5'-GAAAUGAUGCAAACAGCAA-3'   (SEQ ID NO: 17762)
C5-896   19 nt   Target #3:   5'-AGAAAUGAUGCAAACAGCA-3'   (SEQ ID NO: 20072)
C5-897   19 nt   Target #1:   5'-AAUGAUGCAAACAGCAAUG-3'   (SEQ ID NO: 15453)
C5-897   19 nt   Target #2:   5'-AAAUGAUGCAAACAGCAAU-3'   (SEQ ID NO: 17763)
C5-897   19 nt   Target #3:   5'-GAAAUGAUGCAAACAGCAA-3'   (SEQ ID NO: 20073)
C5-898   19 nt   Target #1:   5'-AUGAUGCAAACAGCAAUGC-3'   (SEQ ID NO: 15454)
C5-898   19 nt   Target #2:   5'-AAUGAUGCAAACAGCAAUG-3'   (SEQ ID NO: 17764)
C5-898   19 nt   Target #3:   5'-AAAUGAUGCAAACAGCAAU-3'   (SEQ ID NO: 20074)
C5-899   19 nt   Target #1:   5'-UGAUGCAAACAGCAAUGCA-3'   (SEQ ID NO: 15455)
C5-899   19 nt   Target #2:   5'-AUGAUGCAAACAGCAAUGC-3'   (SEQ ID NO: 17765)
C5-899   19 nt   Target #3:   5'-AAUGAUGCAAACAGCAAUG-3'   (SEQ ID NO: 20075)
C5-925   19 nt   Target #1:   5'-AUGUUGAUAAAUGGAAUUG-3'   (SEQ ID NO: 15456)
C5-925   19 nt   Target #2:   5'-AAUGUUGAUAAAUGGAAUU-3'   (SEQ ID NO: 17766)
C5-925   19 nt   Target #3:   5'-CAAUGUUGAUAAAUGGAAU-3'   (SEQ ID NO: 20076)
C5-929   19 nt   Target #1:   5'-UGAUAAAUGGAAUUGCUCA-3'   (SEQ ID NO: 15457)
C5-929   19 nt   Target #2:   5'-UUGAUAAAUGGAAUUGCUC-3'   (SEQ ID NO: 17767)
C5-929   19 nt   Target #3:   5'-GUUGAUAAAUGGAAUUGCU-3'   (SEQ ID NO: 20077)
C5-930   19 nt   Target #1:   5'-GAUAAAUGGAAUUGCUCAA-3'   (SEQ ID NO: 15458)
C5-930   19 nt   Target #2:   5'-UGAUAAAUGGAAUUGCUCA-3'   (SEQ ID NO: 17768)
C5-930   19 nt   Target #3:   5'-UUGAUAAAUGGAAUUGCUC-3'   (SEQ ID NO: 20078)
C5-932   19 nt   Target #1:   5'-UAAAUGGAAUUGCUCAAGU-3'   (SEQ ID NO: 15459)
C5-932   19 nt   Target #2:   5'-AUAAAUGGAAUUGCUCAAG-3'   (SEQ ID NO: 17769)
C5-932   19 nt   Target #3:   5'-GAUAAAUGGAAUUGCUCAA-3'   (SEQ ID NO: 20079)
C5-933   19 nt   Target #1:   5'-AAAUGGAAUUGCUCAAGUC-3'   (SEQ ID NO: 15460)
C5-933   19 nt   Target #2:   5'-UAAAUGGAAUUGCUCAAGU-3'   (SEQ ID NO: 17770)
C5-933   19 nt   Target #3:   5'-AUAAAUGGAAUUGCUCAAG-3'   (SEQ ID NO: 20080)
C5-934   19 nt   Target #1:   5'-AAUGGAAUUGCUCAAGUCA-3'   (SEQ ID NO: 15461)
C5-934   19 nt   Target #2:   5'-AAAUGGAAUUGCUCAAGUC-3'   (SEQ ID NO: 17771)
C5-934   19 nt   Target #3:   5'-UAAAUGGAAUUGCUCAAGU-3'   (SEQ ID NO: 20081)
C5-936   19 nt   Target #1:   5'-UGGAAUUGCUCAAGUCACA-3'   (SEQ ID NO: 15462)
C5-936   19 nt   Target #2:   5'-AUGGAAUUGCUCAAGUCAC-3'   (SEQ ID NO: 17772)
C5-936   19 nt   Target #3:   5'-AAUGGAAUUGCUCAAGUCA-3'   (SEQ ID NO: 20082)
C5-937   19 nt   Target #1:   5'-GGAAUUGCUCAAGUCACAU-3'   (SEQ ID NO: 15463)
C5-937   19 nt   Target #2:   5'-UGGAAUUGCUCAAGUCACA-3'   (SEQ ID NO: 17773)
C5-937   19 nt   Target #3:   5'-AUGGAAUUGCUCAAGUCAC-3'   (SEQ ID NO: 20083)
C5-938   19 nt   Target #1:   5'-GAAUUGCUCAAGUCACAUU-3'   (SEQ ID NO: 15464)
C5-938   19 nt   Target #2:   5'-GGAAUUGCUCAAGUCACAU-3'   (SEQ ID NO: 17774)
C5-938   19 nt   Target #3:   5'-UGGAAUUGCUCAAGUCACA-3'   (SEQ ID NO: 20084)
C5-939   19 nt   Target #1:   5'-AAUUGCUCAAGUCACAUUU-3'   (SEQ ID NO: 15465)
C5-939   19 nt   Target #2:   5'-GAAUUGCUCAAGUCACAUU-3'   (SEQ ID NO: 17775)
C5-939   19 nt   Target #3:   5'-GGAAUUGCUCAAGUCACAU-3'   (SEQ ID NO: 20085)
C5-940   19 nt   Target #1:   5'-AUUGCUCAAGUCACAUUUG-3'   (SEQ ID NO: 15466)
C5-940   19 nt   Target #2:   5'-AAUUGCUCAAGUCACAUUU-3'   (SEQ ID NO: 17776)
C5-940   19 nt   Target #3:   5'-GAAUUGCUCAAGUCACAUU-3'   (SEQ ID NO: 20086)
C5-941   19 nt   Target #1:   5'-UUGCUCAAGUCACAUUUGA-3'   (SEQ ID NO: 15467)
C5-941   19 nt   Target #2:   5'-AUUGCUCAAGUCACAUUUG-3'   (SEQ ID NO: 17777)
C5-941   19 nt   Target #3:   5'-AAUUGCUCAAGUCACAUUU-3'   (SEQ ID NO: 20087)
```

TABLE 10-continued

DsiRNA Component 19 Nucleotide Target Sequences of Human Anti-C5 DsiRNAs Predicted to have >50% Knockdown Efficacy

| | | | | |
|---|---|---|---|---|
| C5-942 | 19 nt | Target #1: | 5'-UGCUCAAGUCACAUUUGAU-3' | (SEQ ID NO: 15468) |
| C5-942 | 19 nt | Target #2: | 5'-UUGCUCAAGUCACAUUUGA-3' | (SEQ ID NO: 17778) |
| C5-942 | 19 nt | Target #3: | 5'-AUUGCUCAAGUCACAUUUG-3' | (SEQ ID NO: 20088) |
| C5-943 | 19 nt | Target #1: | 5'-GCUCAAGUCACAUUUGAUU-3' | (SEQ ID NO: 15469) |
| C5-943 | 19 nt | Target #2: | 5'-UGCUCAAGUCACAUUUGAU-3' | (SEQ ID NO: 17779) |
| C5-943 | 19 nt | Target #3: | 5'-UUGCUCAAGUCACAUUUGA-3' | (SEQ ID NO: 20089) |
| C5-945 | 19 nt | Target #1: | 5'-UCAAGUCACAUUUGAUUCU-3' | (SEQ ID NO: 15470) |
| C5-945 | 19 nt | Target #2: | 5'-CUCAAGUCACAUUUGAUUC-3' | (SEQ ID NO: 17780) |
| C5-945 | 19 nt | Target #3: | 5'-GCUCAAGUCACAUUUGAUU-3' | (SEQ ID NO: 20090) |
| C5-949 | 19 nt | Target #1: | 5'-GUCACAUUUGAUUCUGAAA-3' | (SEQ ID NO: 15471) |
| C5-949 | 19 nt | Target #2: | 5'-AGUCACAUUUGAUUCUGAA-3' | (SEQ ID NO: 17781) |
| C5-949 | 19 nt | Target #3: | 5'-AAGUCACAUUUGAUUCUGA-3' | (SEQ ID NO: 20091) |
| C5-950 | 19 nt | Target #1: | 5'-UCACAUUUGAUUCUGAAAC-3' | (SEQ ID NO: 15472) |
| C5-950 | 19 nt | Target #2: | 5'-GUCACAUUUGAUUCUGAAA-3' | (SEQ ID NO: 17782) |
| C5-950 | 19 nt | Target #3: | 5'-AGUCACAUUUGAUUCUGAA-3' | (SEQ ID NO: 20092) |
| C5-951 | 19 nt | Target #1: | 5'-CACAUUUGAUUCUGAAACA-3' | (SEQ ID NO: 15473) |
| C5-951 | 19 nt | Target #2: | 5'-UCACAUUUGAUUCUGAAAC-3' | (SEQ ID NO: 17783) |
| C5-951 | 19 nt | Target #3: | 5'-GUCACAUUUGAUUCUGAAA-3' | (SEQ ID NO: 20093) |
| C5-952 | 19 nt | Target #1: | 5'-ACAUUUGAUUCUGAAACAG-3' | (SEQ ID NO: 15474) |
| C5-952 | 19 nt | Target #2: | 5'-CACAUUUGAUUCUGAAACA-3' | (SEQ ID NO: 17784) |
| C5-952 | 19 nt | Target #3: | 5'-UCACAUUUGAUUCUGAAAC-3' | (SEQ ID NO: 20094) |
| C5-954 | 19 nt | Target #1: | 5'-AUUUGAUUCUGAAACAGCA-3' | (SEQ ID NO: 15475) |
| C5-954 | 19 nt | Target #2: | 5'-CAUUUGAUUCUGAAACAGC-3' | (SEQ ID NO: 17785) |
| C5-954 | 19 nt | Target #3: | 5'-ACAUUUGAUUCUGAAACAG-3' | (SEQ ID NO: 20095) |
| C5-957 | 19 nt | Target #1: | 5'-UGAUUCUGAAACAGCAGUC-3' | (SEQ ID NO: 15476) |
| C5-957 | 19 nt | Target #2: | 5'-UUGAUUCUGAAACAGCAGU-3' | (SEQ ID NO: 17786) |
| C5-957 | 19 nt | Target #3: | 5'-UUUGAUUCUGAAACAGCAG-3' | (SEQ ID NO: 20096) |
| C5-958 | 19 nt | Target #1: | 5'-GAUUCUGAAACAGCAGUCA-3' | (SEQ ID NO: 15477) |
| C5-958 | 19 nt | Target #2: | 5'-UGAUUCUGAAACAGCAGUC-3' | (SEQ ID NO: 17787) |
| C5-958 | 19 nt | Target #3: | 5'-UUGAUUCUGAAACAGCAGU-3' | (SEQ ID NO: 20097) |
| C5-959 | 19 nt | Target #1: | 5'-AUUCUGAAACAGCAGUCAA-3' | (SEQ ID NO: 15478) |
| C5-959 | 19 nt | Target #2: | 5'-GAUUCUGAAACAGCAGUCA-3' | (SEQ ID NO: 17788) |
| C5-959 | 19 nt | Target #3: | 5'-UGAUUCUGAAACAGCAGUC-3' | (SEQ ID NO: 20098) |
| C5-960 | 19 nt | Target #1: | 5'-UUCUGAAACAGCAGUCAAA-3' | (SEQ ID NO: 15479) |
| C5-960 | 19 nt | Target #2: | 5'-AUUCUGAAACAGCAGUCAA-3' | (SEQ ID NO: 17789) |
| C5-960 | 19 nt | Target #3: | 5'-GAUUCUGAAACAGCAGUCA-3' | (SEQ ID NO: 20099) |
| C5-961 | 19 nt | Target #1: | 5'-UCUGAAACAGCAGUCAAAG-3' | (SEQ ID NO: 15480) |
| C5-961 | 19 nt | Target #2: | 5'-UUCUGAAACAGCAGUCAAA-3' | (SEQ ID NO: 17790) |
| C5-961 | 19 nt | Target #3: | 5'-AUUCUGAAACAGCAGUCAA-3' | (SEQ ID NO: 20100) |
| C5-962 | 19 nt | Target #1: | 5'-CUGAAACAGCAGUCAAAGA-3' | (SEQ ID NO: 15481) |
| C5-962 | 19 nt | Target #2: | 5'-UCUGAAACAGCAGUCAAAG-3' | (SEQ ID NO: 17791) |
| C5-962 | 19 nt | Target #3: | 5'-UUCUGAAACAGCAGUCAAA-3' | (SEQ ID NO: 20101) |
| C5-963 | 19 nt | Target #1: | 5'-UGAAACAGCAGUCAAAGAA-3' | (SEQ ID NO: 15482) |
| C5-963 | 19 nt | Target #2: | 5'-CUGAAACAGCAGUCAAAGA-3' | (SEQ ID NO: 17792) |
| C5-963 | 19 nt | Target #3: | 5'-UCUGAAACAGCAGUCAAAG-3' | (SEQ ID NO: 20102) |
| C5-964 | 19 nt | Target #1: | 5'-GAAACAGCAGUCAAAGAAC-3' | (SEQ ID NO: 15483) |
| C5-964 | 19 nt | Target #2: | 5'-UGAAACAGCAGUCAAAGAA-3' | (SEQ ID NO: 17793) |
| C5-964 | 19 nt | Target #3: | 5'-CUGAAACAGCAGUCAAAGA-3' | (SEQ ID NO: 20103) |
| C5-965 | 19 nt | Target #1: | 5'-AAACAGCAGUCAAAGAACU-3' | (SEQ ID NO: 15484) |
| C5-965 | 19 nt | Target #2: | 5'-GAAACAGCAGUCAAAGAAC-3' | (SEQ ID NO: 17794) |
| C5-965 | 19 nt | Target #3: | 5'-UGAAACAGCAGUCAAAGAA-3' | (SEQ ID NO: 20104) |
| C5-966 | 19 nt | Target #1: | 5'-AACAGCAGUCAAAGAACUG-3' | (SEQ ID NO: 15485) |
| C5-966 | 19 nt | Target #2: | 5'-AAACAGCAGUCAAAGAACU-3' | (SEQ ID NO: 17795) |
| C5-966 | 19 nt | Target #3: | 5'-GAAACAGCAGUCAAAGAAC-3' | (SEQ ID NO: 20105) |
| C5-967 | 19 nt | Target #1: | 5'-ACAGCAGUCAAAGAACUGU-3' | (SEQ ID NO: 15486) |
| C5-967 | 19 nt | Target #2: | 5'-AACAGCAGUCAAAGAACUG-3' | (SEQ ID NO: 17796) |
| C5-967 | 19 nt | Target #3: | 5'-AAACAGCAGUCAAAGAACU-3' | (SEQ ID NO: 20106) |
| C5-969 | 19 nt | Target #1: | 5'-AGCAGUCAAAGAACUGUCA-3' | (SEQ ID NO: 15487) |
| C5-969 | 19 nt | Target #2: | 5'-CAGCAGUCAAAGAACUGUC-3' | (SEQ ID NO: 17797) |
| C5-969 | 19 nt | Target #3: | 5'-ACAGCAGUCAAAGAACUGU-3' | (SEQ ID NO: 20107) |
| C5-971 | 19 nt | Target #1: | 5'-CAGUCAAAGAACUGUCAUA-3' | (SEQ ID NO: 15488) |
| C5-971 | 19 nt | Target #2: | 5'-GCAGUCAAAGAACUGUCAU-3' | (SEQ ID NO: 17798) |
| C5-971 | 19 nt | Target #3: | 5'-AGCAGUCAAAGAACUGUCA-3' | (SEQ ID NO: 20108) |
| C5-972 | 19 nt | Target #1: | 5'-AGUCAAAGAACUGUCAUAC-3' | (SEQ ID NO: 15489) |
| C5-972 | 19 nt | Target #2: | 5'-CAGUCAAAGAACUGUCAUA-3' | (SEQ ID NO: 17799) |
| C5-972 | 19 nt | Target #3: | 5'-GCAGUCAAAGAACUGUCAU-3' | (SEQ ID NO: 20109) |
| C5-974 | 19 nt | Target #1: | 5'-UCAAAGAACUGUCAUACUA-3' | (SEQ ID NO: 15490) |
| C5-974 | 19 nt | Target #2: | 5'-GUCAAAGAACUGUCAUACU-3' | (SEQ ID NO: 17800) |
| C5-974 | 19 nt | Target #3: | 5'-AGUCAAAGAACUGUCAUAC-3' | (SEQ ID NO: 20110) |
| C5-975 | 19 nt | Target #1: | 5'-CAAAGAACUGUCAUACUAC-3' | (SEQ ID NO: 15491) |
| C5-975 | 19 nt | Target #2: | 5'-UCAAAGAACUGUCAUACUA-3' | (SEQ ID NO: 17801) |
| C5-975 | 19 nt | Target #3: | 5'-GUCAAAGAACUGUCAUACU-3' | (SEQ ID NO: 20111) |
| C5-976 | 19 nt | Target #1: | 5'-AAAGAACUGUCAUACUACA-3' | (SEQ ID NO: 15492) |
| C5-976 | 19 nt | Target #2: | 5'-CAAAGAACUGUCAUACUAC-3' | (SEQ ID NO: 17802) |
| C5-976 | 19 nt | Target #3: | 5'-UCAAAGAACUGUCAUACUA-3' | (SEQ ID NO: 20112) |
| C5-979 | 19 nt | Target #1: | 5'-GAACUGUCAUACUACAGUU-3' | (SEQ ID NO: 15493) |
| C5-979 | 19 nt | Target #2: | 5'-AGAACUGUCAUACUACAGU-3' | (SEQ ID NO: 17803) |

TABLE 10-continued

DsiRNA Component 19 Nucleotide Target Sequences of Human Anti-C5 DsiRNAs Predicted to have >50% Knockdown Efficacy

| | | | | |
|---|---|---|---|---|
| C5-979 | 19 nt | Target #3: | 5'-AAGAACUGUCAUACUACAG-3' | (SEQ ID NO: 20113) |
| C5-981 | 19 nt | Target #1: | 5'-ACUGUCAUACUACAGUUUA-3' | (SEQ ID NO: 15494) |
| C5-981 | 19 nt | Target #2: | 5'-AACUGUCAUACUACAGUUU-3' | (SEQ ID NO: 17804) |
| C5-981 | 19 nt | Target #3: | 5'-GAACUGUCAUACUACAGUU-3' | (SEQ ID NO: 20114) |
| C5-982 | 19 nt | Target #1: | 5'-CUGUCAUACUACAGUUUAG-3' | (SEQ ID NO: 15495) |
| C5-982 | 19 nt | Target #2: | 5'-ACUGUCAUACUACAGUUUA-3' | (SEQ ID NO: 17805) |
| C5-982 | 19 nt | Target #3: | 5'-AACUGUCAUACUACAGUUU-3' | (SEQ ID NO: 20115) |
| C5-983 | 19 nt | Target #1: | 5'-UGUCAUACUACAGUUUAGA-3' | (SEQ ID NO: 15496) |
| C5-983 | 19 nt | Target #2: | 5'-CUGUCAUACUACAGUUUAG-3' | (SEQ ID NO: 17806) |
| C5-983 | 19 nt | Target #3: | 5'-ACUGUCAUACUACAGUUUA-3' | (SEQ ID NO: 20116) |
| C5-984 | 19 nt | Target #1: | 5'-GUCAUACUACAGUUUAGAA-3' | (SEQ ID NO: 15497) |
| C5-984 | 19 nt | Target #2: | 5'-UGUCAUACUACAGUUUAGA-3' | (SEQ ID NO: 17807) |
| C5-984 | 19 nt | Target #3: | 5'-CUGUCAUACUACAGUUUAG-3' | (SEQ ID NO: 20117) |
| C5-985 | 19 nt | Target #1: | 5'-UCAUACUACAGUUUAGAAG-3' | (SEQ ID NO: 15498) |
| C5-985 | 19 nt | Target #2: | 5'-GUCAUACUACAGUUUAGAA-3' | (SEQ ID NO: 17808) |
| C5-985 | 19 nt | Target #3: | 5'-UGUCAUACUACAGUUUAGA-3' | (SEQ ID NO: 20118) |
| C5-986 | 19 nt | Target #1: | 5'-CAUACUACAGUUUAGAAGA-3' | (SEQ ID NO: 15499) |
| C5-986 | 19 nt | Target #2: | 5'-UCAUACUACAGUUUAGAAG-3' | (SEQ ID NO: 17809) |
| C5-986 | 19 nt | Target #3: | 5'-GUCAUACUACAGUUUAGAA-3' | (SEQ ID NO: 20119) |
| C5-987 | 19 nt | Target #1: | 5'-AUACUACAGUUUAGAAGAU-3' | (SEQ ID NO: 15500) |
| C5-987 | 19 nt | Target #2: | 5'-CAUACUACAGUUUAGAAGA-3' | (SEQ ID NO: 17810) |
| C5-987 | 19 nt | Target #3: | 5'-UCAUACUACAGUUUAGAAG-3' | (SEQ ID NO: 20120) |
| C5-988 | 19 nt | Target #1: | 5'-UACUACAGUUUAGAAGAUU-3' | (SEQ ID NO: 15501) |
| C5-988 | 19 nt | Target #2: | 5'-AUACUACAGUUUAGAAGAU-3' | (SEQ ID NO: 17811) |
| C5-988 | 19 nt | Target #3: | 5'-CAUACUACAGUUUAGAAGA-3' | (SEQ ID NO: 20121) |
| C5-989 | 19 nt | Target #1: | 5'-ACUACAGUUUAGAAGAUUU-3' | (SEQ ID NO: 15502) |
| C5-989 | 19 nt | Target #2: | 5'-UACUACAGUUUAGAAGAUU-3' | (SEQ ID NO: 17812) |
| C5-989 | 19 nt | Target #3: | 5'-AUACUACAGUUUAGAAGAU-3' | (SEQ ID NO: 20122) |
| C5-990 | 19 nt | Target #1: | 5'-CUACAGUUUAGAAGAUUUA-3' | (SEQ ID NO: 15503) |
| C5-990 | 19 nt | Target #2: | 5'-ACUACAGUUUAGAAGAUUU-3' | (SEQ ID NO: 17813) |
| C5-990 | 19 nt | Target #3: | 5'-UACUACAGUUUAGAAGAUU-3' | (SEQ ID NO: 20123) |
| C5-991 | 19 nt | Target #1: | 5'-UACAGUUUAGAAGAUUUAA-3' | (SEQ ID NO: 15504) |
| C5-991 | 19 nt | Target #2: | 5'-CUACAGUUUAGAAGAUUUA-3' | (SEQ ID NO: 17814) |
| C5-991 | 19 nt | Target #3: | 5'-ACUACAGUUUAGAAGAUUU-3' | (SEQ ID NO: 20124) |
| C5-992 | 19 nt | Target #1: | 5'-ACAGUUUAGAAGAUUUAAA-3' | (SEQ ID NO: 15505) |
| C5-992 | 19 nt | Target #2: | 5'-UACAGUUUAGAAGAUUUAA-3' | (SEQ ID NO: 17815) |
| C5-992 | 19 nt | Target #3: | 5'-CUACAGUUUAGAAGAUUUA-3' | (SEQ ID NO: 20125) |
| C5-993 | 19 nt | Target #1: | 5'-CAGUUUAGAAGAUUUAAAC-3' | (SEQ ID NO: 15506) |
| C5-993 | 19 nt | Target #2: | 5'-ACAGUUUAGAAGAUUUAAA-3' | (SEQ ID NO: 17816) |
| C5-993 | 19 nt | Target #3: | 5'-UACAGUUUAGAAGAUUUAA-3' | (SEQ ID NO: 20126) |
| C5-994 | 19 nt | Target #1: | 5'-AGUUUAGAAGAUUUAAACA-3' | (SEQ ID NO: 15507) |
| C5-994 | 19 nt | Target #2: | 5'-CAGUUUAGAAGAUUUAAAC-3' | (SEQ ID NO: 17817) |
| C5-994 | 19 nt | Target #3: | 5'-ACAGUUUAGAAGAUUUAAA-3' | (SEQ ID NO: 20127) |
| C5-995 | 19 nt | Target #1: | 5'-GUUUAGAAGAUUUAAACAA-3' | (SEQ ID NO: 15508) |
| C5-995 | 19 nt | Target #2: | 5'-AGUUUAGAAGAUUUAAACA-3' | (SEQ ID NO: 17818) |
| C5-995 | 19 nt | Target #3: | 5'-CAGUUUAGAAGAUUUAAAC-3' | (SEQ ID NO: 20128) |
| C5-996 | 19 nt | Target #1: | 5'-UUUAGAAGAUUUAAACAAC-3' | (SEQ ID NO: 15509) |
| C5-996 | 19 nt | Target #2: | 5'-GUUUAGAAGAUUUAAACAA-3' | (SEQ ID NO: 17819) |
| C5-996 | 19 nt | Target #3: | 5'-AGUUUAGAAGAUUUAAACA-3' | (SEQ ID NO: 20129) |
| C5-997 | 19 nt | Target #1: | 5'-UUAGAAGAUUUAAACAACA-3' | (SEQ ID NO: 15510) |
| C5-997 | 19 nt | Target #2: | 5'-UUUAGAAGAUUUAAACAAC-3' | (SEQ ID NO: 17820) |
| C5-997 | 19 nt | Target #3: | 5'-GUUUAGAAGAUUUAAACAA-3' | (SEQ ID NO: 20130) |
| C5-998 | 19 nt | Target #1: | 5'-UAGAAGAUUUAAACAACAA-3' | (SEQ ID NO: 15511) |
| C5-998 | 19 nt | Target #2: | 5'-UUAGAAGAUUUAAACAACA-3' | (SEQ ID NO: 17821) |
| C5-998 | 19 nt | Target #3: | 5'-UUUAGAAGAUUUAAACAAC-3' | (SEQ ID NO: 20131) |
| C5-999 | 19 nt | Target #1: | 5'-AGAAGAUUUAAACAACAAG-3' | (SEQ ID NO: 15512) |
| C5-999 | 19 nt | Target #2: | 5'-UAGAAGAUUUAAACAACAA-3' | (SEQ ID NO: 17822) |
| C5-999 | 19 nt | Target #3: | 5'-UUAGAAGAUUUAAACAACA-3' | (SEQ ID NO: 20132) |
| C5-1000 | 19 nt | Target #1: | 5'-GAAGAUUUAAACAACAAGU-3' | (SEQ ID NO: 15513) |
| C5-1000 | 19 nt | Target #2: | 5'-AGAAGAUUUAAACAACAAG-3' | (SEQ ID NO: 17823) |
| C5-1000 | 19 nt | Target #3: | 5'-UAGAAGAUUUAAACAACAA-3' | (SEQ ID NO: 20133) |
| C5-1001 | 19 nt | Target #1: | 5'-AAGAUUUAAACAACAAGUA-3' | (SEQ ID NO: 15514) |
| C5-1001 | 19 nt | Target #2: | 5'-GAAGAUUUAAACAACAAGU-3' | (SEQ ID NO: 17824) |
| C5-1001 | 19 nt | Target #3: | 5'-AGAAGAUUUAAACAACAAG-3' | (SEQ ID NO: 20134) |
| C5-1002 | 19 nt | Target #1: | 5'-AGAUUUAAACAACAAGUAC-3' | (SEQ ID NO: 15515) |
| C5-1002 | 19 nt | Target #2: | 5'-AAGAUUUAAACAACAAGUA-3' | (SEQ ID NO: 17825) |
| C5-1002 | 19 nt | Target #3: | 5'-GAAGAUUUAAACAACAAGU-3' | (SEQ ID NO: 20135) |
| C5-1003 | 19 nt | Target #1: | 5'-GAUUUAAACAACAAGUACC-3' | (SEQ ID NO: 15516) |
| C5-1003 | 19 nt | Target #2: | 5'-AGAUUUAAACAACAAGUAC-3' | (SEQ ID NO: 17826) |
| C5-1003 | 19 nt | Target #3: | 5'-AAGAUUUAAACAACAAGUA-3' | (SEQ ID NO: 20136) |
| C5-1004 | 19 nt | Target #1: | 5'-AUUUAAACAACAAGUACCU-3' | (SEQ ID NO: 15517) |
| C5-1004 | 19 nt | Target #2: | 5'-GAUUUAAACAACAAGUACC-3' | (SEQ ID NO: 17827) |
| C5-1004 | 19 nt | Target #3: | 5'-AGAUUUAAACAACAAGUAC-3' | (SEQ ID NO: 20137) |
| C5-1005 | 19 nt | Target #1: | 5'-UUUAAACAACAAGUACCUU-3' | (SEQ ID NO: 15518) |
| C5-1005 | 19 nt | Target #2: | 5'-AUUUAAACAACAAGUACCU-3' | (SEQ ID NO: 17828) |
| C5-1005 | 19 nt | Target #3: | 5'-GAUUUAAACAACAAGUACC-3' | (SEQ ID NO: 20138) |
| C5-1018 | 19 nt | Target #1: | 5'-UACCUUUAUAUUGCUGUAA-3' | (SEQ ID NO: 15519) |

TABLE 10-continued

DsiRNA Component 19 Nucleotide Target Sequences of Human Anti-C5
DsiRNAs Predicted to have >50% Knockdown Efficacy

| | | | | |
|---|---|---|---|---|
| C5-1018 | 19 nt | Target #2: | 5'-GUACCUUUAUAUUGCUGUA-3' | (SEQ ID NO: 17829) |
| C5-1018 | 19 nt | Target #3: | 5'-AGUACCUUUAUAUUGCUGU-3' | (SEQ ID NO: 20139) |
| C5-1020 | 19 nt | Target #1: | 5'-CCUUUAUAUUGCUGUAACA-3' | (SEQ ID NO: 15520) |
| C5-1020 | 19 nt | Target #2: | 5'-ACCUUUAUAUUGCUGUAAC-3' | (SEQ ID NO: 17830) |
| C5-1020 | 19 nt | Target #3: | 5'-UACCUUUAUAUUGCUGUAA-3' | (SEQ ID NO: 20140) |
| C5-1021 | 19 nt | Target #1: | 5'-CUUUAUAUUGCUGUAACAG-3' | (SEQ ID NO: 15521) |
| C5-1021 | 19 nt | Target #2: | 5'-CCUUUAUAUUGCUGUAACA-3' | (SEQ ID NO: 17831) |
| C5-1021 | 19 nt | Target #3: | 5'-ACCUUUAUAUUGCUGUAAC-3' | (SEQ ID NO: 20141) |
| C5-1022 | 19 nt | Target #1: | 5'-UUUAUAUUGCUGUAACAGU-3' | (SEQ ID NO: 15522) |
| C5-1022 | 19 nt | Target #2: | 5'-CUUUAUAUUGCUGUAACAG-3' | (SEQ ID NO: 17832) |
| C5-1022 | 19 nt | Target #3: | 5'-CCUUUAUAUUGCUGUAACA-3' | (SEQ ID NO: 20142) |
| C5-1023 | 19 nt | Target #1: | 5'-UUAUAUUGCUGUAACAGUC-3' | (SEQ ID NO: 15523) |
| C5-1023 | 19 nt | Target #2: | 5'-UUUAUAUUGCUGUAACAGU-3' | (SEQ ID NO: 17833) |
| C5-1023 | 19 nt | Target #3: | 5'-CUUUAUAUUGCUGUAACAG-3' | (SEQ ID NO: 20143) |
| C5-1024 | 19 nt | Target #1: | 5'-UAUAUUGCUGUAACAGUCA-3' | (SEQ ID NO: 15524) |
| C5-1024 | 19 nt | Target #2: | 5'-UUAUAUUGCUGUAACAGUC-3' | (SEQ ID NO: 17834) |
| C5-1024 | 19 nt | Target #3: | 5'-UUUAUAUUGCUGUAACAGU-3' | (SEQ ID NO: 20144) |
| C5-1025 | 19 nt | Target #1: | 5'-AUAUUGCUGUAACAGUCAU-3' | (SEQ ID NO: 15525) |
| C5-1025 | 19 nt | Target #2: | 5'-UAUAUUGCUGUAACAGUCA-3' | (SEQ ID NO: 17835) |
| C5-1025 | 19 nt | Target #3: | 5'-UUAUAUUGCUGUAACAGUC-3' | (SEQ ID NO: 20145) |
| C5-1026 | 19 nt | Target #1: | 5'-UAUUGCUGUAACAGUCAUA-3' | (SEQ ID NO: 15526) |
| C5-1026 | 19 nt | Target #2: | 5'-AUAUUGCUGUAACAGUCAU-3' | (SEQ ID NO: 17836) |
| C5-1026 | 19 nt | Target #3: | 5'-UAUAUUGCUGUAACAGUCA-3' | (SEQ ID NO: 20146) |
| C5-1027 | 19 nt | Target #1: | 5'-AUUGCUGUAACAGUCAUAG-3' | (SEQ ID NO: 15527) |
| C5-1027 | 19 nt | Target #2: | 5'-UAUUGCUGUAACAGUCAUA-3' | (SEQ ID NO: 17837) |
| C5-1027 | 19 nt | Target #3: | 5'-AUAUUGCUGUAACAGUCAU-3' | (SEQ ID NO: 20147) |
| C5-1028 | 19 nt | Target #1: | 5'-UUGCUGUAACAGUCAUAGA-3' | (SEQ ID NO: 15528) |
| C5-1028 | 19 nt | Target #2: | 5'-AUUGCUGUAACAGUCAUAG-3' | (SEQ ID NO: 17838) |
| C5-1028 | 19 nt | Target #3: | 5'-UAUUGCUGUAACAGUCAUA-3' | (SEQ ID NO: 20148) |
| C5-1029 | 19 nt | Target #1: | 5'-UGCUGUAACAGUCAUAGAG-3' | (SEQ ID NO: 15529) |
| C5-1029 | 19 nt | Target #2: | 5'-UUGCUGUAACAGUCAUAGA-3' | (SEQ ID NO: 17839) |
| C5-1029 | 19 nt | Target #3: | 5'-AUUGCUGUAACAGUCAUAG-3' | (SEQ ID NO: 20149) |
| C5-1030 | 19 nt | Target #1: | 5'-GCUGUAACAGUCAUAGAGU-3' | (SEQ ID NO: 15530) |
| C5-1030 | 19 nt | Target #2: | 5'-UGCUGUAACAGUCAUAGAG-3' | (SEQ ID NO: 17840) |
| C5-1030 | 19 nt | Target #3: | 5'-UUGCUGUAACAGUCAUAGA-3' | (SEQ ID NO: 20150) |
| C5-1031 | 19 nt | Target #1: | 5'-CUGUAACAGUCAUAGAGUC-3' | (SEQ ID NO: 15531) |
| C5-1031 | 19 nt | Target #2: | 5'-GCUGUAACAGUCAUAGAGU-3' | (SEQ ID NO: 17841) |
| C5-1031 | 19 nt | Target #3: | 5'-UGCUGUAACAGUCAUAGAG-3' | (SEQ ID NO: 20151) |
| C5-1032 | 19 nt | Target #1: | 5'-UGUAACAGUCAUAGAGUCU-3' | (SEQ ID NO: 15532) |
| C5-1032 | 19 nt | Target #2: | 5'-CUGUAACAGUCAUAGAGUC-3' | (SEQ ID NO: 17842) |
| C5-1032 | 19 nt | Target #3: | 5'-GCUGUAACAGUCAUAGAGU-3' | (SEQ ID NO: 20152) |
| C5-1033 | 19 nt | Target #1: | 5'-GUAACAGUCAUAGAGUCUA-3' | (SEQ ID NO: 15533) |
| C5-1033 | 19 nt | Target #2: | 5'-UGUAACAGUCAUAGAGUCU-3' | (SEQ ID NO: 17843) |
| C5-1033 | 19 nt | Target #3: | 5'-CUGUAACAGUCAUAGAGUC-3' | (SEQ ID NO: 20153) |
| C5-1034 | 19 nt | Target #1: | 5'-UAACAGUCAUAGAGUCUAC-3' | (SEQ ID NO: 15534) |
| C5-1034 | 19 nt | Target #2: | 5'-GUAACAGUCAUAGAGUCUA-3' | (SEQ ID NO: 17844) |
| C5-1034 | 19 nt | Target #3: | 5'-UGUAACAGUCAUAGAGUCU-3' | (SEQ ID NO: 20154) |
| C5-1035 | 19 nt | Target #1: | 5'-AACAGUCAUAGAGUCUACA-3' | (SEQ ID NO: 15535) |
| C5-1035 | 19 nt | Target #2: | 5'-UAACAGUCAUAGAGUCUAC-3' | (SEQ ID NO: 17845) |
| C5-1035 | 19 nt | Target #3: | 5'-GUAACAGUCAUAGAGUCUA-3' | (SEQ ID NO: 20155) |
| C5-1036 | 19 nt | Target #1: | 5'-ACAGUCAUAGAGUCUACAG-3' | (SEQ ID NO: 15536) |
| C5-1036 | 19 nt | Target #2: | 5'-AACAGUCAUAGAGUCUACA-3' | (SEQ ID NO: 17846) |
| C5-1036 | 19 nt | Target #3: | 5'-UAACAGUCAUAGAGUCUAC-3' | (SEQ ID NO: 20156) |
| C5-1037 | 19 nt | Target #1: | 5'-CAGUCAUAGAGUCUACAGG-3' | (SEQ ID NO: 15537) |
| C5-1037 | 19 nt | Target #2: | 5'-ACAGUCAUAGAGUCUACAG-3' | (SEQ ID NO: 17847) |
| C5-1037 | 19 nt | Target #3: | 5'-AACAGUCAUAGAGUCUACA-3' | (SEQ ID NO: 20157) |
| C5-1038 | 19 nt | Target #1: | 5'-AGUCAUAGAGUCUACAGGU-3' | (SEQ ID NO: 15538) |
| C5-1038 | 19 nt | Target #2: | 5'-CAGUCAUAGAGUCUACAGG-3' | (SEQ ID NO: 17848) |
| C5-1038 | 19 nt | Target #3: | 5'-ACAGUCAUAGAGUCUACAG-3' | (SEQ ID NO: 20158) |
| C5-1039 | 19 nt | Target #1: | 5'-GUCAUAGAGUCUACAGGUG-3' | (SEQ ID NO: 15539) |
| C5-1039 | 19 nt | Target #2: | 5'-AGUCAUAGAGUCUACAGGU-3' | (SEQ ID NO: 17849) |
| C5-1039 | 19 nt | Target #3: | 5'-CAGUCAUAGAGUCUACAGG-3' | (SEQ ID NO: 20159) |
| C5-1040 | 19 nt | Target #1: | 5'-UCAUAGAGUCUACAGGUGG-3' | (SEQ ID NO: 15540) |
| C5-1040 | 19 nt | Target #2: | 5'-GUCAUAGAGUCUACAGGUG-3' | (SEQ ID NO: 17850) |
| C5-1040 | 19 nt | Target #3: | 5'-AGUCAUAGAGUCUACAGGU-3' | (SEQ ID NO: 20160) |
| C5-1041 | 19 nt | Target #1: | 5'-CAUAGAGUCUACAGGUGGA-3' | (SEQ ID NO: 15541) |
| C5-1041 | 19 nt | Target #2: | 5'-UCAUAGAGUCUACAGGUGG-3' | (SEQ ID NO: 17851) |
| C5-1041 | 19 nt | Target #3: | 5'-GUCAUAGAGUCUACAGGUG-3' | (SEQ ID NO: 20161) |
| C5-1042 | 19 nt | Target #1: | 5'-AUAGAGUCUACAGGUGGAU-3' | (SEQ ID NO: 15542) |
| C5-1042 | 19 nt | Target #2: | 5'-CAUAGAGUCUACAGGUGGA-3' | (SEQ ID NO: 17852) |
| C5-1042 | 19 nt | Target #3: | 5'-UCAUAGAGUCUACAGGUGG-3' | (SEQ ID NO: 20162) |
| C5-1043 | 19 nt | Target #1: | 5'-UAGAGUCUACAGGUGGAUU-3' | (SEQ ID NO: 15543) |
| C5-1043 | 19 nt | Target #2: | 5'-AUAGAGUCUACAGGUGGAU-3' | (SEQ ID NO: 17853) |
| C5-1043 | 19 nt | Target #3: | 5'-CAUAGAGUCUACAGGUGGA-3' | (SEQ ID NO: 20163) |
| C5-1044 | 19 nt | Target #1: | 5'-AGAGUCUACAGGUGGAUUU-3' | (SEQ ID NO: 15544) |
| C5-1044 | 19 nt | Target #2: | 5'-UAGAGUCUACAGGUGGAUU-3' | (SEQ ID NO: 17854) |
| C5-1044 | 19 nt | Target #3: | 5'-AUAGAGUCUACAGGUGGAU-3' | (SEQ ID NO: 20164) |

TABLE 10-continued

DsiRNA Component 19 Nucleotide Target Sequences of Human Anti-C5
DsiRNAs Predicted to have >50% Knockdown Efficacy

| ID | Length | Target | Sequence | SEQ ID NO |
|---|---|---|---|---|
| C5-1045 | 19 nt | Target #1: | 5'-GAGUCUACAGGUGGAUUUU-3' | (SEQ ID NO: 15545) |
| C5-1045 | 19 nt | Target #2: | 5'-AGAGUCUACAGGUGGAUUU-3' | (SEQ ID NO: 17855) |
| C5-1045 | 19 nt | Target #3: | 5'-UAGAGUCUACAGGUGGAUU-3' | (SEQ ID NO: 20165) |
| C5-1046 | 19 nt | Target #1: | 5'-AGUCUACAGGUGGAUUUUC-3' | (SEQ ID NO: 15546) |
| C5-1046 | 19 nt | Target #2: | 5'-GAGUCUACAGGUGGAUUUU-3' | (SEQ ID NO: 17856) |
| C5-1046 | 19 nt | Target #3: | 5'-AGAGUCUACAGGUGGAUUU-3' | (SEQ ID NO: 20166) |
| C5-1047 | 19 nt | Target #1: | 5'-GUCUACAGGUGGAUUUUCU-3' | (SEQ ID NO: 15547) |
| C5-1047 | 19 nt | Target #2: | 5'-AGUCUACAGGUGGAUUUUC-3' | (SEQ ID NO: 17857) |
| C5-1047 | 19 nt | Target #3: | 5'-GAGUCUACAGGUGGAUUUU-3' | (SEQ ID NO: 20167) |
| C5-1048 | 19 nt | Target #1: | 5'-UCUACAGGUGGAUUUUCUG-3' | (SEQ ID NO: 15548) |
| C5-1048 | 19 nt | Target #2: | 5'-GUCUACAGGUGGAUUUUCU-3' | (SEQ ID NO: 17858) |
| C5-1048 | 19 nt | Target #3: | 5'-AGUCUACAGGUGGAUUUUC-3' | (SEQ ID NO: 20168) |
| C5-1049 | 19 nt | Target #1: | 5'-CUACAGGUGGAUUUUCUGA-3' | (SEQ ID NO: 15549) |
| C5-1049 | 19 nt | Target #2: | 5'-UCUACAGGUGGAUUUUCUG-3' | (SEQ ID NO: 17859) |
| C5-1049 | 19 nt | Target #3: | 5'-GUCUACAGGUGGAUUUUCU-3' | (SEQ ID NO: 20169) |
| C5-1050 | 19 nt | Target #1: | 5'-UACAGGUGGAUUUUCUGAA-3' | (SEQ ID NO: 15550) |
| C5-1050 | 19 nt | Target #2: | 5'-CUACAGGUGGAUUUUCUGA-3' | (SEQ ID NO: 17860) |
| C5-1050 | 19 nt | Target #3: | 5'-UCUACAGGUGGAUUUUCUG-3' | (SEQ ID NO: 20170) |
| C5-1051 | 19 nt | Target #1: | 5'-ACAGGUGGAUUUUCUGAAG-3' | (SEQ ID NO: 15551) |
| C5-1051 | 19 nt | Target #2: | 5'-UACAGGUGGAUUUUCUGAA-3' | (SEQ ID NO: 17861) |
| C5-1051 | 19 nt | Target #3: | 5'-CUACAGGUGGAUUUUCUGA-3' | (SEQ ID NO: 20171) |
| C5-1052 | 19 nt | Target #1: | 5'-CAGGUGGAUUUUCUGAAGA-3' | (SEQ ID NO: 15552) |
| C5-1052 | 19 nt | Target #2: | 5'-ACAGGUGGAUUUUCUGAAG-3' | (SEQ ID NO: 17862) |
| C5-1052 | 19 nt | Target #3: | 5'-UACAGGUGGAUUUUCUGAA-3' | (SEQ ID NO: 20172) |
| C5-1053 | 19 nt | Target #1: | 5'-AGGUGGAUUUUCUGAAGAG-3' | (SEQ ID NO: 15553) |
| C5-1053 | 19 nt | Target #2: | 5'-CAGGUGGAUUUUCUGAAGA-3' | (SEQ ID NO: 17863) |
| C5-1053 | 19 nt | Target #3: | 5'-ACAGGUGGAUUUUCUGAAG-3' | (SEQ ID NO: 20173) |
| C5-1054 | 19 nt | Target #1: | 5'-GGUGGAUUUUCUGAAGAGG-3' | (SEQ ID NO: 15554) |
| C5-1054 | 19 nt | Target #2: | 5'-AGGUGGAUUUUCUGAAGAG-3' | (SEQ ID NO: 17864) |
| C5-1054 | 19 nt | Target #3: | 5'-CAGGUGGAUUUUCUGAAGA-3' | (SEQ ID NO: 20174) |
| C5-1055 | 19 nt | Target #1: | 5'-GUGGAUUUUCUGAAGAGGC-3' | (SEQ ID NO: 15555) |
| C5-1055 | 19 nt | Target #2: | 5'-GGUGGAUUUUCUGAAGAGG-3' | (SEQ ID NO: 17865) |
| C5-1055 | 19 nt | Target #3: | 5'-AGGUGGAUUUUCUGAAGAG-3' | (SEQ ID NO: 20175) |
| C5-1056 | 19 nt | Target #1: | 5'-UGGAUUUUCUGAAGAGGCA-3' | (SEQ ID NO: 15556) |
| C5-1056 | 19 nt | Target #2: | 5'-GUGGAUUUUCUGAAGAGGC-3' | (SEQ ID NO: 17866) |
| C5-1056 | 19 nt | Target #3: | 5'-GGUGGAUUUUCUGAAGAGG-3' | (SEQ ID NO: 20176) |
| C5-1057 | 19 nt | Target #1: | 5'-GGAUUUUCUGAAGAGGCAG-3' | (SEQ ID NO: 15557) |
| C5-1057 | 19 nt | Target #2: | 5'-UGGAUUUUCUGAAGAGGCA-3' | (SEQ ID NO: 17867) |
| C5-1057 | 19 nt | Target #3: | 5'-GUGGAUUUUCUGAAGAGGC-3' | (SEQ ID NO: 20177) |
| C5-1058 | 19 nt | Target #1: | 5'-GAUUUUCUGAAGAGGCAGA-3' | (SEQ ID NO: 15558) |
| C5-1058 | 19 nt | Target #2: | 5'-GGAUUUUCUGAAGAGGCAG-3' | (SEQ ID NO: 17868) |
| C5-1058 | 19 nt | Target #3: | 5'-UGGAUUUUCUGAAGAGGCA-3' | (SEQ ID NO: 20178) |
| C5-1059 | 19 nt | Target #1: | 5'-AUUUUCUGAAGAGGCAGAA-3' | (SEQ ID NO: 15559) |
| C5-1059 | 19 nt | Target #2: | 5'-GAUUUUCUGAAGAGGCAGA-3' | (SEQ ID NO: 17869) |
| C5-1059 | 19 nt | Target #3: | 5'-GGAUUUUCUGAAGAGGCAG-3' | (SEQ ID NO: 20179) |
| C5-1060 | 19 nt | Target #1: | 5'-UUUUCUGAAGAGGCAGAAA-3' | (SEQ ID NO: 15560) |
| C5-1060 | 19 nt | Target #2: | 5'-AUUUUCUGAAGAGGCAGAA-3' | (SEQ ID NO: 17870) |
| C5-1060 | 19 nt | Target #3: | 5'-GAUUUUCUGAAGAGGCAGA-3' | (SEQ ID NO: 20180) |
| C5-1061 | 19 nt | Target #1: | 5'-UUUCUGAAGAGGCAGAAAU-3' | (SEQ ID NO: 15561) |
| C5-1061 | 19 nt | Target #2: | 5'-UUUUCUGAAGAGGCAGAAA-3' | (SEQ ID NO: 17871) |
| C5-1061 | 19 nt | Target #3: | 5'-AUUUUCUGAAGAGGCAGAA-3' | (SEQ ID NO: 20181) |
| C5-1062 | 19 nt | Target #1: | 5'-UUCUGAAGAGGCAGAAAUA-3' | (SEQ ID NO: 15562) |
| C5-1062 | 19 nt | Target #2: | 5'-UUUCUGAAGAGGCAGAAAU-3' | (SEQ ID NO: 17872) |
| C5-1062 | 19 nt | Target #3: | 5'-UUUUCUGAAGAGGCAGAAA-3' | (SEQ ID NO: 20182) |
| C5-1063 | 19 nt | Target #1: | 5'-UCUGAAGAGGCAGAAAUAC-3' | (SEQ ID NO: 15563) |
| C5-1063 | 19 nt | Target #2: | 5'-UUCUGAAGAGGCAGAAAUA-3' | (SEQ ID NO: 17873) |
| C5-1063 | 19 nt | Target #3: | 5'-UUUCUGAAGAGGCAGAAAU-3' | (SEQ ID NO: 20183) |
| C5-1064 | 19 nt | Target #1: | 5'-CUGAAGAGGCAGAAAUACC-3' | (SEQ ID NO: 15564) |
| C5-1064 | 19 nt | Target #2: | 5'-UCUGAAGAGGCAGAAAUAC-3' | (SEQ ID NO: 17874) |
| C5-1064 | 19 nt | Target #3: | 5'-UUCUGAAGAGGCAGAAAUA-3' | (SEQ ID NO: 20184) |
| C5-1065 | 19 nt | Target #1: | 5'-UGAAGAGGCAGAAAUACCU-3' | (SEQ ID NO: 15565) |
| C5-1065 | 19 nt | Target #2: | 5'-CUGAAGAGGCAGAAAUACC-3' | (SEQ ID NO: 17875) |
| C5-1065 | 19 nt | Target #3: | 5'-UCUGAAGAGGCAGAAAUAC-3' | (SEQ ID NO: 20185) |
| C5-1066 | 19 nt | Target #1: | 5'-GAAGAGGCAGAAAUACCUG-3' | (SEQ ID NO: 15566) |
| C5-1066 | 19 nt | Target #2: | 5'-UGAAGAGGCAGAAAUACCU-3' | (SEQ ID NO: 17876) |
| C5-1066 | 19 nt | Target #3: | 5'-CUGAAGAGGCAGAAAUACC-3' | (SEQ ID NO: 20186) |
| C5-1067 | 19 nt | Target #1: | 5'-AAGAGGCAGAAAUACCUGG-3' | (SEQ ID NO: 15567) |
| C5-1067 | 19 nt | Target #2: | 5'-GAAGAGGCAGAAAUACCUG-3' | (SEQ ID NO: 17877) |
| C5-1067 | 19 nt | Target #3: | 5'-UGAAGAGGCAGAAAUACCU-3' | (SEQ ID NO: 20187) |
| C5-1068 | 19 nt | Target #1: | 5'-AGAGGCAGAAAUACCUGGC-3' | (SEQ ID NO: 15568) |
| C5-1068 | 19 nt | Target #2: | 5'-AAGAGGCAGAAAUACCUGG-3' | (SEQ ID NO: 17878) |
| C5-1068 | 19 nt | Target #3: | 5'-GAAGAGGCAGAAAUACCUG-3' | (SEQ ID NO: 20188) |
| C5-1069 | 19 nt | Target #1: | 5'-GAGGCAGAAAUACCUGGCA-3' | (SEQ ID NO: 15569) |
| C5-1069 | 19 nt | Target #2: | 5'-AGAGGCAGAAAUACCUGGC-3' | (SEQ ID NO: 17879) |
| C5-1069 | 19 nt | Target #3: | 5'-AAGAGGCAGAAAUACCUGG-3' | (SEQ ID NO: 20189) |
| C5-1070 | 19 nt | Target #1: | 5'-AGGCAGAAAUACCUGGCAU-3' | (SEQ ID NO: 15570) |
| C5-1070 | 19 nt | Target #2: | 5'-GAGGCAGAAAUACCUGGCA-3' | (SEQ ID NO: 17880) |

TABLE 10-continued

| DsiRNA Component 19 Nucleotide Target Sequences of Human Anti-C5 DsiRNAs Predicted to have >50% Knockdown Efficacy |
|---|
| C5-1070 19 nt Target #3: 5'-AGAGGCAGAAAUACCUGGC-3' (SEQ ID NO: 20190) |
| C5-1071 19 nt Target #1: 5'-GGCAGAAAUACCUGGCAUC-3' (SEQ ID NO: 15571) |
| C5-1071 19 nt Target #2: 5'-AGGCAGAAAUACCUGGCAU-3' (SEQ ID NO: 17881) |
| C5-1071 19 nt Target #3: 5'-GAGGCAGAAAUACCUGGCA-3' (SEQ ID NO: 20191) |
| C5-1072 19 nt Target #1: 5'-GCAGAAAUACCUGGCAUCA-3' (SEQ ID NO: 15572) |
| C5-1072 19 nt Target #2: 5'-GGCAGAAAUACCUGGCAUC-3' (SEQ ID NO: 17882) |
| C5-1072 19 nt Target #3: 5'-AGGCAGAAAUACCUGGCAU-3' (SEQ ID NO: 20192) |
| C5-1073 19 nt Target #1: 5'-CAGAAAUACCUGGCAUCAA-3' (SEQ ID NO: 15573) |
| C5-1073 19 nt Target #2: 5'-GCAGAAAUACCUGGCAUCA-3' (SEQ ID NO: 17883) |
| C5-1073 19 nt Target #3: 5'-GGCAGAAAUACCUGGCAUC-3' (SEQ ID NO: 20193) |
| C5-1074 19 nt Target #1: 5'-AGAAAUACCUGGCAUCAAA-3' (SEQ ID NO: 15574) |
| C5-1074 19 nt Target #2: 5'-CAGAAAUACCUGGCAUCAA-3' (SEQ ID NO: 17884) |
| C5-1074 19 nt Target #3: 5'-GCAGAAAUACCUGGCAUCA-3' (SEQ ID NO: 20194) |
| C5-1075 19 nt Target #1: 5'-GAAAUACCUGGCAUCAAAU-3' (SEQ ID NO: 15575) |
| C5-1075 19 nt Target #2: 5'-AGAAAUACCUGGCAUCAAA-3' (SEQ ID NO: 17885) |
| C5-1075 19 nt Target #3: 5'-CAGAAAUACCUGGCAUCAA-3' (SEQ ID NO: 20195) |
| C5-1076 19 nt Target #1: 5'-AAAUACCUGGCAUCAAAUA-3' (SEQ ID NO: 15576) |
| C5-1076 19 nt Target #2: 5'-GAAAUACCUGGCAUCAAAU-3' (SEQ ID NO: 17886) |
| C5-1076 19 nt Target #3: 5'-AGAAAUACCUGGCAUCAAA-3' (SEQ ID NO: 20196) |
| C5-1077 19 nt Target #1: 5'-AAUACCUGGCAUCAAAUAU-3' (SEQ ID NO: 15577) |
| C5-1077 19 nt Target #2: 5'-AAAUACCUGGCAUCAAAUA-3' (SEQ ID NO: 17887) |
| C5-1077 19 nt Target #3: 5'-GAAAUACCUGGCAUCAAAU-3' (SEQ ID NO: 20197) |
| C5-1078 19 nt Target #1: 5'-AUACCUGGCAUCAAAUAUG-3' (SEQ ID NO: 15578) |
| C5-1078 19 nt Target #2: 5'-AAUACCUGGCAUCAAAUAU-3' (SEQ ID NO: 17888) |
| C5-1078 19 nt Target #3: 5'-AAAUACCUGGCAUCAAAUA-3' (SEQ ID NO: 20198) |
| C5-1079 19 nt Target #1: 5'-UACCUGGCAUCAAAUAUGU-3' (SEQ ID NO: 15579) |
| C5-1079 19 nt Target #2: 5'-AUACCUGGCAUCAAAUAUG-3' (SEQ ID NO: 17889) |
| C5-1079 19 nt Target #3: 5'-AAUACCUGGCAUCAAAUAU-3' (SEQ ID NO: 20199) |
| C5-1080 19 nt Target #1: 5'-ACCUGGCAUCAAAUAUGUC-3' (SEQ ID NO: 15580) |
| C5-1080 19 nt Target #2: 5'-UACCUGGCAUCAAAUAUGU-3' (SEQ ID NO: 17890) |
| C5-1080 19 nt Target #3: 5'-AUACCUGGCAUCAAAUAUG-3' (SEQ ID NO: 20200) |
| C5-1081 19 nt Target #1: 5'-CCUGGCAUCAAAUAUGUCC-3' (SEQ ID NO: 15581) |
| C5-1081 19 nt Target #2: 5'-ACCUGGCAUCAAAUAUGUC-3' (SEQ ID NO: 17891) |
| C5-1081 19 nt Target #3: 5'-UACCUGGCAUCAAAUAUGU-3' (SEQ ID NO: 20201) |
| C5-1082 19 nt Target #1: 5'-CUGGCAUCAAAUAUGUCCU-3' (SEQ ID NO: 15582) |
| C5-1082 19 nt Target #2: 5'-CCUGGCAUCAAAUAUGUCC-3' (SEQ ID NO: 17892) |
| C5-1082 19 nt Target #3: 5'-ACCUGGCAUCAAAUAUGUC-3' (SEQ ID NO: 20202) |
| C5-1083 19 nt Target #1: 5'-UGGCAUCAAAUAUGUCCUC-3' (SEQ ID NO: 15583) |
| C5-1083 19 nt Target #2: 5'-CUGGCAUCAAAUAUGUCCU-3' (SEQ ID NO: 17893) |
| C5-1083 19 nt Target #3: 5'-CCUGGCAUCAAAUAUGUCC-3' (SEQ ID NO: 20203) |
| C5-1084 19 nt Target #1: 5'-GGCAUCAAAUAUGUCCUCU-3' (SEQ ID NO: 15584) |
| C5-1084 19 nt Target #2: 5'-UGGCAUCAAAUAUGUCCUC-3' (SEQ ID NO: 17894) |
| C5-1084 19 nt Target #3: 5'-CUGGCAUCAAAUAUGUCCU-3' (SEQ ID NO: 20204) |
| C5-1085 19 nt Target #1: 5'-GCAUCAAAUAUGUCCUCUC-3' (SEQ ID NO: 15585) |
| C5-1085 19 nt Target #2: 5'-GGCAUCAAAUAUGUCCUCU-3' (SEQ ID NO: 17895) |
| C5-1085 19 nt Target #3: 5'-UGGCAUCAAAUAUGUCCUC-3' (SEQ ID NO: 20205) |
| C5-1086 19 nt Target #1: 5'-CAUCAAAUAUGUCCUCUCU-3' (SEQ ID NO: 15586) |
| C5-1086 19 nt Target #2: 5'-GCAUCAAAUAUGUCCUCUC-3' (SEQ ID NO: 17896) |
| C5-1086 19 nt Target #3: 5'-GGCAUCAAAUAUGUCCUCU-3' (SEQ ID NO: 20206) |
| C5-1087 19 nt Target #1: 5'-AUCAAAUAUGUCCUCUCUC-3' (SEQ ID NO: 15587) |
| C5-1087 19 nt Target #2: 5'-CAUCAAAUAUGUCCUCUCU-3' (SEQ ID NO: 17897) |
| C5-1087 19 nt Target #3: 5'-GCAUCAAAUAUGUCCUCUC-3' (SEQ ID NO: 20207) |
| C5-1089 19 nt Target #1: 5'-CAAAUAUGUCCUCUCUCCC-3' (SEQ ID NO: 15588) |
| C5-1089 19 nt Target #2: 5'-UCAAAUAUGUCCUCUCUCC-3' (SEQ ID NO: 17898) |
| C5-1089 19 nt Target #3: 5'-AUCAAAUAUGUCCUCUCUC-3' (SEQ ID NO: 20208) |
| C5-1090 19 nt Target #1: 5'-AAAUAUGUCCUCUCUCCCU-3' (SEQ ID NO: 15589) |
| C5-1090 19 nt Target #2: 5'-CAAAUAUGUCCUCUCUCCC-3' (SEQ ID NO: 17899) |
| C5-1090 19 nt Target #3: 5'-UCAAAUAUGUCCUCUCUCC-3' (SEQ ID NO: 20209) |
| C5-1091 19 nt Target #1: 5'-AAUAUGUCCUCUCUCCCUA-3' (SEQ ID NO: 15590) |
| C5-1091 19 nt Target #2: 5'-AAAUAUGUCCUCUCUCCCU-3' (SEQ ID NO: 17900) |
| C5-1091 19 nt Target #3: 5'-CAAAUAUGUCCUCUCUCCC-3' (SEQ ID NO: 20210) |
| C5-1092 19 nt Target #1: 5'-AUAUGUCCUCUCUCCCUAC-3' (SEQ ID NO: 15591) |
| C5-1092 19 nt Target #2: 5'-AAUAUGUCCUCUCUCCCUA-3' (SEQ ID NO: 17901) |
| C5-1092 19 nt Target #3: 5'-AAAUAUGUCCUCUCUCCCU-3' (SEQ ID NO: 20211) |
| C5-1093 19 nt Target #1: 5'-UAUGUCCUCUCUCCCUACA-3' (SEQ ID NO: 15592) |
| C5-1093 19 nt Target #2: 5'-AUAUGUCCUCUCUCCCUAC-3' (SEQ ID NO: 17902) |
| C5-1093 19 nt Target #3: 5'-AAUAUGUCCUCUCUCCCUA-3' (SEQ ID NO: 20212) |
| C5-1094 19 nt Target #1: 5'-AUGUCCUCUCUCCCUACAA-3' (SEQ ID NO: 15593) |
| C5-1094 19 nt Target #2: 5'-UAUGUCCUCUCUCCCUACA-3' (SEQ ID NO: 17903) |
| C5-1094 19 nt Target #3: 5'-AUAUGUCCUCUCUCCCUAC-3' (SEQ ID NO: 20213) |
| C5-1095 19 nt Target #1: 5'-UGUCCUCUCUCCCUACAAA-3' (SEQ ID NO: 15594) |
| C5-1095 19 nt Target #2: 5'-AUGUCCUCUCUCCCUACAA-3' (SEQ ID NO: 17904) |
| C5-1095 19 nt Target #3: 5'-UAUGUCCUCUCUCCCUACA-3' (SEQ ID NO: 20214) |
| C5-1096 19 nt Target #1: 5'-GUCCUCUCUCCCUACAAAC-3' (SEQ ID NO: 15595) |
| C5-1096 19 nt Target #2: 5'-UGUCCUCUCUCCCUACAAA-3' (SEQ ID NO: 17905) |
| C5-1096 19 nt Target #3: 5'-AUGUCCUCUCUCCCUACAA-3' (SEQ ID NO: 20215) |
| C5-1097 19 nt Target #1: 5'-UCCUCUCUCCCUACAAACU-3' (SEQ ID NO: 15596) |

TABLE 10-continued

DsiRNA Component 19 Nucleotide Target Sequences of Human Anti-C5
DsiRNAs Predicted to have >50% Knockdown Efficacy

| ID | Length | Target | Sequence | SEQ ID NO |
|---|---|---|---|---|
| C5-1097 | 19 nt | Target #2: | 5'-GUCCUCUCUCCCUACAAAC-3' | (SEQ ID NO: 17906) |
| C5-1097 | 19 nt | Target #3: | 5'-UGUCCUCUCUCCCUACAAA-3' | (SEQ ID NO: 20216) |
| C5-1098 | 19 nt | Target #1: | 5'-CCUCUCUCCCUACAAACUG-3' | (SEQ ID NO: 15597) |
| C5-1098 | 19 nt | Target #2: | 5'-UCCUCUCUCCCUACAAACU-3' | (SEQ ID NO: 17907) |
| C5-1098 | 19 nt | Target #3: | 5'-GUCCUCUCUCCCUACAAAC-3' | (SEQ ID NO: 20217) |
| C5-1099 | 19 nt | Target #1: | 5'-CUCUCUCCCUACAAACUGA-3' | (SEQ ID NO: 15598) |
| C5-1099 | 19 nt | Target #2: | 5'-CCUCUCUCCCUACAAACUG-3' | (SEQ ID NO: 17908) |
| C5-1099 | 19 nt | Target #3: | 5'-UCCUCUCUCCCUACAAACU-3' | (SEQ ID NO: 20218) |
| C5-1100 | 19 nt | Target #1: | 5'-UCUCUCCCUACAAACUGAA-3' | (SEQ ID NO: 15599) |
| C5-1100 | 19 nt | Target #2: | 5'-CUCUCUCCCUACAAACUGA-3' | (SEQ ID NO: 17909) |
| C5-1100 | 19 nt | Target #3: | 5'-CCUCUCUCCCUACAAACUG-3' | (SEQ ID NO: 20219) |
| C5-1101 | 19 nt | Target #1: | 5'-CUCUCCCUACAAACUGAAU-3' | (SEQ ID NO: 15600) |
| C5-1101 | 19 nt | Target #2: | 5'-UCUCUCCCUACAAACUGAA-3' | (SEQ ID NO: 17910) |
| C5-1101 | 19 nt | Target #3: | 5'-CUCUCUCCCUACAAACUGA-3' | (SEQ ID NO: 20220) |
| C5-1102 | 19 nt | Target #1: | 5'-UCUCCCUACAAACUGAAUU-3' | (SEQ ID NO: 15601) |
| C5-1102 | 19 nt | Target #2: | 5'-CUCUCCCUACAAACUGAAU-3' | (SEQ ID NO: 17911) |
| C5-1102 | 19 nt | Target #3: | 5'-UCUCUCCCUACAAACUGAA-3' | (SEQ ID NO: 20221) |
| C5-1103 | 19 nt | Target #1: | 5'-CUCCCUACAAACUGAAUUU-3' | (SEQ ID NO: 15602) |
| C5-1103 | 19 nt | Target #2: | 5'-UCUCCCUACAAACUGAAUU-3' | (SEQ ID NO: 17912) |
| C5-1103 | 19 nt | Target #3: | 5'-CUCUCCCUACAAACUGAAU-3' | (SEQ ID NO: 20222) |
| C5-1104 | 19 nt | Target #1: | 5'-UCCCUACAAACUGAAUUUG-3' | (SEQ ID NO: 15603) |
| C5-1104 | 19 nt | Target #2: | 5'-CUCCCUACAAACUGAAUUU-3' | (SEQ ID NO: 17913) |
| C5-1104 | 19 nt | Target #3: | 5'-UCUCCCUACAAACUGAAUU-3' | (SEQ ID NO: 20223) |
| C5-1106 | 19 nt | Target #1: | 5'-CCUACAAACUGAAUUUGGU-3' | (SEQ ID NO: 15604) |
| C5-1106 | 19 nt | Target #2: | 5'-CCCUACAAACUGAAUUUGG-3' | (SEQ ID NO: 17914) |
| C5-1106 | 19 nt | Target #3: | 5'-UCCCUACAAACUGAAUUUG-3' | (SEQ ID NO: 20224) |
| C5-1107 | 19 nt | Target #1: | 5'-CUACAAACUGAAUUUGGUU-3' | (SEQ ID NO: 15605) |
| C5-1107 | 19 nt | Target #2: | 5'-CCUACAAACUGAAUUUGGU-3' | (SEQ ID NO: 17915) |
| C5-1107 | 19 nt | Target #3: | 5'-CCCUACAAACUGAAUUUGG-3' | (SEQ ID NO: 20225) |
| C5-1108 | 19 nt | Target #1: | 5'-UACAAACUGAAUUUGGUUG-3' | (SEQ ID NO: 15606) |
| C5-1108 | 19 nt | Target #2: | 5'-CUACAAACUGAAUUUGGUU-3' | (SEQ ID NO: 17916) |
| C5-1108 | 19 nt | Target #3: | 5'-CCUACAAACUGAAUUUGGU-3' | (SEQ ID NO: 20226) |
| C5-1111 | 19 nt | Target #1: | 5'-AAACUGAAUUUGGUUGCUA-3' | (SEQ ID NO: 15607) |
| C5-1111 | 19 nt | Target #2: | 5'-CAAACUGAAUUUGGUUGCU-3' | (SEQ ID NO: 17917) |
| C5-1111 | 19 nt | Target #3: | 5'-ACAAACUGAAUUUGGUUGC-3' | (SEQ ID NO: 20227) |
| C5-1112 | 19 nt | Target #1: | 5'-AACUGAAUUUGGUUGCUAC-3' | (SEQ ID NO: 15608) |
| C5-1112 | 19 nt | Target #2: | 5'-AAACUGAAUUUGGUUGCUA-3' | (SEQ ID NO: 17918) |
| C5-1112 | 19 nt | Target #3: | 5'-CAAACUGAAUUUGGUUGCU-3' | (SEQ ID NO: 20228) |
| C5-1113 | 19 nt | Target #1: | 5'-ACUGAAUUUGGUUGCUACU-3' | (SEQ ID NO: 15609) |
| C5-1113 | 19 nt | Target #2: | 5'-AACUGAAUUUGGUUGCUAC-3' | (SEQ ID NO: 17919) |
| C5-1113 | 19 nt | Target #3: | 5'-AAACUGAAUUUGGUUGCUA-3' | (SEQ ID NO: 20229) |
| C5-1114 | 19 nt | Target #1: | 5'-CUGAAUUUGGUUGCUACUC-3' | (SEQ ID NO: 15610) |
| C5-1114 | 19 nt | Target #2: | 5'-ACUGAAUUUGGUUGCUACU-3' | (SEQ ID NO: 17920) |
| C5-1114 | 19 nt | Target #3: | 5'-AACUGAAUUUGGUUGCUAC-3' | (SEQ ID NO: 20230) |
| C5-1115 | 19 nt | Target #1: | 5'-UGAAUUUGGUUGCUACUCC-3' | (SEQ ID NO: 15611) |
| C5-1115 | 19 nt | Target #2: | 5'-CUGAAUUUGGUUGCUACUC-3' | (SEQ ID NO: 17921) |
| C5-1115 | 19 nt | Target #3: | 5'-ACUGAAUUUGGUUGCUACU-3' | (SEQ ID NO: 20231) |
| C5-1116 | 19 nt | Target #1: | 5'-GAAUUUGGUUGCUACUCCU-3' | (SEQ ID NO: 15612) |
| C5-1116 | 19 nt | Target #2: | 5'-UGAAUUUGGUUGCUACUCC-3' | (SEQ ID NO: 17922) |
| C5-1116 | 19 nt | Target #3: | 5'-CUGAAUUUGGUUGCUACUC-3' | (SEQ ID NO: 20232) |
| C5-1117 | 19 nt | Target #1: | 5'-AAUUUGGUUGCUACUCCUC-3' | (SEQ ID NO: 15613) |
| C5-1117 | 19 nt | Target #2: | 5'-GAAUUUGGUUGCUACUCCU-3' | (SEQ ID NO: 17923) |
| C5-1117 | 19 nt | Target #3: | 5'-UGAAUUUGGUUGCUACUCC-3' | (SEQ ID NO: 20233) |
| C5-1118 | 19 nt | Target #1: | 5'-AUUUGGUUGCUACUCCUCU-3' | (SEQ ID NO: 15614) |
| C5-1118 | 19 nt | Target #2: | 5'-AAUUUGGUUGCUACUCCUC-3' | (SEQ ID NO: 17924) |
| C5-1118 | 19 nt | Target #3: | 5'-GAAUUUGGUUGCUACUCCU-3' | (SEQ ID NO: 20234) |
| C5-1119 | 19 nt | Target #1: | 5'-UUUGGUUGCUACUCCUCUU-3' | (SEQ ID NO: 15615) |
| C5-1119 | 19 nt | Target #2: | 5'-AUUUGGUUGCUACUCCUCU-3' | (SEQ ID NO: 17925) |
| C5-1119 | 19 nt | Target #3: | 5'-AAUUUGGUUGCUACUCCUC-3' | (SEQ ID NO: 20235) |
| C5-1120 | 19 nt | Target #1: | 5'-UUGGUUGCUACUCCUCUUU-3' | (SEQ ID NO: 15616) |
| C5-1120 | 19 nt | Target #2: | 5'-UUUGGUUGCUACUCCUCUU-3' | (SEQ ID NO: 17926) |
| C5-1120 | 19 nt | Target #3: | 5'-AUUUGGUUGCUACUCCUCU-3' | (SEQ ID NO: 20236) |
| C5-1121 | 19 nt | Target #1: | 5'-UGGUUGCUACUCCUCUUUU-3' | (SEQ ID NO: 15617) |
| C5-1121 | 19 nt | Target #2: | 5'-UUGGUUGCUACUCCUCUUU-3' | (SEQ ID NO: 17927) |
| C5-1121 | 19 nt | Target #3: | 5'-UUUGGUUGCUACUCCUCUU-3' | (SEQ ID NO: 20237) |
| C5-1122 | 19 nt | Target #1: | 5'-GGUUGCUACUCCUCUUUUC-3' | (SEQ ID NO: 15618) |
| C5-1122 | 19 nt | Target #2: | 5'-UGGUUGCUACUCCUCUUUU-3' | (SEQ ID NO: 17928) |
| C5-1122 | 19 nt | Target #3: | 5'-UUGGUUGCUACUCCUCUUU-3' | (SEQ ID NO: 20238) |
| C5-1123 | 19 nt | Target #1: | 5'-GUUGCUACUCCUCUUUUCC-3' | (SEQ ID NO: 15619) |
| C5-1123 | 19 nt | Target #2: | 5'-GGUUGCUACUCCUCUUUUC-3' | (SEQ ID NO: 17929) |
| C5-1123 | 19 nt | Target #3: | 5'-UGGUUGCUACUCCUCUUUU-3' | (SEQ ID NO: 20239) |
| C5-1124 | 19 nt | Target #1: | 5'-UUGCUACUCCUCUUUUCCU-3' | (SEQ ID NO: 15620) |
| C5-1124 | 19 nt | Target #2: | 5'-GUUGCUACUCCUCUUUUCC-3' | (SEQ ID NO: 17930) |
| C5-1124 | 19 nt | Target #3: | 5'-GGUUGCUACUCCUCUUUUC-3' | (SEQ ID NO: 20240) |
| C5-1125 | 19 nt | Target #1: | 5'-UGCUACUCCUCUUUUCCUG-3' | (SEQ ID NO: 15621) |
| C5-1125 | 19 nt | Target #2: | 5'-UUGCUACUCCUCUUUUCCU-3' | (SEQ ID NO: 17931) |
| C5-1125 | 19 nt | Target #3: | 5'-GUUGCUACUCCUCUUUUCC-3' | (SEQ ID NO: 20241) |

TABLE 10-continued

DsiRNA Component 19 Nucleotide Target Sequences of Human Anti-C5 DsiRNAs Predicted to have >50% Knockdown Efficacy

| | | | | |
|---|---|---|---|---|
| C5-1126 | 19 nt | Target #1: | 5'-GCUACUCCUCUUUUCCUGA-3' | (SEQ ID NO: 15622) |
| C5-1126 | 19 nt | Target #2: | 5'-UGCUACUCCUCUUUUCCUG-3' | (SEQ ID NO: 17932) |
| C5-1126 | 19 nt | Target #3: | 5'-UUGCUACUCCUCUUUUCCU-3' | (SEQ ID NO: 20242) |
| C5-1127 | 19 nt | Target #1: | 5'-CUACUCCUCUUUUCCUGAA-3' | (SEQ ID NO: 15623) |
| C5-1127 | 19 nt | Target #2: | 5'-GCUACUCCUCUUUUCCUGA-3' | (SEQ ID NO: 17933) |
| C5-1127 | 19 nt | Target #3: | 5'-UGCUACUCCUCUUUUCCUG-3' | (SEQ ID NO: 20243) |
| C5-1128 | 19 nt | Target #1: | 5'-UACUCCUCUUUUCCUGAAG-3' | (SEQ ID NO: 15624) |
| C5-1128 | 19 nt | Target #2: | 5'-CUACUCCUCUUUUCCUGAA-3' | (SEQ ID NO: 17934) |
| C5-1128 | 19 nt | Target #3: | 5'-GCUACUCCUCUUUUCCUGA-3' | (SEQ ID NO: 20244) |
| C5-1129 | 19 nt | Target #1: | 5'-ACUCCUCUUUUCCUGAAGC-3' | (SEQ ID NO: 15625) |
| C5-1129 | 19 nt | Target #2: | 5'-UACUCCUCUUUUCCUGAAG-3' | (SEQ ID NO: 17935) |
| C5-1129 | 19 nt | Target #3: | 5'-CUACUCCUCUUUUCCUGAA-3' | (SEQ ID NO: 20245) |
| C5-1130 | 19 nt | Target #1: | 5'-CUCCUCUUUUCCUGAAGCC-3' | (SEQ ID NO: 15626) |
| C5-1130 | 19 nt | Target #2: | 5'-ACUCCUCUUUUCCUGAAGC-3' | (SEQ ID NO: 17936) |
| C5-1130 | 19 nt | Target #3: | 5'-UACUCCUCUUUUCCUGAAG-3' | (SEQ ID NO: 20246) |
| C5-1131 | 19 nt | Target #1: | 5'-UCCUCUUUUCCUGAAGCCU-3' | (SEQ ID NO: 15627) |
| C5-1131 | 19 nt | Target #2: | 5'-CUCCUCUUUUCCUGAAGCC-3' | (SEQ ID NO: 17937) |
| C5-1131 | 19 nt | Target #3: | 5'-ACUCCUCUUUUCCUGAAGC-3' | (SEQ ID NO: 20247) |
| C5-1132 | 19 nt | Target #1: | 5'-CCUCUUUUCCUGAAGCCUG-3' | (SEQ ID NO: 15628) |
| C5-1132 | 19 nt | Target #2: | 5'-UCCUCUUUUCCUGAAGCCU-3' | (SEQ ID NO: 17938) |
| C5-1132 | 19 nt | Target #3: | 5'-CUCCUCUUUUCCUGAAGCC-3' | (SEQ ID NO: 20248) |
| C5-1133 | 19 nt | Target #1: | 5'-CUCUUUUCCUGAAGCCUGG-3' | (SEQ ID NO: 15629) |
| C5-1133 | 19 nt | Target #2: | 5'-CCUCUUUUCCUGAAGCCUG-3' | (SEQ ID NO: 17939) |
| C5-1133 | 19 nt | Target #3: | 5'-UCCUCUUUUCCUGAAGCCU-3' | (SEQ ID NO: 20249) |
| C5-1134 | 19 nt | Target #1: | 5'-UCUUUUCCUGAAGCCUGGG-3' | (SEQ ID NO: 15630) |
| C5-1134 | 19 nt | Target #2: | 5'-CUCUUUUCCUGAAGCCUGG-3' | (SEQ ID NO: 17940) |
| C5-1134 | 19 nt | Target #3: | 5'-CCUCUUUUCCUGAAGCCUG-3' | (SEQ ID NO: 20250) |
| C5-1135 | 19 nt | Target #1: | 5'-CUUUUCCUGAAGCCUGGGA-3' | (SEQ ID NO: 15631) |
| C5-1135 | 19 nt | Target #2: | 5'-UCUUUUCCUGAAGCCUGGG-3' | (SEQ ID NO: 17941) |
| C5-1135 | 19 nt | Target #3: | 5'-CUCUUUUCCUGAAGCCUGG-3' | (SEQ ID NO: 20251) |
| C5-1136 | 19 nt | Target #1: | 5'-UUUUCCUGAAGCCUGGGAU-3' | (SEQ ID NO: 15632) |
| C5-1136 | 19 nt | Target #2: | 5'-CUUUUCCUGAAGCCUGGGA-3' | (SEQ ID NO: 17942) |
| C5-1136 | 19 nt | Target #3: | 5'-UCUUUUCCUGAAGCCUGGG-3' | (SEQ ID NO: 20252) |
| C5-1137 | 19 nt | Target #1: | 5'-UUUCCUGAAGCCUGGGAUU-3' | (SEQ ID NO: 15633) |
| C5-1137 | 19 nt | Target #2: | 5'-UUUUCCUGAAGCCUGGGAU-3' | (SEQ ID NO: 17943) |
| C5-1137 | 19 nt | Target #3: | 5'-CUUUUCCUGAAGCCUGGGA-3' | (SEQ ID NO: 20253) |
| C5-1138 | 19 nt | Target #1: | 5'-UUCCUGAAGCCUGGGAUUC-3' | (SEQ ID NO: 15634) |
| C5-1138 | 19 nt | Target #2: | 5'-UUUCCUGAAGCCUGGGAUU-3' | (SEQ ID NO: 17944) |
| C5-1138 | 19 nt | Target #3: | 5'-UUUUCCUGAAGCCUGGGAU-3' | (SEQ ID NO: 20254) |
| C5-1139 | 19 nt | Target #1: | 5'-UCCUGAAGCCUGGGAUUCC-3' | (SEQ ID NO: 15635) |
| C5-1139 | 19 nt | Target #2: | 5'-UUCCUGAAGCCUGGGAUUC-3' | (SEQ ID NO: 17945) |
| C5-1139 | 19 nt | Target #3: | 5'-UUUCCUGAAGCCUGGGAUU-3' | (SEQ ID NO: 20255) |
| C5-1140 | 19 nt | Target #1: | 5'-CCUGAAGCCUGGGAUUCCA-3' | (SEQ ID NO: 15636) |
| C5-1140 | 19 nt | Target #2: | 5'-UCCUGAAGCCUGGGAUUCC-3' | (SEQ ID NO: 17946) |
| C5-1140 | 19 nt | Target #3: | 5'-UUCCUGAAGCCUGGGAUUC-3' | (SEQ ID NO: 20256) |
| C5-1141 | 19 nt | Target #1: | 5'-CUGAAGCCUGGGAUUCCAU-3' | (SEQ ID NO: 15637) |
| C5-1141 | 19 nt | Target #2: | 5'-CCUGAAGCCUGGGAUUCCA-3' | (SEQ ID NO: 17947) |
| C5-1141 | 19 nt | Target #3: | 5'-UCCUGAAGCCUGGGAUUCC-3' | (SEQ ID NO: 20257) |
| C5-1142 | 19 nt | Target #1: | 5'-UGAAGCCUGGGAUUCCAUA-3' | (SEQ ID NO: 15638) |
| C5-1142 | 19 nt | Target #2: | 5'-CUGAAGCCUGGGAUUCCAU-3' | (SEQ ID NO: 17948) |
| C5-1142 | 19 nt | Target #3: | 5'-CCUGAAGCCUGGGAUUCCA-3' | (SEQ ID NO: 20258) |
| C5-1143 | 19 nt | Target #1: | 5'-GAAGCCUGGGAUUCCAUAU-3' | (SEQ ID NO: 15639) |
| C5-1143 | 19 nt | Target #2: | 5'-UGAAGCCUGGGAUUCCAUA-3' | (SEQ ID NO: 17949) |
| C5-1143 | 19 nt | Target #3: | 5'-CUGAAGCCUGGGAUUCCAU-3' | (SEQ ID NO: 20259) |
| C5-1163 | 19 nt | Target #1: | 5'-CCAUCAAGGUGCAGGUUAA-3' | (SEQ ID NO: 15640) |
| C5-1163 | 19 nt | Target #2: | 5'-CCCAUCAAGGUGCAGGUUA-3' | (SEQ ID NO: 17950) |
| C5-1163 | 19 nt | Target #3: | 5'-UCCCAUCAAGGUGCAGGUU-3' | (SEQ ID NO: 20260) |
| C5-1164 | 19 nt | Target #1: | 5'-CAUCAAGGUGCAGGUUAAA-3' | (SEQ ID NO: 15641) |
| C5-1164 | 19 nt | Target #2: | 5'-CCAUCAAGGUGCAGGUUAA-3' | (SEQ ID NO: 17951) |
| C5-1164 | 19 nt | Target #3: | 5'-CCCAUCAAGGUGCAGGUUA-3' | (SEQ ID NO: 20261) |
| C5-1165 | 19 nt | Target #1: | 5'-AUCAAGGUGCAGGUUAAAG-3' | (SEQ ID NO: 15642) |
| C5-1165 | 19 nt | Target #2: | 5'-CAUCAAGGUGCAGGUUAAA-3' | (SEQ ID NO: 17952) |
| C5-1165 | 19 nt | Target #3: | 5'-CCAUCAAGGUGCAGGUUAA-3' | (SEQ ID NO: 20262) |
| C5-1166 | 19 nt | Target #1: | 5'-UCAAGGUGCAGGUUAAAGA-3' | (SEQ ID NO: 15643) |
| C5-1166 | 19 nt | Target #2: | 5'-AUCAAGGUGCAGGUUAAAG-3' | (SEQ ID NO: 17953) |
| C5-1166 | 19 nt | Target #3: | 5'-CAUCAAGGUGCAGGUUAAA-3' | (SEQ ID NO: 20263) |
| C5-1167 | 19 nt | Target #1: | 5'-CAAGGUGCAGGUUAAAGAU-3' | (SEQ ID NO: 15644) |
| C5-1167 | 19 nt | Target #2: | 5'-UCAAGGUGCAGGUUAAAGA-3' | (SEQ ID NO: 17954) |
| C5-1167 | 19 nt | Target #3: | 5'-AUCAAGGUGCAGGUUAAAG-3' | (SEQ ID NO: 20264) |
| C5-1187 | 19 nt | Target #1: | 5'-CGCUUGACCAGUUGGUAGG-3' | (SEQ ID NO: 15645) |
| C5-1187 | 19 nt | Target #2: | 5'-UCGCUUGACCAGUUGGUAG-3' | (SEQ ID NO: 17955) |
| C5-1187 | 19 nt | Target #3: | 5'-UUCGCUUGACCAGUUGGUA-3' | (SEQ ID NO: 20265) |
| C5-1188 | 19 nt | Target #1: | 5'-GCUUGACCAGUUGGUAGGA-3' | (SEQ ID NO: 15646) |
| C5-1188 | 19 nt | Target #2: | 5'-CGCUUGACCAGUUGGUAGG-3' | (SEQ ID NO: 17956) |
| C5-1188 | 19 nt | Target #3: | 5'-UCGCUUGACCAGUUGGUAG-3' | (SEQ ID NO: 20266) |
| C5-1189 | 19 nt | Target #1: | 5'-CUUGACCAGUUGGUAGGAG-3' | (SEQ ID NO: 15647) |
| C5-1189 | 19 nt | Target #2: | 5'-GCUUGACCAGUUGGUAGGA-3' | (SEQ ID NO: 17957) |

TABLE 10-continued

| DsiRNA Component 19 Nucleotide Target Sequences of Human Anti-C5 DsiRNAs Predicted to have >50% Knockdown Efficacy |
|---|
| C5-1189 19 nt Target #3: 5'-CGCUUGACCAGUUGGUAGG-3' (SEQ ID NO: 20267) |
| C5-1190 19 nt Target #1: 5'-UUGACCAGUUGGUAGGAGG-3' (SEQ ID NO: 15648) |
| C5-1190 19 nt Target #2: 5'-CUUGACCAGUUGGUAGGAG-3' (SEQ ID NO: 17958) |
| C5-1190 19 nt Target #3: 5'-GCUUGACCAGUUGGUAGGA-3' (SEQ ID NO: 20268) |
| C5-1210 19 nt Target #1: 5'-GUCCCAGUAACACUGAAUG-3' (SEQ ID NO: 15649) |
| C5-1210 19 nt Target #2: 5'-AGUCCCAGUAACACUGAAU-3' (SEQ ID NO: 17959) |
| C5-1210 19 nt Target #3: 5'-GAGUCCCAGUAACACUGAA-3' (SEQ ID NO: 20269) |
| C5-1211 19 nt Target #1: 5'-UCCCAGUAACACUGAAUGC-3' (SEQ ID NO: 15650) |
| C5-1211 19 nt Target #2: 5'-GUCCCAGUAACACUGAAUG-3' (SEQ ID NO: 17960) |
| C5-1211 19 nt Target #3: 5'-AGUCCCAGUAACACUGAAU-3' (SEQ ID NO: 20270) |
| C5-1212 19 nt Target #1: 5'-CCCAGUAACACUGAAUGCA-3' (SEQ ID NO: 15651) |
| C5-1212 19 nt Target #2: 5'-UCCCAGUAACACUGAAUGC-3' (SEQ ID NO: 17961) |
| C5-1212 19 nt Target #3: 5'-GUCCCAGUAACACUGAAUG-3' (SEQ ID NO: 20271) |
| C5-1213 19 nt Target #1: 5'-CCAGUAACACUGAAUGCAC-3' (SEQ ID NO: 15652) |
| C5-1213 19 nt Target #2: 5'-CCCAGUAACACUGAAUGCA-3' (SEQ ID NO: 17962) |
| C5-1213 19 nt Target #3: 5'-UCCCAGUAACACUGAAUGC-3' (SEQ ID NO: 20272) |
| C5-1214 19 nt Target #1: 5'-CAGUAACACUGAAUGCACA-3' (SEQ ID NO: 15653) |
| C5-1214 19 nt Target #2: 5'-CCAGUAACACUGAAUGCAC-3' (SEQ ID NO: 17963) |
| C5-1214 19 nt Target #3: 5'-CCCAGUAACACUGAAUGCA-3' (SEQ ID NO: 20273) |
| C5-1215 19 nt Target #1: 5'-AGUAACACUGAAUGCACAA-3' (SEQ ID NO: 15654) |
| C5-1215 19 nt Target #2: 5'-CAGUAACACUGAAUGCACA-3' (SEQ ID NO: 17964) |
| C5-1215 19 nt Target #3: 5'-CCAGUAACACUGAAUGCAC-3' (SEQ ID NO: 20274) |
| C5-1216 19 nt Target #1: 5'-GUAACACUGAAUGCACAAA-3' (SEQ ID NO: 15655) |
| C5-1216 19 nt Target #2: 5'-AGUAACACUGAAUGCACAA-3' (SEQ ID NO: 17965) |
| C5-1216 19 nt Target #3: 5'-CAGUAACACUGAAUGCACA-3' (SEQ ID NO: 20275) |
| C5-1217 19 nt Target #1: 5'-UAACACUGAAUGCACAAAC-3' (SEQ ID NO: 15656) |
| C5-1217 19 nt Target #2: 5'-GUAACACUGAAUGCACAAA-3' (SEQ ID NO: 17966) |
| C5-1217 19 nt Target #3: 5'-AGUAACACUGAAUGCACAA-3' (SEQ ID NO: 20276) |
| C5-1218 19 nt Target #1: 5'-AACACUGAAUGCACAAACA-3' (SEQ ID NO: 15657) |
| C5-1218 19 nt Target #2: 5'-UAACACUGAAUGCACAAAC-3' (SEQ ID NO: 17967) |
| C5-1218 19 nt Target #3: 5'-GUAACACUGAAUGCACAAA-3' (SEQ ID NO: 20277) |
| C5-1219 19 nt Target #1: 5'-ACACUGAAUGCACAAACAA-3' (SEQ ID NO: 15658) |
| C5-1219 19 nt Target #2: 5'-AACACUGAAUGCACAAACA-3' (SEQ ID NO: 17968) |
| C5-1219 19 nt Target #3: 5'-UAACACUGAAUGCACAAAC-3' (SEQ ID NO: 20278) |
| C5-1220 19 nt Target #1: 5'-CACUGAAUGCACAAACAAU-3' (SEQ ID NO: 15659) |
| C5-1220 19 nt Target #2: 5'-ACACUGAAUGCACAAACAA-3' (SEQ ID NO: 17969) |
| C5-1220 19 nt Target #3: 5'-AACACUGAAUGCACAAACA-3' (SEQ ID NO: 20279) |
| C5-1221 19 nt Target #1: 5'-ACUGAAUGCACAAACAAUU-3' (SEQ ID NO: 15660) |
| C5-1221 19 nt Target #2: 5'-CACUGAAUGCACAAACAAU-3' (SEQ ID NO: 17970) |
| C5-1221 19 nt Target #3: 5'-ACACUGAAUGCACAAACAA-3' (SEQ ID NO: 20280) |
| C5-1224 19 nt Target #1: 5'-GAAUGCACAAACAAUUGAU-3' (SEQ ID NO: 15661) |
| C5-1224 19 nt Target #2: 5'-UGAAUGCACAAACAAUUGA-3' (SEQ ID NO: 17971) |
| C5-1224 19 nt Target #3: 5'-CUGAAUGCACAAACAAUUG-3' (SEQ ID NO: 20281) |
| C5-1225 19 nt Target #1: 5'-AAUGCACAAACAAUUGAUG-3' (SEQ ID NO: 15662) |
| C5-1225 19 nt Target #2: 5'-GAAUGCACAAACAAUUGAU-3' (SEQ ID NO: 17972) |
| C5-1225 19 nt Target #3: 5'-UGAAUGCACAAACAAUUGA-3' (SEQ ID NO: 20282) |
| C5-1226 19 nt Target #1: 5'-AUGCACAAACAAUUGAUGU-3' (SEQ ID NO: 15663) |
| C5-1226 19 nt Target #2: 5'-AAUGCACAAACAAUUGAUG-3' (SEQ ID NO: 17973) |
| C5-1226 19 nt Target #3: 5'-GAAUGCACAAACAAUUGAU-3' (SEQ ID NO: 20283) |
| C5-1246 19 nt Target #1: 5'-AACCAAGAGACAUCUGACU-3' (SEQ ID NO: 15664) |
| C5-1246 19 nt Target #2: 5'-AAACCAAGAGACAUCUGAC-3' (SEQ ID NO: 17974) |
| C5-1246 19 nt Target #3: 5'-UAAACCAAGAGACAUCUGA-3' (SEQ ID NO: 20284) |
| C5-1247 19 nt Target #1: 5'-ACCAAGAGACAUCUGACUU-3' (SEQ ID NO: 15665) |
| C5-1247 19 nt Target #2: 5'-AACCAAGAGACAUCUGACU-3' (SEQ ID NO: 17975) |
| C5-1247 19 nt Target #3: 5'-AAACCAAGAGACAUCUGAC-3' (SEQ ID NO: 20285) |
| C5-1248 19 nt Target #1: 5'-CCAAGAGACAUCUGACUUG-3' (SEQ ID NO: 15666) |
| C5-1248 19 nt Target #2: 5'-ACCAAGAGACAUCUGACUU-3' (SEQ ID NO: 17976) |
| C5-1248 19 nt Target #3: 5'-AACCAAGAGACAUCUGACU-3' (SEQ ID NO: 20286) |
| C5-1276 19 nt Target #1: 5'-AAAAGUGUAACACGUGUUG-3' (SEQ ID NO: 15667) |
| C5-1276 19 nt Target #2: 5'-CAAAAGUGUAACACGUGUU-3' (SEQ ID NO: 17977) |
| C5-1276 19 nt Target #3: 5'-GCAAAAGUGUAACACGUGU-3' (SEQ ID NO: 20287) |
| C5-1277 19 nt Target #1: 5'-AAAGUGUAACACGUGUUGA-3' (SEQ ID NO: 15668) |
| C5-1277 19 nt Target #2: 5'-AAAAGUGUAACACGUGUUG-3' (SEQ ID NO: 17978) |
| C5-1277 19 nt Target #3: 5'-CAAAAGUGUAACACGUGUU-3' (SEQ ID NO: 20288) |
| C5-1278 19 nt Target #1: 5'-AAGUGUAACACGUGUUGAU-3' (SEQ ID NO: 15669) |
| C5-1278 19 nt Target #2: 5'-AAAGUGUAACACGUGUUGA-3' (SEQ ID NO: 17979) |
| C5-1278 19 nt Target #3: 5'-AAAAGUGUAACACGUGUUG-3' (SEQ ID NO: 20289) |
| C5-1279 19 nt Target #1: 5'-AGUGUAACACGUGUUGAUG-3' (SEQ ID NO: 15670) |
| C5-1279 19 nt Target #2: 5'-AAGUGUAACACGUGUUGAU-3' (SEQ ID NO: 17980) |
| C5-1279 19 nt Target #3: 5'-AAAGUGUAACACGUGUUGA-3' (SEQ ID NO: 20290) |
| C5-1280 19 nt Target #1: 5'-GUGUAACACGUGUUGAUGA-3' (SEQ ID NO: 15671) |
| C5-1280 19 nt Target #2: 5'-AGUGUAACACGUGUUGAUG-3' (SEQ ID NO: 17981) |
| C5-1280 19 nt Target #3: 5'-AAGUGUAACACGUGUUGAU-3' (SEQ ID NO: 20291) |
| C5-1281 19 nt Target #1: 5'-UGUAACACGUGUUGAUGAU-3' (SEQ ID NO: 15672) |
| C5-1281 19 nt Target #2: 5'-GUGUAACACGUGUUGAUGA-3' (SEQ ID NO: 17982) |
| C5-1281 19 nt Target #3: 5'-AGUGUAACACGUGUUGAUG-3' (SEQ ID NO: 20292) |
| C5-1282 19 nt Target #1: 5'-GUAACACGUGUUGAUGAUG-3' (SEQ ID NO: 15673) |

TABLE 10-continued

DsiRNA Component 19 Nucleotide Target Sequences of Human Anti-C5
DsiRNAs Predicted to have >50% Knockdown Efficacy

| | | | | |
|---|---|---|---|---|
| C5-1282 | 19 nt | Target #2: | 5'-UGUAACACGUGUUGAUGAU-3' | (SEQ ID NO: 17983) |
| C5-1282 | 19 nt | Target #3: | 5'-GUGUAACACGUGUUGAUGA-3' | (SEQ ID NO: 20293) |
| C5-1283 | 19 nt | Target #1: | 5'-UAACACGUGUUGAUGAUGG-3' | (SEQ ID NO: 15674) |
| C5-1283 | 19 nt | Target #2: | 5'-GUAACACGUGUUGAUGAUG-3' | (SEQ ID NO: 17984) |
| C5-1283 | 19 nt | Target #3: | 5'-UGUAACACGUGUUGAUGAU-3' | (SEQ ID NO: 20294) |
| C5-1284 | 19 nt | Target #1: | 5'-AACACGUGUUGAUGAUGGA-3' | (SEQ ID NO: 15675) |
| C5-1284 | 19 nt | Target #2: | 5'-UAACACGUGUUGAUGAUGG-3' | (SEQ ID NO: 17985) |
| C5-1284 | 19 nt | Target #3: | 5'-GUAACACGUGUUGAUGAUG-3' | (SEQ ID NO: 20295) |
| C5-1285 | 19 nt | Target #1: | 5'-ACACGUGUUGAUGAUGGAG-3' | (SEQ ID NO: 15676) |
| C5-1285 | 19 nt | Target #2: | 5'-AACACGUGUUGAUGAUGGA-3' | (SEQ ID NO: 17986) |
| C5-1285 | 19 nt | Target #3: | 5'-UAACACGUGUUGAUGAUGG-3' | (SEQ ID NO: 20296) |
| C5-1286 | 19 nt | Target #1: | 5'-CACGUGUUGAUGAUGGAGU-3' | (SEQ ID NO: 15677) |
| C5-1286 | 19 nt | Target #2: | 5'-ACACGUGUUGAUGAUGGAG-3' | (SEQ ID NO: 17987) |
| C5-1286 | 19 nt | Target #3: | 5'-AACACGUGUUGAUGAUGGA-3' | (SEQ ID NO: 20297) |
| C5-1287 | 19 nt | Target #1: | 5'-ACGUGUUGAUGAUGGAGUA-3' | (SEQ ID NO: 15678) |
| C5-1287 | 19 nt | Target #2: | 5'-CACGUGUUGAUGAUGGAGU-3' | (SEQ ID NO: 17988) |
| C5-1287 | 19 nt | Target #3: | 5'-ACACGUGUUGAUGAUGGAG-3' | (SEQ ID NO: 20298) |
| C5-1288 | 19 nt | Target #1: | 5'-CGUGUUGAUGAUGGAGUAG-3' | (SEQ ID NO: 15679) |
| C5-1288 | 19 nt | Target #2: | 5'-ACGUGUUGAUGAUGGAGUA-3' | (SEQ ID NO: 17989) |
| C5-1288 | 19 nt | Target #3: | 5'-CACGUGUUGAUGAUGGAGU-3' | (SEQ ID NO: 20299) |
| C5-1289 | 19 nt | Target #1: | 5'-GUGUUGAUGAUGGAGUAGC-3' | (SEQ ID NO: 15680) |
| C5-1289 | 19 nt | Target #2: | 5'-CGUGUUGAUGAUGGAGUAG-3' | (SEQ ID NO: 17990) |
| C5-1289 | 19 nt | Target #3: | 5'-ACGUGUUGAUGAUGGAGUA-3' | (SEQ ID NO: 20300) |
| C5-1290 | 19 nt | Target #1: | 5'-UGUUGAUGAUGGAGUAGCU-3' | (SEQ ID NO: 15681) |
| C5-1290 | 19 nt | Target #2: | 5'-GUGUUGAUGAUGGAGUAGC-3' | (SEQ ID NO: 17991) |
| C5-1290 | 19 nt | Target #3: | 5'-CGUGUUGAUGAUGGAGUAG-3' | (SEQ ID NO: 20301) |
| C5-1291 | 19 nt | Target #1: | 5'-GUUGAUGAUGGAGUAGCUU-3' | (SEQ ID NO: 15682) |
| C5-1291 | 19 nt | Target #2: | 5'-UGUUGAUGAUGGAGUAGCU-3' | (SEQ ID NO: 17992) |
| C5-1291 | 19 nt | Target #3: | 5'-GUGUUGAUGAUGGAGUAGC-3' | (SEQ ID NO: 20302) |
| C5-1292 | 19 nt | Target #1: | 5'-UUGAUGAUGGAGUAGCUUC-3' | (SEQ ID NO: 15683) |
| C5-1292 | 19 nt | Target #2: | 5'-GUUGAUGAUGGAGUAGCUU-3' | (SEQ ID NO: 17993) |
| C5-1292 | 19 nt | Target #3: | 5'-UGUUGAUGAUGGAGUAGCU-3' | (SEQ ID NO: 20303) |
| C5-1319 | 19 nt | Target #1: | 5'-UUAAUCUCCCAUCUGGAGU-3' | (SEQ ID NO: 15684) |
| C5-1319 | 19 nt | Target #2: | 5'-CUUAAUCUCCCAUCUGGAG-3' | (SEQ ID NO: 17994) |
| C5-1319 | 19 nt | Target #3: | 5'-GCUUAAUCUCCCAUCUGGA-3' | (SEQ ID NO: 20304) |
| C5-1320 | 19 nt | Target #1: | 5'-UAAUCUCCCAUCUGGAGUG-3' | (SEQ ID NO: 15685) |
| C5-1320 | 19 nt | Target #2: | 5'-UUAAUCUCCCAUCUGGAGU-3' | (SEQ ID NO: 17995) |
| C5-1320 | 19 nt | Target #3: | 5'-CUUAAUCUCCCAUCUGGAG-3' | (SEQ ID NO: 20305) |
| C5-1321 | 19 nt | Target #1: | 5'-AAUCUCCCAUCUGGAGUGA-3' | (SEQ ID NO: 15686) |
| C5-1321 | 19 nt | Target #2: | 5'-UAAUCUCCCAUCUGGAGUG-3' | (SEQ ID NO: 17996) |
| C5-1321 | 19 nt | Target #3: | 5'-UUAAUCUCCCAUCUGGAGU-3' | (SEQ ID NO: 20306) |
| C5-1322 | 19 nt | Target #1: | 5'-AUCUCCCAUCUGGAGUGAC-3' | (SEQ ID NO: 15687) |
| C5-1322 | 19 nt | Target #2: | 5'-AAUCUCCCAUCUGGAGUGA-3' | (SEQ ID NO: 17997) |
| C5-1322 | 19 nt | Target #3: | 5'-UAAUCUCCCAUCUGGAGUG-3' | (SEQ ID NO: 20307) |
| C5-1323 | 19 nt | Target #1: | 5'-UCUCCCAUCUGGAGUGACG-3' | (SEQ ID NO: 15688) |
| C5-1323 | 19 nt | Target #2: | 5'-AUCUCCCAUCUGGAGUGAC-3' | (SEQ ID NO: 17998) |
| C5-1323 | 19 nt | Target #3: | 5'-AAUCUCCCAUCUGGAGUGA-3' | (SEQ ID NO: 20308) |
| C5-1325 | 19 nt | Target #1: | 5'-UCCCAUCUGGAGUGACGGU-3' | (SEQ ID NO: 15689) |
| C5-1325 | 19 nt | Target #2: | 5'-CUCCCAUCUGGAGUGACGG-3' | (SEQ ID NO: 17999) |
| C5-1325 | 19 nt | Target #3: | 5'-UCUCCCAUCUGGAGUGACG-3' | (SEQ ID NO: 20309) |
| C5-1327 | 19 nt | Target #1: | 5'-CCAUCUGGAGUGACGGUGC-3' | (SEQ ID NO: 15690) |
| C5-1327 | 19 nt | Target #2: | 5'-CCCAUCUGGAGUGACGGUG-3' | (SEQ ID NO: 18000) |
| C5-1327 | 19 nt | Target #3: | 5'-UCCCAUCUGGAGUGACGGU-3' | (SEQ ID NO: 20310) |
| C5-1328 | 19 nt | Target #1: | 5'-CAUCUGGAGUGACGGUGCU-3' | (SEQ ID NO: 15691) |
| C5-1328 | 19 nt | Target #2: | 5'-CCAUCUGGAGUGACGGUGC-3' | (SEQ ID NO: 18001) |
| C5-1328 | 19 nt | Target #3: | 5'-CCCAUCUGGAGUGACGGUG-3' | (SEQ ID NO: 20311) |
| C5-1329 | 19 nt | Target #1: | 5'-AUCUGGAGUGACGGUGCUG-3' | (SEQ ID NO: 15692) |
| C5-1329 | 19 nt | Target #2: | 5'-CAUCUGGAGUGACGGUGCU-3' | (SEQ ID NO: 18002) |
| C5-1329 | 19 nt | Target #3: | 5'-CCAUCUGGAGUGACGGUGC-3' | (SEQ ID NO: 20312) |
| C5-1330 | 19 nt | Target #1: | 5'-UCUGGAGUGACGGUGCUGG-3' | (SEQ ID NO: 15693) |
| C5-1330 | 19 nt | Target #2: | 5'-AUCUGGAGUGACGGUGCUG-3' | (SEQ ID NO: 18003) |
| C5-1330 | 19 nt | Target #3: | 5'-CAUCUGGAGUGACGGUGCU-3' | (SEQ ID NO: 20313) |
| C5-1331 | 19 nt | Target #1: | 5'-CUGGAGUGACGGUGCUGGA-3' | (SEQ ID NO: 15694) |
| C5-1331 | 19 nt | Target #2: | 5'-UCUGGAGUGACGGUGCUGG-3' | (SEQ ID NO: 18004) |
| C5-1331 | 19 nt | Target #3: | 5'-AUCUGGAGUGACGGUGCUG-3' | (SEQ ID NO: 20314) |
| C5-1332 | 19 nt | Target #1: | 5'-UGGAGUGACGGUGCUGGAG-3' | (SEQ ID NO: 15695) |
| C5-1332 | 19 nt | Target #2: | 5'-CUGGAGUGACGGUGCUGGA-3' | (SEQ ID NO: 18005) |
| C5-1332 | 19 nt | Target #3: | 5'-UCUGGAGUGACGGUGCUGG-3' | (SEQ ID NO: 20315) |
| C5-1333 | 19 nt | Target #1: | 5'-GGAGUGACGGUGCUGGAGU-3' | (SEQ ID NO: 15696) |
| C5-1333 | 19 nt | Target #2: | 5'-UGGAGUGACGGUGCUGGAG-3' | (SEQ ID NO: 18006) |
| C5-1333 | 19 nt | Target #3: | 5'-CUGGAGUGACGGUGCUGGA-3' | (SEQ ID NO: 20316) |
| C5-1334 | 19 nt | Target #1: | 5'-GAGUGACGGUGCUGGAGUU-3' | (SEQ ID NO: 15697) |
| C5-1334 | 19 nt | Target #2: | 5'-GGAGUGACGGUGCUGGAGU-3' | (SEQ ID NO: 18007) |
| C5-1334 | 19 nt | Target #3: | 5'-UGGAGUGACGGUGCUGGAG-3' | (SEQ ID NO: 20317) |
| C5-1335 | 19 nt | Target #1: | 5'-AGUGACGGUGCUGGAGUUU-3' | (SEQ ID NO: 15698) |
| C5-1335 | 19 nt | Target #2: | 5'-GAGUGACGGUGCUGGAGUU-3' | (SEQ ID NO: 18008) |
| C5-1335 | 19 nt | Target #3: | 5'-GGAGUGACGGUGCUGGAGU-3' | (SEQ ID NO: 20318) |

TABLE 10-continued

DsiRNA Component 19 Nucleotide Target Sequences of Human Anti-C5
DsiRNAs Predicted to have >50% Knockdown Efficacy

```
C5-1336  19 nt  Target #1:  5'-GUGACGGUGCUGGAGUUUA-3'  (SEQ ID NO: 15699)
C5-1336  19 nt  Target #2:  5'-AGUGACGGUGCUGGAGUUU-3'  (SEQ ID NO: 18009)
C5-1336  19 nt  Target #3:  5'-GAGUGACGGUGCUGGAGUU-3'  (SEQ ID NO: 20319)
C5-1337  19 nt  Target #1:  5'-UGACGGUGCUGGAGUUUAA-3'  (SEQ ID NO: 15700)
C5-1337  19 nt  Target #2:  5'-GUGACGGUGCUGGAGUUUA-3'  (SEQ ID NO: 18010)
C5-1337  19 nt  Target #3:  5'-AGUGACGGUGCUGGAGUUU-3'  (SEQ ID NO: 20320)
C5-1338  19 nt  Target #1:  5'-GACGGUGCUGGAGUUUAAU-3'  (SEQ ID NO: 15701)
C5-1338  19 nt  Target #2:  5'-UGACGGUGCUGGAGUUUAA-3'  (SEQ ID NO: 18011)
C5-1338  19 nt  Target #3:  5'-GUGACGGUGCUGGAGUUUA-3'  (SEQ ID NO: 20321)
C5-1339  19 nt  Target #1:  5'-ACGGUGCUGGAGUUUAAUG-3'  (SEQ ID NO: 15702)
C5-1339  19 nt  Target #2:  5'-GACGGUGCUGGAGUUUAAU-3'  (SEQ ID NO: 18012)
C5-1339  19 nt  Target #3:  5'-UGACGGUGCUGGAGUUUAA-3'  (SEQ ID NO: 20322)
C5-1340  19 nt  Target #1:  5'-CGGUGCUGGAGUUUAAUGU-3'  (SEQ ID NO: 15703)
C5-1340  19 nt  Target #2:  5'-ACGGUGCUGGAGUUUAAUG-3'  (SEQ ID NO: 18013)
C5-1340  19 nt  Target #3:  5'-GACGGUGCUGGAGUUUAAU-3'  (SEQ ID NO: 20323)
C5-1341  19 nt  Target #1:  5'-GGUGCUGGAGUUUAAUGUC-3'  (SEQ ID NO: 15704)
C5-1341  19 nt  Target #2:  5'-CGGUGCUGGAGUUUAAUGU-3'  (SEQ ID NO: 18014)
C5-1341  19 nt  Target #3:  5'-ACGGUGCUGGAGUUUAAUG-3'  (SEQ ID NO: 20324)
C5-1342  19 nt  Target #1:  5'-GUGCUGGAGUUUAAUGUCA-3'  (SEQ ID NO: 15705)
C5-1342  19 nt  Target #2:  5'-GGUGCUGGAGUUUAAUGUC-3'  (SEQ ID NO: 18015)
C5-1342  19 nt  Target #3:  5'-CGGUGCUGGAGUUUAAUGU-3'  (SEQ ID NO: 20325)
C5-1343  19 nt  Target #1:  5'-UGCUGGAGUUUAAUGUCAA-3'  (SEQ ID NO: 15706)
C5-1343  19 nt  Target #2:  5'-GUGCUGGAGUUUAAUGUCA-3'  (SEQ ID NO: 18016)
C5-1343  19 nt  Target #3:  5'-GGUGCUGGAGUUUAAUGUC-3'  (SEQ ID NO: 20326)
C5-1344  19 nt  Target #1:  5'-GCUGGAGUUUAAUGUCAAA-3'  (SEQ ID NO: 15707)
C5-1344  19 nt  Target #2:  5'-UGCUGGAGUUUAAUGUCAA-3'  (SEQ ID NO: 18017)
C5-1344  19 nt  Target #3:  5'-GUGCUGGAGUUUAAUGUCA-3'  (SEQ ID NO: 20327)
C5-1345  19 nt  Target #1:  5'-CUGGAGUUUAAUGUCAAAA-3'  (SEQ ID NO: 15708)
C5-1345  19 nt  Target #2:  5'-GCUGGAGUUUAAUGUCAAA-3'  (SEQ ID NO: 18018)
C5-1345  19 nt  Target #3:  5'-UGCUGGAGUUUAAUGUCAA-3'  (SEQ ID NO: 20328)
C5-1346  19 nt  Target #1:  5'-UGGAGUUUAAUGUCAAAAC-3'  (SEQ ID NO: 15709)
C5-1346  19 nt  Target #2:  5'-CUGGAGUUUAAUGUCAAAA-3'  (SEQ ID NO: 18019)
C5-1346  19 nt  Target #3:  5'-GCUGGAGUUUAAUGUCAAA-3'  (SEQ ID NO: 20329)
C5-1347  19 nt  Target #1:  5'-GGAGUUUAAUGUCAAAACU-3'  (SEQ ID NO: 15710)
C5-1347  19 nt  Target #2:  5'-UGGAGUUUAAUGUCAAAAC-3'  (SEQ ID NO: 18020)
C5-1347  19 nt  Target #3:  5'-CUGGAGUUUAAUGUCAAAA-3'  (SEQ ID NO: 20330)
C5-1348  19 nt  Target #1:  5'-GAGUUUAAUGUCAAAACUG-3'  (SEQ ID NO: 15711)
C5-1348  19 nt  Target #2:  5'-GGAGUUUAAUGUCAAAACU-3'  (SEQ ID NO: 18021)
C5-1348  19 nt  Target #3:  5'-UGGAGUUUAAUGUCAAAAC-3'  (SEQ ID NO: 20331)
C5-1349  19 nt  Target #1:  5'-AGUUUAAUGUCAAAACUGA-3'  (SEQ ID NO: 15712)
C5-1349  19 nt  Target #2:  5'-GAGUUUAAUGUCAAAACUG-3'  (SEQ ID NO: 18022)
C5-1349  19 nt  Target #3:  5'-GGAGUUUAAUGUCAAAACU-3'  (SEQ ID NO: 20332)
C5-1350  19 nt  Target #1:  5'-GUUUAAUGUCAAAACUGAU-3'  (SEQ ID NO: 15713)
C5-1350  19 nt  Target #2:  5'-AGUUUAAUGUCAAAACUGA-3'  (SEQ ID NO: 18023)
C5-1350  19 nt  Target #3:  5'-GAGUUUAAUGUCAAAACUG-3'  (SEQ ID NO: 20333)
C5-1351  19 nt  Target #1:  5'-UUUAAUGUCAAAACUGAUG-3'  (SEQ ID NO: 15714)
C5-1351  19 nt  Target #2:  5'-GUUUAAUGUCAAAACUGAU-3'  (SEQ ID NO: 18024)
C5-1351  19 nt  Target #3:  5'-AGUUUAAUGUCAAAACUGA-3'  (SEQ ID NO: 20334)
C5-1352  19 nt  Target #1:  5'-UUAAUGUCAAAACUGAUGC-3'  (SEQ ID NO: 15715)
C5-1352  19 nt  Target #2:  5'-UUUAAUGUCAAAACUGAUG-3'  (SEQ ID NO: 18025)
C5-1352  19 nt  Target #3:  5'-GUUUAAUGUCAAAACUGAU-3'  (SEQ ID NO: 20335)
C5-1353  19 nt  Target #1:  5'-UAAUGUCAAAACUGAUGCU-3'  (SEQ ID NO: 15716)
C5-1353  19 nt  Target #2:  5'-UUAAUGUCAAAACUGAUGC-3'  (SEQ ID NO: 18026)
C5-1353  19 nt  Target #3:  5'-UUUAAUGUCAAAACUGAUG-3'  (SEQ ID NO: 20336)
C5-1354  19 nt  Target #1:  5'-AAUGUCAAAACUGAUGCUC-3'  (SEQ ID NO: 15717)
C5-1354  19 nt  Target #2:  5'-UAAUGUCAAAACUGAUGCU-3'  (SEQ ID NO: 18027)
C5-1354  19 nt  Target #3:  5'-UUAAUGUCAAAACUGAUGC-3'  (SEQ ID NO: 20337)
C5-1355  19 nt  Target #1:  5'-AUGUCAAAACUGAUGCUCC-3'  (SEQ ID NO: 15718)
C5-1355  19 nt  Target #2:  5'-AAUGUCAAAACUGAUGCUC-3'  (SEQ ID NO: 18028)
C5-1355  19 nt  Target #3:  5'-UAAUGUCAAAACUGAUGCU-3'  (SEQ ID NO: 20338)
C5-1356  19 nt  Target #1:  5'-UGUCAAAACUGAUGCUCCA-3'  (SEQ ID NO: 15719)
C5-1356  19 nt  Target #2:  5'-AUGUCAAAACUGAUGCUCC-3'  (SEQ ID NO: 18029)
C5-1356  19 nt  Target #3:  5'-AAUGUCAAAACUGAUGCUC-3'  (SEQ ID NO: 20339)
C5-1357  19 nt  Target #1:  5'-GUCAAAACUGAUGCUCCAG-3'  (SEQ ID NO: 15720)
C5-1357  19 nt  Target #2:  5'-UGUCAAAACUGAUGCUCCA-3'  (SEQ ID NO: 18030)
C5-1357  19 nt  Target #3:  5'-AUGUCAAAACUGAUGCUCC-3'  (SEQ ID NO: 20340)
C5-1358  19 nt  Target #1:  5'-UCAAAACUGAUGCUCCAGA-3'  (SEQ ID NO: 15721)
C5-1358  19 nt  Target #2:  5'-GUCAAAACUGAUGCUCCAG-3'  (SEQ ID NO: 18031)
C5-1358  19 nt  Target #3:  5'-UGUCAAAACUGAUGCUCCA-3'  (SEQ ID NO: 20341)
C5-1359  19 nt  Target #1:  5'-CAAAACUGAUGCUCCAGAU-3'  (SEQ ID NO: 15722)
C5-1359  19 nt  Target #2:  5'-UCAAAACUGAUGCUCCAGA-3'  (SEQ ID NO: 18032)
C5-1359  19 nt  Target #3:  5'-GUCAAAACUGAUGCUCCAG-3'  (SEQ ID NO: 20342)
C5-1360  19 nt  Target #1:  5'-AAAACUGAUGCUCCAGAUC-3'  (SEQ ID NO: 15723)
C5-1360  19 nt  Target #2:  5'-CAAAACUGAUGCUCCAGAU-3'  (SEQ ID NO: 18033)
C5-1360  19 nt  Target #3:  5'-UCAAAACUGAUGCUCCAGA-3'  (SEQ ID NO: 20343)
C5-1361  19 nt  Target #1:  5'-AAACUGAUGCUCCAGAUCU-3'  (SEQ ID NO: 15724)
C5-1361  19 nt  Target #2:  5'-AAAACUGAUGCUCCAGAUC-3'  (SEQ ID NO: 18034)
```

TABLE 10-continued

DsiRNA Component 19 Nucleotide Target Sequences of Human Anti-C5
DsiRNAs Predicted to have >50% Knockdown Efficacy

| | | | | |
|---|---|---|---|---|
| C5-1361 | 19 nt | Target #3: | 5'-CAAAACUGAUGCUCCAGAU-3' | (SEQ ID NO: 20344) |
| C5-1362 | 19 nt | Target #1: | 5'-AACUGAUGCUCCAGAUCUU-3' | (SEQ ID NO: 15725) |
| C5-1362 | 19 nt | Target #2: | 5'-AAACUGAUGCUCCAGAUCU-3' | (SEQ ID NO: 18035) |
| C5-1362 | 19 nt | Target #3: | 5'-AAACUGAUGCUCCAGAUCU-3' | (SEQ ID NO: 20345) |
| C5-1363 | 19 nt | Target #1: | 5'-ACUGAUGCUCCAGAUCUUC-3' | (SEQ ID NO: 15726) |
| C5-1363 | 19 nt | Target #2: | 5'-AACUGAUGCUCCAGAUCUU-3' | (SEQ ID NO: 18036) |
| C5-1363 | 19 nt | Target #3: | 5'-AAACUGAUGCUCCAGAUCU-3' | (SEQ ID NO: 20346) |
| C5-1364 | 19 nt | Target #1: | 5'-CUGAUGCUCCAGAUCUUCC-3' | (SEQ ID NO: 15727) |
| C5-1364 | 19 nt | Target #2: | 5'-ACUGAUGCUCCAGAUCUUC-3' | (SEQ ID NO: 18037) |
| C5-1364 | 19 nt | Target #3: | 5'-AACUGAUGCUCCAGAUCUU-3' | (SEQ ID NO: 20347) |
| C5-1365 | 19 nt | Target #1: | 5'-UGAUGCUCCAGAUCUUCCA-3' | (SEQ ID NO: 15728) |
| C5-1365 | 19 nt | Target #2: | 5'-CUGAUGCUCCAGAUCUUCC-3' | (SEQ ID NO: 18038) |
| C5-1365 | 19 nt | Target #3: | 5'-ACUGAUGCUCCAGAUCUUC-3' | (SEQ ID NO: 20348) |
| C5-1366 | 19 nt | Target #1: | 5'-GAUGCUCCAGAUCUUCCAG-3' | (SEQ ID NO: 15729) |
| C5-1366 | 19 nt | Target #2: | 5'-UGAUGCUCCAGAUCUUCCA-3' | (SEQ ID NO: 18039) |
| C5-1366 | 19 nt | Target #3: | 5'-CUGAUGCUCCAGAUCUUCC-3' | (SEQ ID NO: 20349) |
| C5-1367 | 19 nt | Target #1: | 5'-AUGCUCCAGAUCUUCCAGA-3' | (SEQ ID NO: 15730) |
| C5-1367 | 19 nt | Target #2: | 5'-GAUGCUCCAGAUCUUCCAG-3' | (SEQ ID NO: 18040) |
| C5-1367 | 19 nt | Target #3: | 5'-UGAUGCUCCAGAUCUUCCA-3' | (SEQ ID NO: 20350) |
| C5-1387 | 19 nt | Target #1: | 5'-GAAAAUCAGGCCAGGGAAG-3' | (SEQ ID NO: 15731) |
| C5-1387 | 19 nt | Target #2: | 5'-AGAAAAUCAGGCCAGGGAA-3' | (SEQ ID NO: 18041) |
| C5-1387 | 19 nt | Target #3: | 5'-AAGAAAAUCAGGCCAGGGA-3' | (SEQ ID NO: 20351) |
| C5-1388 | 19 nt | Target #1: | 5'-AAAAUCAGGCCAGGGAAGG-3' | (SEQ ID NO: 15732) |
| C5-1388 | 19 nt | Target #2: | 5'-GAAAAUCAGGCCAGGGAAG-3' | (SEQ ID NO: 18042) |
| C5-1388 | 19 nt | Target #3: | 5'-AGAAAAUCAGGCCAGGGAA-3' | (SEQ ID NO: 20352) |
| C5-1389 | 19 nt | Target #1: | 5'-AAAUCAGGCCAGGGAAGGU-3' | (SEQ ID NO: 15733) |
| C5-1389 | 19 nt | Target #2: | 5'-AAAAUCAGGCCAGGGAAGG-3' | (SEQ ID NO: 18043) |
| C5-1389 | 19 nt | Target #3: | 5'-GAAAAUCAGGCCAGGGAAG-3' | (SEQ ID NO: 20353) |
| C5-1390 | 19 nt | Target #1: | 5'-AAUCAGGCCAGGGAAGGUU-3' | (SEQ ID NO: 15734) |
| C5-1390 | 19 nt | Target #2: | 5'-AAAUCAGGCCAGGGAAGGU-3' | (SEQ ID NO: 18044) |
| C5-1390 | 19 nt | Target #3: | 5'-AAAAUCAGGCCAGGGAAGG-3' | (SEQ ID NO: 20354) |
| C5-1391 | 19 nt | Target #1: | 5'-AUCAGGCCAGGGAAGGUUA-3' | (SEQ ID NO: 15735) |
| C5-1391 | 19 nt | Target #2: | 5'-AAUCAGGCCAGGGAAGGUU-3' | (SEQ ID NO: 18045) |
| C5-1391 | 19 nt | Target #3: | 5'-AAAUCAGGCCAGGGAAGGU-3' | (SEQ ID NO: 20355) |
| C5-1392 | 19 nt | Target #1: | 5'-UCAGGCCAGGGAAGGUUAC-3' | (SEQ ID NO: 15736) |
| C5-1392 | 19 nt | Target #2: | 5'-AUCAGGCCAGGGAAGGUUA-3' | (SEQ ID NO: 18046) |
| C5-1392 | 19 nt | Target #3: | 5'-AAUCAGGCCAGGGAAGGUU-3' | (SEQ ID NO: 20356) |
| C5-1393 | 19 nt | Target #1: | 5'-CAGGCCAGGGAAGGUUACC-3' | (SEQ ID NO: 15737) |
| C5-1393 | 19 nt | Target #2: | 5'-UCAGGCCAGGGAAGGUUAC-3' | (SEQ ID NO: 18047) |
| C5-1393 | 19 nt | Target #3: | 5'-AUCAGGCCAGGGAAGGUUA-3' | (SEQ ID NO: 20357) |
| C5-1394 | 19 nt | Target #1: | 5'-AGGCCAGGGAAGGUUACCG-3' | (SEQ ID NO: 15738) |
| C5-1394 | 19 nt | Target #2: | 5'-CAGGCCAGGGAAGGUUACC-3' | (SEQ ID NO: 18048) |
| C5-1394 | 19 nt | Target #3: | 5'-UCAGGCCAGGGAAGGUUAC-3' | (SEQ ID NO: 20358) |
| C5-1395 | 19 nt | Target #1: | 5'-GGCCAGGGAAGGUUACCGA-3' | (SEQ ID NO: 15739) |
| C5-1395 | 19 nt | Target #2: | 5'-AGGCCAGGGAAGGUUACCG-3' | (SEQ ID NO: 18049) |
| C5-1395 | 19 nt | Target #3: | 5'-CAGGCCAGGGAAGGUUACC-3' | (SEQ ID NO: 20359) |
| C5-1396 | 19 nt | Target #1: | 5'-GCCAGGGAAGGUUACCGAG-3' | (SEQ ID NO: 15740) |
| C5-1396 | 19 nt | Target #2: | 5'-GGCCAGGGAAGGUUACCGA-3' | (SEQ ID NO: 18050) |
| C5-1396 | 19 nt | Target #3: | 5'-AGGCCAGGGAAGGUUACCG-3' | (SEQ ID NO: 20360) |
| C5-1397 | 19 nt | Target #1: | 5'-CCAGGGAAGGUUACCGAGC-3' | (SEQ ID NO: 15741) |
| C5-1397 | 19 nt | Target #2: | 5'-GCCAGGGAAGGUUACCGAG-3' | (SEQ ID NO: 18051) |
| C5-1397 | 19 nt | Target #3: | 5'-GGCCAGGGAAGGUUACCGA-3' | (SEQ ID NO: 20361) |
| C5-1398 | 19 nt | Target #1: | 5'-CAGGGAAGGUUACCGAGCA-3' | (SEQ ID NO: 15742) |
| C5-1398 | 19 nt | Target #2: | 5'-CCAGGGAAGGUUACCGAGC-3' | (SEQ ID NO: 18052) |
| C5-1398 | 19 nt | Target #3: | 5'-GCCAGGGAAGGUUACCGAG-3' | (SEQ ID NO: 20362) |
| C5-1399 | 19 nt | Target #1: | 5'-AGGGAAGGUUACCGAGCAA-3' | (SEQ ID NO: 15743) |
| C5-1399 | 19 nt | Target #2: | 5'-CAGGGAAGGUUACCGAGCA-3' | (SEQ ID NO: 18053) |
| C5-1399 | 19 nt | Target #3: | 5'-CCAGGGAAGGUUACCGAGC-3' | (SEQ ID NO: 20363) |
| C5-1400 | 19 nt | Target #1: | 5'-GGGAAGGUUACCGAGCAAU-3' | (SEQ ID NO: 15744) |
| C5-1400 | 19 nt | Target #2: | 5'-AGGGAAGGUUACCGAGCAA-3' | (SEQ ID NO: 18054) |
| C5-1400 | 19 nt | Target #3: | 5'-CAGGGAAGGUUACCGAGCA-3' | (SEQ ID NO: 20364) |
| C5-1401 | 19 nt | Target #1: | 5'-GGAAGGUUACCGAGCAAUA-3' | (SEQ ID NO: 15745) |
| C5-1401 | 19 nt | Target #2: | 5'-GGGAAGGUUACCGAGCAAU-3' | (SEQ ID NO: 18055) |
| C5-1401 | 19 nt | Target #3: | 5'-AGGGAAGGUUACCGAGCAA-3' | (SEQ ID NO: 20365) |
| C5-1402 | 19 nt | Target #1: | 5'-GAAGGUUACCGAGCAAUAG-3' | (SEQ ID NO: 15746) |
| C5-1402 | 19 nt | Target #2: | 5'-GGAAGGUUACCGAGCAAUA-3' | (SEQ ID NO: 18056) |
| C5-1402 | 19 nt | Target #3: | 5'-GGGAAGGUUACCGAGCAAU-3' | (SEQ ID NO: 20366) |
| C5-1403 | 19 nt | Target #1: | 5'-AAGGUUACCGAGCAAUAGC-3' | (SEQ ID NO: 15747) |
| C5-1403 | 19 nt | Target #2: | 5'-GAAGGUUACCGAGCAAUAG-3' | (SEQ ID NO: 18057) |
| C5-1403 | 19 nt | Target #3: | 5'-GGAAGGUUACCGAGCAAUA-3' | (SEQ ID NO: 20367) |
| C5-1404 | 19 nt | Target #1: | 5'-AGGUUACCGAGCAAUAGCA-3' | (SEQ ID NO: 15748) |
| C5-1404 | 19 nt | Target #2: | 5'-AAGGUUACCGAGCAAUAGC-3' | (SEQ ID NO: 18058) |
| C5-1404 | 19 nt | Target #3: | 5'-GAAGGUUACCGAGCAAUAG-3' | (SEQ ID NO: 20368) |
| C5-1406 | 19 nt | Target #1: | 5'-GUUACCGAGCAAUAGCAUA-3' | (SEQ ID NO: 15749) |
| C5-1406 | 19 nt | Target #2: | 5'-GGUUACCGAGCAAUAGCAU-3' | (SEQ ID NO: 18059) |
| C5-1406 | 19 nt | Target #3: | 5'-AGGUUACCGAGCAAUAGCA-3' | (SEQ ID NO: 20369) |
| C5-1407 | 19 nt | Target #1: | 5'-UUACCGAGCAAUAGCAUAC-3' | (SEQ ID NO: 15750) |

TABLE 10-continued

DsiRNA Component 19 Nucleotide Target Sequences of Human Anti-C5
DsiRNAs Predicted to have >50% Knockdown Efficacy

| Name | Length | Target | Sequence | SEQ ID NO |
|---|---|---|---|---|
| C5-1407 | 19 nt | Target #2: | 5'-GUUACCGAGCAAUAGCAUA-3' | (SEQ ID NO: 18060) |
| C5-1407 | 19 nt | Target #3: | 5'-GGUUACCGAGCAAUAGCAU-3' | (SEQ ID NO: 20370) |
| C5-1408 | 19 nt | Target #1: | 5'-UACCGAGCAAUAGCAUACU-3' | (SEQ ID NO: 15751) |
| C5-1408 | 19 nt | Target #2: | 5'-UUACCGAGCAAUAGCAUAC-3' | (SEQ ID NO: 18061) |
| C5-1408 | 19 nt | Target #3: | 5'-GUUACCGAGCAAUAGCAUA-3' | (SEQ ID NO: 20371) |
| C5-1409 | 19 nt | Target #1: | 5'-ACCGAGCAAUAGCAUACUC-3' | (SEQ ID NO: 15752) |
| C5-1409 | 19 nt | Target #2: | 5'-UACCGAGCAAUAGCAUACU-3' | (SEQ ID NO: 18062) |
| C5-1409 | 19 nt | Target #3: | 5'-UUACCGAGCAAUAGCAUAC-3' | (SEQ ID NO: 20372) |
| C5-1410 | 19 nt | Target #1: | 5'-CCGAGCAAUAGCAUACUCA-3' | (SEQ ID NO: 15753) |
| C5-1410 | 19 nt | Target #2: | 5'-ACCGAGCAAUAGCAUACUC-3' | (SEQ ID NO: 18063) |
| C5-1410 | 19 nt | Target #3: | 5'-UACCGAGCAAUAGCAUACU-3' | (SEQ ID NO: 20373) |
| C5-1411 | 19 nt | Target #1: | 5'-CGAGCAAUAGCAUACUCAU-3' | (SEQ ID NO: 15754) |
| C5-1411 | 19 nt | Target #2: | 5'-CCGAGCAAUAGCAUACUCA-3' | (SEQ ID NO: 18064) |
| C5-1411 | 19 nt | Target #3: | 5'-ACCGAGCAAUAGCAUACUC-3' | (SEQ ID NO: 20374) |
| C5-1412 | 19 nt | Target #1: | 5'-GAGCAAUAGCAUACUCAUC-3' | (SEQ ID NO: 15755) |
| C5-1412 | 19 nt | Target #2: | 5'-CGAGCAAUAGCAUACUCAU-3' | (SEQ ID NO: 18065) |
| C5-1412 | 19 nt | Target #3: | 5'-CCGAGCAAUAGCAUACUCA-3' | (SEQ ID NO: 20375) |
| C5-1413 | 19 nt | Target #1: | 5'-AGCAAUAGCAUACUCAUCU-3' | (SEQ ID NO: 15756) |
| C5-1413 | 19 nt | Target #2: | 5'-GAGCAAUAGCAUACUCAUC-3' | (SEQ ID NO: 18066) |
| C5-1413 | 19 nt | Target #3: | 5'-CGAGCAAUAGCAUACUCAU-3' | (SEQ ID NO: 20376) |
| C5-1414 | 19 nt | Target #1: | 5'-GCAAUAGCAUACUCAUCUC-3' | (SEQ ID NO: 15757) |
| C5-1414 | 19 nt | Target #2: | 5'-AGCAAUAGCAUACUCAUCU-3' | (SEQ ID NO: 18067) |
| C5-1414 | 19 nt | Target #3: | 5'-GAGCAAUAGCAUACUCAUC-3' | (SEQ ID NO: 20377) |
| C5-1415 | 19 nt | Target #1: | 5'-CAAUAGCAUACUCAUCUCU-3' | (SEQ ID NO: 15758) |
| C5-1415 | 19 nt | Target #2: | 5'-GCAAUAGCAUACUCAUCUC-3' | (SEQ ID NO: 18068) |
| C5-1415 | 19 nt | Target #3: | 5'-AGCAAUAGCAUACUCAUCU-3' | (SEQ ID NO: 20378) |
| C5-1416 | 19 nt | Target #1: | 5'-AAUAGCAUACUCAUCUCUC-3' | (SEQ ID NO: 15759) |
| C5-1416 | 19 nt | Target #2: | 5'-CAAUAGCAUACUCAUCUCU-3' | (SEQ ID NO: 18069) |
| C5-1416 | 19 nt | Target #3: | 5'-GCAAUAGCAUACUCAUCUC-3' | (SEQ ID NO: 20379) |
| C5-1417 | 19 nt | Target #1: | 5'-AUAGCAUACUCAUCUCUCA-3' | (SEQ ID NO: 15760) |
| C5-1417 | 19 nt | Target #2: | 5'-AAUAGCAUACUCAUCUCUC-3' | (SEQ ID NO: 18070) |
| C5-1417 | 19 nt | Target #3: | 5'-CAAUAGCAUACUCAUCUCU-3' | (SEQ ID NO: 20380) |
| C5-1418 | 19 nt | Target #1: | 5'-UAGCAUACUCAUCUCUCAG-3' | (SEQ ID NO: 15761) |
| C5-1418 | 19 nt | Target #2: | 5'-AUAGCAUACUCAUCUCUCA-3' | (SEQ ID NO: 18071) |
| C5-1418 | 19 nt | Target #3: | 5'-AAUAGCAUACUCAUCUCUC-3' | (SEQ ID NO: 20381) |
| C5-1419 | 19 nt | Target #1: | 5'-AGCAUACUCAUCUCUCAGC-3' | (SEQ ID NO: 15762) |
| C5-1419 | 19 nt | Target #2: | 5'-UAGCAUACUCAUCUCUCAG-3' | (SEQ ID NO: 18072) |
| C5-1419 | 19 nt | Target #3: | 5'-AUAGCAUACUCAUCUCUCA-3' | (SEQ ID NO: 20382) |
| C5-1420 | 19 nt | Target #1: | 5'-GCAUACUCAUCUCUCAGCC-3' | (SEQ ID NO: 15763) |
| C5-1420 | 19 nt | Target #2: | 5'-AGCAUACUCAUCUCUCAGC-3' | (SEQ ID NO: 18073) |
| C5-1420 | 19 nt | Target #3: | 5'-UAGCAUACUCAUCUCUCAG-3' | (SEQ ID NO: 20383) |
| C5-1421 | 19 nt | Target #1: | 5'-CAUACUCAUCUCUCAGCCA-3' | (SEQ ID NO: 15764) |
| C5-1421 | 19 nt | Target #2: | 5'-GCAUACUCAUCUCUCAGCC-3' | (SEQ ID NO: 18074) |
| C5-1421 | 19 nt | Target #3: | 5'-AGCAUACUCAUCUCUCAGC-3' | (SEQ ID NO: 20384) |
| C5-1422 | 19 nt | Target #1: | 5'-AUACUCAUCUCUCAGCCAA-3' | (SEQ ID NO: 15765) |
| C5-1422 | 19 nt | Target #2: | 5'-CAUACUCAUCUCUCAGCCA-3' | (SEQ ID NO: 18075) |
| C5-1422 | 19 nt | Target #3: | 5'-GCAUACUCAUCUCUCAGCC-3' | (SEQ ID NO: 20385) |
| C5-1423 | 19 nt | Target #1: | 5'-UACUCAUCUCUCAGCCAAA-3' | (SEQ ID NO: 15766) |
| C5-1423 | 19 nt | Target #2: | 5'-AUACUCAUCUCUCAGCCAA-3' | (SEQ ID NO: 18076) |
| C5-1423 | 19 nt | Target #3: | 5'-CAUACUCAUCUCUCAGCCA-3' | (SEQ ID NO: 20386) |
| C5-1424 | 19 nt | Target #1: | 5'-ACUCAUCUCUCAGCCAAAG-3' | (SEQ ID NO: 15767) |
| C5-1424 | 19 nt | Target #2: | 5'-UACUCAUCUCUCAGCCAAA-3' | (SEQ ID NO: 18077) |
| C5-1424 | 19 nt | Target #3: | 5'-AUACUCAUCUCUCAGCCAA-3' | (SEQ ID NO: 20387) |
| C5-1425 | 19 nt | Target #1: | 5'-CUCAUCUCUCAGCCAAAGU-3' | (SEQ ID NO: 15768) |
| C5-1425 | 19 nt | Target #2: | 5'-ACUCAUCUCUCAGCCAAAG-3' | (SEQ ID NO: 18078) |
| C5-1425 | 19 nt | Target #3: | 5'-UACUCAUCUCUCAGCCAAA-3' | (SEQ ID NO: 20388) |
| C5-1426 | 19 nt | Target #1: | 5'-UCAUCUCUCAGCCAAAGUU-3' | (SEQ ID NO: 15769) |
| C5-1426 | 19 nt | Target #2: | 5'-CUCAUCUCUCAGCCAAAGU-3' | (SEQ ID NO: 18079) |
| C5-1426 | 19 nt | Target #3: | 5'-ACUCAUCUCUCAGCCAAAG-3' | (SEQ ID NO: 20389) |
| C5-1427 | 19 nt | Target #1: | 5'-CAUCUCUCAGCCAAAGUUA-3' | (SEQ ID NO: 15770) |
| C5-1427 | 19 nt | Target #2: | 5'-UCAUCUCUCAGCCAAAGUU-3' | (SEQ ID NO: 18080) |
| C5-1427 | 19 nt | Target #3: | 5'-CUCAUCUCUCAGCCAAAGU-3' | (SEQ ID NO: 20390) |
| C5-1428 | 19 nt | Target #1: | 5'-AUCUCUCAGCCAAAGUUAC-3' | (SEQ ID NO: 15771) |
| C5-1428 | 19 nt | Target #2: | 5'-CAUCUCUCAGCCAAAGUUA-3' | (SEQ ID NO: 18081) |
| C5-1428 | 19 nt | Target #3: | 5'-UCAUCUCUCAGCCAAAGUU-3' | (SEQ ID NO: 20391) |
| C5-1429 | 19 nt | Target #1: | 5'-UCUCUCAGCCAAAGUUACC-3' | (SEQ ID NO: 15772) |
| C5-1429 | 19 nt | Target #2: | 5'-AUCUCUCAGCCAAAGUUAC-3' | (SEQ ID NO: 18082) |
| C5-1429 | 19 nt | Target #3: | 5'-CAUCUCUCAGCCAAAGUUA-3' | (SEQ ID NO: 20392) |
| C5-1430 | 19 nt | Target #1: | 5'-CUCUCAGCCAAAGUUACCU-3' | (SEQ ID NO: 15773) |
| C5-1430 | 19 nt | Target #2: | 5'-UCUCUCAGCCAAAGUUACC-3' | (SEQ ID NO: 18083) |
| C5-1430 | 19 nt | Target #3: | 5'-AUCUCUCAGCCAAAGUUAC-3' | (SEQ ID NO: 20393) |
| C5-1431 | 19 nt | Target #1: | 5'-UCUCAGCCAAAGUUACCUU-3' | (SEQ ID NO: 15774) |
| C5-1431 | 19 nt | Target #2: | 5'-CUCUCAGCCAAAGUUACCU-3' | (SEQ ID NO: 18084) |
| C5-1431 | 19 nt | Target #3: | 5'-UCUCUCAGCCAAAGUUACC-3' | (SEQ ID NO: 20394) |
| C5-1432 | 19 nt | Target #1: | 5'-CUCAGCCAAAGUUACCUUU-3' | (SEQ ID NO: 15775) |
| C5-1432 | 19 nt | Target #2: | 5'-UCUCAGCCAAAGUUACCUU-3' | (SEQ ID NO: 18085) |
| C5-1432 | 19 nt | Target #3: | 5'-CUCUCAGCCAAAGUUACCU-3' | (SEQ ID NO: 20395) |

TABLE 10-continued

DsiRNA Component 19 Nucleotide Target Sequences of Human Anti-C5
DsiRNAs Predicted to have >50% Knockdown Efficacy

| | |

TABLE 10-continued

DsiRNA Component 19 Nucleotide Target Sequences of Human Anti-C5
DsiRNAs Predicted to have >50% Knockdown Efficac TABLE 10-continued DsiRNA Component 19 Nucleotide Target Sequences of Human Anti-C5
DsiRNAs Predicted to have >50% Knockdown Efficacy

| |

TABLE 10-continued

DsiRNA Component 19 Nucleotide Target Sequences of Human Anti-C5
DsiRNAs Predicted to have >50% Knockdown Efficacy

| |

TABLE 10-continued

DsiRNA Component 19 Nucleotide Target Sequences of Human Anti-C5
DsiRNAs Predicted to have >50% Knockdown Efficac TABLE 10-continued DsiRNA Component 19 Nucleotide Target Sequences of Human Anti-C5
DsiRNAs Predicted to have >50% Knockdown Efficacy

| |

TABLE 10-continued

DsiRNA Component 19 Nucleotide Target Sequences of Human Anti-C5
DsiRNAs Predicted to have >50% Knockdown Efficacy TABLE 10-continued DsiRNA Component 19 Nucleotide Target Sequences of Human Anti-C5
DsiRNAs Predicted to have >50% Knockdown Efficacy

```
C5-1

TABLE 10-continued

DsiRNA Component 19 Nucleotide Target Sequences of Human Anti-C5
DsiRNAs Predicted to have >50% Knockdown Efficacy

```

TABLE 10-continued

DsiRNA Component 19 Nucleotide Target Sequences of Human Anti-C5
DsiRNAs Predicted to have >50% Knockdown Efficacy

| | | | | |
|---|---|---|---|---|
| C5-2046 | 19 nt | Target #1: | 5'-AAAUGAUGAACCUUGUAAA-3' | (SEQ ID NO: 16007) |
| C5-2046 | 19 nt | Target #2: | 5'-AAAAUGAUGAACCUUGUAA-3' | (SEQ ID NO: 18317) |
| C5-2046 | 19 nt | Target #3: | 5'-GAAAAUGAUGAACCUUGUA-3' | (SEQ ID NO: 20627) |
| C5-2047 | 19 nt | Target #1: | 5'-AAUGAUGAACCUUGUAAAG-3' | (SEQ ID NO: 16008) |
| C5-2047 | 19 nt | Target #2: | 5'-AAAUGAUGAACCUUGUAAA-3' | (SEQ ID NO: 18318) |
| C5-2047 | 19 nt | Target #3: | 5'-AAAAUGAUGAACCUUGUAA-3' | (SEQ ID NO: 20628) |
| C5-2049 | 19 nt | Target #1: | 5'-UGAUGAACCUUGUAAAGAA-3' | (SEQ ID NO: 16009) |
| C5-2049 | 19 nt | Target #2: | 5'-AUGAUGAACCUUGUAAAGA-3' | (SEQ ID NO: 18319) |
| C5-2049 | 19 nt | Target #3: | 5'-AAUGAUGAACCUUGUAAAG-3' | (SEQ ID NO: 20629) |
| C5-2052 | 19 nt | Target #1: | 5'-UGAACCUUGUAAAGAAAUU-3' | (SEQ ID NO: 16010) |
| C5-2052 | 19 nt | Target #2: | 5'-AUGAACCUUGUAAAGAAAU-3' | (SEQ ID NO: 18320) |
| C5-2052 | 19 nt | Target #3: | 5'-GAUGAACCUUGUAAAGAAA-3' | (SEQ ID NO: 20630) |
| C5-2096 | 19 nt | Target #1: | 5'-AGAAGAUAGAAGAAAUAGC-3' | (SEQ ID NO: 16011) |
| C5-2096 | 19 nt | Target #2: | 5'-AAGAAGAUAGAAGAAAUAG-3' | (SEQ ID NO: 18321) |
| C5-2096 | 19 nt | Target #3: | 5'-AAAGAAGAUAGAAGAAAUA-3' | (SEQ ID NO: 20631) |
| C5-2097 | 19 nt | Target #1: | 5'-GAAGAUAGAAGAAAUAGCU-3' | (SEQ ID NO: 16012) |
| C5-2097 | 19 nt | Target #2: | 5'-AGAAGAUAGAAGAAAUAGC-3' | (SEQ ID NO: 18322) |
| C5-2097 | 19 nt | Target #3: | 5'-AAGAAGAUAGAAGAAAUAG-3' | (SEQ ID NO: 20632) |
| C5-2098 | 19 nt | Target #1: | 5'-AAGAUAGAAGAAAUAGCUG-3' | (SEQ ID NO: 16013) |
| C5-2098 | 19 nt | Target #2: | 5'-GAAGAUAGAAGAAAUAGCU-3' | (SEQ ID NO: 18323) |
| C5-2098 | 19 nt | Target #3: | 5'-AGAAGAUAGAAGAAAUAGC-3' | (SEQ ID NO: 20633) |
| C5-2099 | 19 nt | Target #1: | 5'-AGAUAGAAGAAAUAGCUGC-3' | (SEQ ID NO: 16014) |
| C5-2099 | 19 nt | Target #2: | 5'-AAGAUAGAAGAAAUAGCUG-3' | (SEQ ID NO: 18324) |
| C5-2099 | 19 nt | Target #3: | 5'-GAAGAUAGAAGAAAUAGCU-3' | (SEQ ID NO: 20634) |
| C5-2100 | 19 nt | Target #1: | 5'-GAUAGAAGAAAUAGCUGCU-3' | (SEQ ID NO: 16015) |
| C5-2100 | 19 nt | Target #2: | 5'-AGAUAGAAGAAAUAGCUGC-3' | (SEQ ID NO: 18325) |
| C5-2100 | 19 nt | Target #3: | 5'-AAGAUAGAAGAAAUAGCUG-3' | (SEQ ID NO: 20635) |
| C5-2101 | 19 nt | Target #1: | 5'-AUAGAAGAAAUAGCUGCUA-3' | (SEQ ID NO: 16016) |
| C5-2101 | 19 nt | Target #2: | 5'-GAUAGAAGAAAUAGCUGCU-3' | (SEQ ID NO: 18326) |
| C5-2101 | 19 nt | Target #3: | 5'-AGAUAGAAGAAAUAGCUGC-3' | (SEQ ID NO: 20636) |
| C5-2102 | 19 nt | Target #1: | 5'-UAGAAGAAAUAGCUGCUAA-3' | (SEQ ID NO: 16017) |
| C5-2102 | 19 nt | Target #2: | 5'-AUAGAAGAAAUAGCUGCUA-3' | (SEQ ID NO: 18327) |
| C5-2102 | 19 nt | Target #3: | 5'-GAUAGAAGAAAUAGCUGCU-3' | (SEQ ID NO: 20637) |
| C5-2103 | 19 nt | Target #1: | 5'-AGAAGAAAUAGCUGCUAAA-3' | (SEQ ID NO: 16018) |
| C5-2103 | 19 nt | Target #2: | 5'-UAGAAGAAAUAGCUGCUAA-3' | (SEQ ID NO: 18328) |
| C5-2103 | 19 nt | Target #3: | 5'-AUAGAAGAAAUAGCUGCUA-3' | (SEQ ID NO: 20638) |
| C5-2104 | 19 nt | Target #1: | 5'-GAAGAAAUAGCUGCUAAAU-3' | (SEQ ID NO: 16019) |
| C5-2104 | 19 nt | Target #2: | 5'-AGAAGAAAUAGCUGCUAAA-3' | (SEQ ID NO: 18329) |
| C5-2104 | 19 nt | Target #3: | 5'-UAGAAGAAAUAGCUGCUAA-3' | (SEQ ID NO: 20639) |
| C5-2105 | 19 nt | Target #1: | 5'-AAGAAAUAGCUGCUAAAUA-3' | (SEQ ID NO: 16020) |
| C5-2105 | 19 nt | Target #2: | 5'-GAAGAAAUAGCUGCUAAAU-3' | (SEQ ID NO: 18330) |
| C5-2105 | 19 nt | Target #3: | 5'-AGAAGAAAUAGCUGCUAAA-3' | (SEQ ID NO: 20640) |
| C5-2106 | 19 nt | Target #1: | 5'-AGAAAUAGCUGCUAAAUAU-3' | (SEQ ID NO: 16021) |
| C5-2106 | 19 nt | Target #2: | 5'-AAGAAAUAGCUGCUAAAUA-3' | (SEQ ID NO: 18331) |
| C5-2106 | 19 nt | Target #3: | 5'-GAAGAAAUAGCUGCUAAAU-3' | (SEQ ID NO: 20641) |
| C5-2107 | 19 nt | Target #1: | 5'-GAAAUAGCUGCUAAAUAUA-3' | (SEQ ID NO: 16022) |
| C5-2107 | 19 nt | Target #2: | 5'-AGAAAUAGCUGCUAAAUAU-3' | (SEQ ID NO: 18332) |
| C5-2107 | 19 nt | Target #3: | 5'-AAGAAAUAGCUGCUAAAUA-3' | (SEQ ID NO: 20642) |
| C5-2108 | 19 nt | Target #1: | 5'-AAAUAGCUGCUAAAUAUAA-3' | (SEQ ID NO: 16023) |
| C5-2108 | 19 nt | Target #2: | 5'-GAAAUAGCUGCUAAAUAUA-3' | (SEQ ID NO: 18333) |
| C5-2108 | 19 nt | Target #3: | 5'-AGAAAUAGCUGCUAAAUAU-3' | (SEQ ID NO: 20643) |
| C5-2109 | 19 nt | Target #1: | 5'-AAUAGCUGCUAAAUAUAAA-3' | (SEQ ID NO: 16024) |
| C5-2109 | 19 nt | Target #2: | 5'-AAAUAGCUGCUAAAUAUAA-3' | (SEQ ID NO: 18334) |
| C5-2109 | 19 nt | Target #3: | 5'-GAAAUAGCUGCUAAAUAUA-3' | (SEQ ID NO: 20644) |
| C5-2110 | 19 nt | Target #1: | 5'-AUAGCUGCUAAAUAUAAAC-3' | (SEQ ID NO: 16025) |
| C5-2110 | 19 nt | Target #2: | 5'-AAUAGCUGCUAAAUAUAAA-3' | (SEQ ID NO: 18335) |
| C5-2110 | 19 nt | Target #3: | 5'-AAAUAGCUGCUAAAUAUAA-3' | (SEQ ID NO: 20645) |
| C5-2111 | 19 nt | Target #1: | 5'-UAGCUGCUAAAUAUAAACA-3' | (SEQ ID NO: 16026) |
| C5-2111 | 19 nt | Target #2: | 5'-AUAGCUGCUAAAUAUAAAC-3' | (SEQ ID NO: 18336) |
| C5-2111 | 19 nt | Target #3: | 5'-AAUAGCUGCUAAAUAUAAA-3' | (SEQ ID NO: 20646) |
| C5-2112 | 19 nt | Target #1: | 5'-AGCUGCUAAAUAUAAACAU-3' | (SEQ ID NO: 16027) |
| C5-2112 | 19 nt | Target #2: | 5'-UAGCUGCUAAAUAUAAACA-3' | (SEQ ID NO: 18337) |
| C5-2112 | 19 nt | Target #3: | 5'-AUAGCUGCUAAAUAUAAAC-3' | (SEQ ID NO: 20647) |
| C5-2113 | 19 nt | Target #1: | 5'-GCUGCUAAAUAUAAACAUU-3' | (SEQ ID NO: 16028) |
| C5-2113 | 19 nt | Target #2: | 5'-AGCUGCUAAAUAUAAACAU-3' | (SEQ ID NO: 18338) |
| C5-2113 | 19 nt | Target #3: | 5'-UAGCUGCUAAAUAUAAACA-3' | (SEQ ID NO: 20648) |
| C5-2135 | 19 nt | Target #1: | 5'-UAGUGAAGAAAUGUUGUUA-3' | (SEQ ID NO: 16029) |
| C5-2135 | 19 nt | Target #2: | 5'-GUAGUGAAGAAAUGUUGUU-3' | (SEQ ID NO: 18339) |
| C5-2135 | 19 nt | Target #3: | 5'-AGUAGUGAAGAAAUGUUGU-3' | (SEQ ID NO: 20649) |
| C5-2136 | 19 nt | Target #1: | 5'-AGUGAAGAAAUGUUGUUAC-3' | (SEQ ID NO: 16030) |
| C5-2136 | 19 nt | Target #2: | 5'-UAGUGAAGAAAUGUUGUUA-3' | (SEQ ID NO: 18340) |
| C5-2136 | 19 nt | Target #3: | 5'-GUAGUGAAGAAAUGUUGUU-3' | (SEQ ID NO: 20650) |
| C5-2137 | 19 nt | Target #1: | 5'-GUGAAGAAAUGUUGUUACG-3' | (SEQ ID NO: 16031) |
| C5-2137 | 19 nt | Target #2: | 5'-AGUGAAGAAAUGUUGUUAC-3' | (SEQ ID NO: 18341) |
| C5-2137 | 19 nt | Target #3: | 5'-UAGUGAAGAAAUGUUGUUA-3' | (SEQ ID NO: 20651) |
| C5-2138 | 19 nt | Target #1: | 5'-UGAAGAAAUGUUGUUACGA-3' | (SEQ ID NO: 16032) |
| C5-2138 | 19 nt | Target #2: | 5'-GUGAAGAAAUGUUGUUACG-3' | (SEQ ID NO: 18342) |

TABLE 10-continued

DsiRNA Component 19 Nucleotide Target Sequences of Human Anti-C5
DsiRNAs Predicted to have >50% Knockdown Efficacy

| | | | | |
|---|---|---|---|---|
| C5-2138 | 19 nt | Target #3: | 5'-AGUGAAGAAAUGUUGUUAC-3' | (SEQ ID NO: 20652) |
| C5-2139 | 19 nt | Target #1: | 5'-GAAGAAAUGUUGUUACGAU-3' | (SEQ ID NO: 16033) |
| C5-2139 | 19 nt | Target #2: | 5'-UGAAGAAAUGUUGUUACGA-3' | (SEQ ID NO: 18343) |
| C5-2139 | 19 nt | Target #3: | 5'-GUGAAGAAAUGUUGUUACG-3' | (SEQ ID NO: 20653) |
| C5-2140 | 19 nt | Target #1: | 5'-AAGAAAUGUUGUUACGAUG-3' | (SEQ ID NO: 16034) |
| C5-2140 | 19 nt | Target #2: | 5'-GAAGAAAUGUUGUUACGAU-3' | (SEQ ID NO: 18344) |
| C5-2140 | 19 nt | Target #3: | 5'-UGAAGAAAUGUUGUUACGA-3' | (SEQ ID NO: 20654) |
| C5-2141 | 19 nt | Target #1: | 5'-AGAAAUGUUGUUACGAUGG-3' | (SEQ ID NO: 16035) |
| C5-2141 | 19 nt | Target #2: | 5'-AAGAAAUGUUGUUACGAUG-3' | (SEQ ID NO: 18345) |
| C5-2141 | 19 nt | Target #3: | 5'-GAAGAAAUGUUGUUACGAU-3' | (SEQ ID NO: 20655) |
| C5-2142 | 19 nt | Target #1: | 5'-GAAAUGUUGUUACGAUGGA-3' | (SEQ ID NO: 16036) |
| C5-2142 | 19 nt | Target #2: | 5'-AGAAAUGUUGUUACGAUGG-3' | (SEQ ID NO: 18346) |
| C5-2142 | 19 nt | Target #3: | 5'-AAGAAAUGUUGUUACGAUG-3' | (SEQ ID NO: 20656) |
| C5-2143 | 19 nt | Target #1: | 5'-AAAUGUUGUUACGAUGGAG-3' | (SEQ ID NO: 16037) |
| C5-2143 | 19 nt | Target #2: | 5'-GAAAUGUUGUUACGAUGGA-3' | (SEQ ID NO: 18347) |
| C5-2143 | 19 nt | Target #3: | 5'-AGAAAUGUUGUUACGAUGG-3' | (SEQ ID NO: 20657) |
| C5-2174 | 19 nt | Target #1: | 5'-AUGAUGAAACCUGUGAGCA-3' | (SEQ ID NO: 16038) |
| C5-2174 | 19 nt | Target #2: | 5'-AAUGAUGAAACCUGUGAGC-3' | (SEQ ID NO: 18348) |
| C5-2174 | 19 nt | Target #3: | 5'-UAAUGAUGAAACCUGUGAG-3' | (SEQ ID NO: 20658) |
| C5-2175 | 19 nt | Target #1: | 5'-UGAUGAAACCUGUGAGCAG-3' | (SEQ ID NO: 16039) |
| C5-2175 | 19 nt | Target #2: | 5'-AUGAUGAAACCUGUGAGCA-3' | (SEQ ID NO: 18349) |
| C5-2175 | 19 nt | Target #3: | 5'-AAUGAUGAAACCUGUGAGC-3' | (SEQ ID NO: 20659) |
| C5-2176 | 19 nt | Target #1: | 5'-GAUGAAACCUGUGAGCAGC-3' | (SEQ ID NO: 16040) |
| C5-2176 | 19 nt | Target #2: | 5'-UGAUGAAACCUGUGAGCAG-3' | (SEQ ID NO: 18350) |
| C5-2176 | 19 nt | Target #3: | 5'-AUGAUGAAACCUGUGAGCA-3' | (SEQ ID NO: 20660) |
| C5-2177 | 19 nt | Target #1: | 5'-AUGAAACCUGUGAGCAGCG-3' | (SEQ ID NO: 16041) |
| C5-2177 | 19 nt | Target #2: | 5'-GAUGAAACCUGUGAGCAGC-3' | (SEQ ID NO: 18351) |
| C5-2177 | 19 nt | Target #3: | 5'-UGAUGAAACCUGUGAGCAG-3' | (SEQ ID NO: 20661) |
| C5-2178 | 19 nt | Target #1: | 5'-UGAAACCUGUGAGCAGCGA-3' | (SEQ ID NO: 16042) |
| C5-2178 | 19 nt | Target #2: | 5'-AUGAAACCUGUGAGCAGCG-3' | (SEQ ID NO: 18352) |
| C5-2178 | 19 nt | Target #3: | 5'-GAUGAAACCUGUGAGCAGC-3' | (SEQ ID NO: 20662) |
| C5-2179 | 19 nt | Target #1: | 5'-GAAACCUGUGAGCAGCGAG-3' | (SEQ ID NO: 16043) |
| C5-2179 | 19 nt | Target #2: | 5'-UGAAACCUGUGAGCAGCGA-3' | (SEQ ID NO: 18353) |
| C5-2179 | 19 nt | Target #3: | 5'-AUGAAACCUGUGAGCAGCG-3' | (SEQ ID NO: 20663) |
| C5-2180 | 19 nt | Target #1: | 5'-AAACCUGUGAGCAGCGAGC-3' | (SEQ ID NO: 16044) |
| C5-2180 | 19 nt | Target #2: | 5'-GAAACCUGUGAGCAGCGAG-3' | (SEQ ID NO: 18354) |
| C5-2180 | 19 nt | Target #3: | 5'-UGAAACCUGUGAGCAGCGA-3' | (SEQ ID NO: 20664) |
| C5-2183 | 19 nt | Target #1: | 5'-CCUGUGAGCAGCGAGCUGC-3' | (SEQ ID NO: 16045) |
| C5-2183 | 19 nt | Target #2: | 5'-ACCUGUGAGCAGCGAGCUG-3' | (SEQ ID NO: 18355) |
| C5-2183 | 19 nt | Target #3: | 5'-AACCUGUGAGCAGCGAGCU-3' | (SEQ ID NO: 20665) |
| C5-2184 | 19 nt | Target #1: | 5'-CUGUGAGCAGCGAGCUGCA-3' | (SEQ ID NO: 16046) |
| C5-2184 | 19 nt | Target #2: | 5'-CCUGUGAGCAGCGAGCUGC-3' | (SEQ ID NO: 18356) |
| C5-2184 | 19 nt | Target #3: | 5'-ACCUGUGAGCAGCGAGCUG-3' | (SEQ ID NO: 20666) |
| C5-2185 | 19 nt | Target #1: | 5'-UGUGAGCAGCGAGCUGCAC-3' | (SEQ ID NO: 16047) |
| C5-2185 | 19 nt | Target #2: | 5'-CUGUGAGCAGCGAGCUGCA-3' | (SEQ ID NO: 18357) |
| C5-2185 | 19 nt | Target #3: | 5'-CCUGUGAGCAGCGAGCUGC-3' | (SEQ ID NO: 20667) |
| C5-2186 | 19 nt | Target #1: | 5'-GUGAGCAGCGAGCUGCACG-3' | (SEQ ID NO: 16048) |
| C5-2186 | 19 nt | Target #2: | 5'-UGUGAGCAGCGAGCUGCAC-3' | (SEQ ID NO: 18358) |
| C5-2186 | 19 nt | Target #3: | 5'-CUGUGAGCAGCGAGCUGCA-3' | (SEQ ID NO: 20668) |
| C5-2187 | 19 nt | Target #1: | 5'-UGAGCAGCGAGCUGCACGG-3' | (SEQ ID NO: 16049) |
| C5-2187 | 19 nt | Target #2: | 5'-GUGAGCAGCGAGCUGCACG-3' | (SEQ ID NO: 18359) |
| C5-2187 | 19 nt | Target #3: | 5'-UGUGAGCAGCGAGCUGCAC-3' | (SEQ ID NO: 20669) |
| C5-2188 | 19 nt | Target #1: | 5'-GAGCAGCGAGCUGCACGGA-3' | (SEQ ID NO: 16050) |
| C5-2188 | 19 nt | Target #2: | 5'-UGAGCAGCGAGCUGCACGG-3' | (SEQ ID NO: 18360) |
| C5-2188 | 19 nt | Target #3: | 5'-GUGAGCAGCGAGCUGCACG-3' | (SEQ ID NO: 20670) |
| C5-2189 | 19 nt | Target #1: | 5'-AGCAGCGAGCUGCACGGAU-3' | (SEQ ID NO: 16051) |
| C5-2189 | 19 nt | Target #2: | 5'-GAGCAGCGAGCUGCACGGA-3' | (SEQ ID NO: 18361) |
| C5-2189 | 19 nt | Target #3: | 5'-UGAGCAGCGAGCUGCACGG-3' | (SEQ ID NO: 20671) |
| C5-2190 | 19 nt | Target #1: | 5'-GCAGCGAGCUGCACGGAUU-3' | (SEQ ID NO: 16052) |
| C5-2190 | 19 nt | Target #2: | 5'-AGCAGCGAGCUGCACGGAU-3' | (SEQ ID NO: 18362) |
| C5-2190 | 19 nt | Target #3: | 5'-GAGCAGCGAGCUGCACGGA-3' | (SEQ ID NO: 20672) |
| C5-2191 | 19 nt | Target #1: | 5'-CAGCGAGCUGCACGGAUUA-3' | (SEQ ID NO: 16053) |
| C5-2191 | 19 nt | Target #2: | 5'-GCAGCGAGCUGCACGGAUU-3' | (SEQ ID NO: 18363) |
| C5-2191 | 19 nt | Target #3: | 5'-AGCAGCGAGCUGCACGGAU-3' | (SEQ ID NO: 20673) |
| C5-2192 | 19 nt | Target #1: | 5'-AGCGAGCUGCACGGAUUAG-3' | (SEQ ID NO: 16054) |
| C5-2192 | 19 nt | Target #2: | 5'-CAGCGAGCUGCACGGAUUA-3' | (SEQ ID NO: 18364) |
| C5-2192 | 19 nt | Target #3: | 5'-GCAGCGAGCUGCACGGAUU-3' | (SEQ ID NO: 20674) |
| C5-2193 | 19 nt | Target #1: | 5'-GCGAGCUGCACGGAUUAGU-3' | (SEQ ID NO: 16055) |
| C5-2193 | 19 nt | Target #2: | 5'-AGCGAGCUGCACGGAUUAG-3' | (SEQ ID NO: 18365) |
| C5-2193 | 19 nt | Target #3: | 5'-CAGCGAGCUGCACGGAUUA-3' | (SEQ ID NO: 20675) |
| C5-2251 | 19 nt | Target #1: | 5'-GUCGUCGCAAGCCAGCUCC-3' | (SEQ ID NO: 16056) |
| C5-2251 | 19 nt | Target #2: | 5'-UGUCGUCGCAAGCCAGCUC-3' | (SEQ ID NO: 18366) |
| C5-2251 | 19 nt | Target #3: | 5'-GUGUCGUCGCAAGCCAGCU-3' | (SEQ ID NO: 20676) |
| C5-2252 | 19 nt | Target #1: | 5'-UCGUCGCAAGCCAGCUCCG-3' | (SEQ ID NO: 16057) |
| C5-2252 | 19 nt | Target #2: | 5'-GUCGUCGCAAGCCAGCUCC-3' | (SEQ ID NO: 18367) |
| C5-2252 | 19 nt | Target #3: | 5'-UGUCGUCGCAAGCCAGCUC-3' | (SEQ ID NO: 20677) |
| C5-2253 | 19 nt | Target #1: | 5'-CGUCGCAAGCCAGCUCCGU-3' | (SEQ ID NO: 16058) |

TABLE 10-continued

DsiRNA Component 19 Nucleotide Target Sequences of Human Anti-C5
DsiRNAs Predicted to have >50% Knockdown Efficacy TABLE 10-continued DsiRNA Component 19 Nucleotide Target Sequences of Human Anti-C5
DsiRNAs Predicted to have >50% Knockdown Efficacy TABLE 10-continued DsiRNA Component 19 Nucleotide Target Sequences of Human Anti-C5
DsiRNAs Predicted to have >50% Knockdown Efficacy

| | | | | |
|---|---|---|---|---|
| C5-2377 | 19 nt | Target #3: | 5'-UGUGGGAAGUUCAUCUUGU-3' | (SEQ ID NO: 20729) |
| C5-2378 | 19 nt | Target #1: | 5'-GGGAAGUUCAUCUUGUUCC-3' | (SEQ ID NO: 16110) |
| C5-2378 | 19 nt | Target #2: | 5'-UGGGAAGUUCAUCUUGUUC-3' | (SEQ ID NO: 18420) |
| C5-2378 | 19 nt | Target #3: | 5'-GUGGGAAGUUCAUCUUGUU-3' | (SEQ ID NO: 20730) |
| C5-2379 | 19 nt | Target #1: | 5'-GGAAGUUCAUCUUGUUCCC-3' | (SEQ ID NO: 16111) |
| C5-2379 | 19 nt | Target #2: | 5'-GGGAAGUUCAUCUUGUUCC-3' | (SEQ ID NO: 18421) |
| C5-2379 | 19 nt | Target #3: | 5'-UGGGAAGUUCAUCUUGUUC-3' | (SEQ ID NO: 20731) |
| C5-2380 | 19 nt | Target #1: | 5'-GAAGUUCAUCUUGUUCCCA-3' | (SEQ ID NO: 16112) |
| C5-2380 | 19 nt | Target #2: | 5'-GGAAGUUCAUCUUGUUCCC-3' | (SEQ ID NO: 18422) |
| C5-2380 | 19 nt | Target #3: | 5'-GGGAAGUUCAUCUUGUUCC-3' | (SEQ ID NO: 20732) |
| C5-2381 | 19 nt | Target #1: | 5'-AAGUUCAUCUUGUUCCCAG-3' | (SEQ ID NO: 16113) |
| C5-2381 | 19 nt | Target #2: | 5'-GAAGUUCAUCUUGUUCCCA-3' | (SEQ ID NO: 18423) |
| C5-2381 | 19 nt | Target #3: | 5'-GGAAGUUCAUCUUGUUCCC-3' | (SEQ ID NO: 20733) |
| C5-2382 | 19 nt | Target #1: | 5'-AGUUCAUCUUGUUCCCAGA-3' | (SEQ ID NO: 16114) |
| C5-2382 | 19 nt | Target #2: | 5'-AAGUUCAUCUUGUUCCCAG-3' | (SEQ ID NO: 18424) |
| C5-2382 | 19 nt | Target #3: | 5'-GAAGUUCAUCUUGUUCCCA-3' | (SEQ ID NO: 20734) |
| C5-2383 | 19 nt | Target #1: | 5'-GUUCAUCUUGUUCCCAGAA-3' | (SEQ ID NO: 16115) |
| C5-2383 | 19 nt | Target #2: | 5'-AGUUCAUCUUGUUCCCAGA-3' | (SEQ ID NO: 18425) |
| C5-2383 | 19 nt | Target #3: | 5'-AAGUUCAUCUUGUUCCCAG-3' | (SEQ ID NO: 20735) |
| C5-2384 | 19 nt | Target #1: | 5'-UUCAUCUUGUUCCCAGAAG-3' | (SEQ ID NO: 16116) |
| C5-2384 | 19 nt | Target #2: | 5'-GUUCAUCUUGUUCCCAGAA-3' | (SEQ ID NO: 18426) |
| C5-2384 | 19 nt | Target #3: | 5'-AGUUCAUCUUGUUCCCAGA-3' | (SEQ ID NO: 20736) |
| C5-2385 | 19 nt | Target #1: | 5'-UCAUCUUGUUCCCAGAAGA-3' | (SEQ ID NO: 16117) |
| C5-2385 | 19 nt | Target #2: | 5'-UUCAUCUUGUUCCCAGAAG-3' | (SEQ ID NO: 18427) |
| C5-2385 | 19 nt | Target #3: | 5'-GUUCAUCUUGUUCCCAGAA-3' | (SEQ ID NO: 20737) |
| C5-2386 | 19 nt | Target #1: | 5'-CAUCUUGUUCCCAGAAGAA-3' | (SEQ ID NO: 16118) |
| C5-2386 | 19 nt | Target #2: | 5'-UCAUCUUGUUCCCAGAAGA-3' | (SEQ ID NO: 18428) |
| C5-2386 | 19 nt | Target #3: | 5'-UUCAUCUUGUUCCCAGAAG-3' | (SEQ ID NO: 20738) |
| C5-2387 | 19 nt | Target #1: | 5'-AUCUUGUUCCCAGAAGAAA-3' | (SEQ ID NO: 16119) |
| C5-2387 | 19 nt | Target #2: | 5'-CAUCUUGUUCCCAGAAGAA-3' | (SEQ ID NO: 18429) |
| C5-2387 | 19 nt | Target #3: | 5'-UCAUCUUGUUCCCAGAAGA-3' | (SEQ ID NO: 20739) |
| C5-2388 | 19 nt | Target #1: | 5'-UCUUGUUCCCAGAAGAAAA-3' | (SEQ ID NO: 16120) |
| C5-2388 | 19 nt | Target #2: | 5'-AUCUUGUUCCCAGAAGAAA-3' | (SEQ ID NO: 18430) |
| C5-2388 | 19 nt | Target #3: | 5'-CAUCUUGUUCCCAGAAGAA-3' | (SEQ ID NO: 20740) |
| C5-2389 | 19 nt | Target #1: | 5'-CUUGUUCCCAGAAGAAAAC-3' | (SEQ ID NO: 16121) |
| C5-2389 | 19 nt | Target #2: | 5'-UCUUGUUCCCAGAAGAAAA-3' | (SEQ ID NO: 18431) |
| C5-2389 | 19 nt | Target #3: | 5'-AUCUUGUUCCCAGAAGAAA-3' | (SEQ ID NO: 20741) |
| C5-2390 | 19 nt | Target #1: | 5'-UUGUUCCCAGAAGAAAACA-3' | (SEQ ID NO: 16122) |
| C5-2390 | 19 nt | Target #2: | 5'-CUUGUUCCCAGAAGAAAAC-3' | (SEQ ID NO: 18432) |
| C5-2390 | 19 nt | Target #3: | 5'-UCUUGUUCCCAGAAGAAAA-3' | (SEQ ID NO: 20742) |
| C5-2391 | 19 nt | Target #1: | 5'-UGUUCCCAGAAGAAAACAG-3' | (SEQ ID NO: 16123) |
| C5-2391 | 19 nt | Target #2: | 5'-UUGUUCCCAGAAGAAAACA-3' | (SEQ ID NO: 18433) |
| C5-2391 | 19 nt | Target #3: | 5'-CUUGUUCCCAGAAGAAAAC-3' | (SEQ ID NO: 20743) |
| C5-2392 | 19 nt | Target #1: | 5'-GUUCCCAGAAGAAAACAGU-3' | (SEQ ID NO: 16124) |
| C5-2392 | 19 nt | Target #2: | 5'-UGUUCCCAGAAGAAAACAG-3' | (SEQ ID NO: 18434) |
| C5-2392 | 19 nt | Target #3: | 5'-UUGUUCCCAGAAGAAAACA-3' | (SEQ ID NO: 20744) |
| C5-2393 | 19 nt | Target #1: | 5'-UUCCCAGAAGAAAACAGUU-3' | (SEQ ID NO: 16125) |
| C5-2393 | 19 nt | Target #2: | 5'-GUUCCCAGAAGAAAACAGU-3' | (SEQ ID NO: 18435) |
| C5-2393 | 19 nt | Target #3: | 5'-UGUUCCCAGAAGAAAACAG-3' | (SEQ ID NO: 20745) |
| C5-2394 | 19 nt | Target #1: | 5'-UCCCAGAAGAAAACAGUUG-3' | (SEQ ID NO: 16126) |
| C5-2394 | 19 nt | Target #2: | 5'-UUCCCAGAAGAAAACAGUU-3' | (SEQ ID NO: 18436) |
| C5-2394 | 19 nt | Target #3: | 5'-GUUCCCAGAAGAAAACAGU-3' | (SEQ ID NO: 20746) |
| C5-2395 | 19 nt | Target #1: | 5'-CCCAGAAGAAAACAGUUGC-3' | (SEQ ID NO: 16127) |
| C5-2395 | 19 nt | Target #2: | 5'-UCCCAGAAGAAAACAGUUG-3' | (SEQ ID NO: 18437) |
| C5-2395 | 19 nt | Target #3: | 5'-UUCCCAGAAGAAAACAGUU-3' | (SEQ ID NO: 20747) |
| C5-2396 | 19 nt | Target #1: | 5'-CCAGAAGAAAACAGUUGCA-3' | (SEQ ID NO: 16128) |
| C5-2396 | 19 nt | Target #2: | 5'-CCCAGAAGAAAACAGUUGC-3' | (SEQ ID NO: 18438) |
| C5-2396 | 19 nt | Target #3: | 5'-UCCCAGAAGAAAACAGUUG-3' | (SEQ ID NO: 20748) |
| C5-2397 | 19 nt | Target #1: | 5'-CAGAAGAAAACAGUUGCAG-3' | (SEQ ID NO: 16129) |
| C5-2397 | 19 nt | Target #2: | 5'-CCAGAAGAAAACAGUUGCA-3' | (SEQ ID NO: 18439) |
| C5-2397 | 19 nt | Target #3: | 5'-CCCAGAAGAAAACAGUUGC-3' | (SEQ ID NO: 20749) |
| C5-2398 | 19 nt | Target #1: | 5'-AGAAGAAAACAGUUGCAGU-3' | (SEQ ID NO: 16130) |
| C5-2398 | 19 nt | Target #2: | 5'-CAGAAGAAAACAGUUGCAG-3' | (SEQ ID NO: 18440) |
| C5-2398 | 19 nt | Target #3: | 5'-CCAGAAGAAAACAGUUGCA-3' | (SEQ ID NO: 20750) |
| C5-2399 | 19 nt | Target #1: | 5'-GAAGAAAACAGUUGCAGUU-3' | (SEQ ID NO: 16131) |
| C5-2399 | 19 nt | Target #2: | 5'-AGAAGAAAACAGUUGCAGU-3' | (SEQ ID NO: 18441) |
| C5-2399 | 19 nt | Target #3: | 5'-CAGAAGAAAACAGUUGCAG-3' | (SEQ ID NO: 20751) |
| C5-2400 | 19 nt | Target #1: | 5'-AAGAAAACAGUUGCAGUUU-3' | (SEQ ID NO: 16132) |
| C5-2400 | 19 nt | Target #2: | 5'-GAAGAAAACAGUUGCAGUU-3' | (SEQ ID NO: 18442) |
| C5-2400 | 19 nt | Target #3: | 5'-AGAAGAAAACAGUUGCAGU-3' | (SEQ ID NO: 20752) |
| C5-2401 | 19 nt | Target #1: | 5'-AGAAAACAGUUGCAGUUUG-3' | (SEQ ID NO: 16133) |
| C5-2401 | 19 nt | Target #2: | 5'-AAGAAAACAGUUGCAGUUU-3' | (SEQ ID NO: 18443) |
| C5-2401 | 19 nt | Target #3: | 5'-GAAGAAAACAGUUGCAGUU-3' | (SEQ ID NO: 20753) |
| C5-2402 | 19 nt | Target #1: | 5'-GAAAACAGUUGCAGUUUGC-3' | (SEQ ID NO: 16134) |
| C5-2402 | 19 nt | Target #2: | 5'-AGAAAACAGUUGCAGUUUG-3' | (SEQ ID NO: 18444) |
| C5-2402 | 19 nt | Target #3: | 5'-AAGAAAACAGUUGCAGUUU-3' | (SEQ ID NO: 20754) |
| C5-2403 | 19 nt | Target #1: | 5'-AAAACAGUUGCAGUUUGCC-3' | (SEQ ID NO: 16135) |

TABLE 10-continued

DsiRNA Component 19 Nucleotide Target Sequences of Human Anti-C5
DsiRNAs Predicted to have >50% Knockdown Efficacy TABLE 10-continued DsiRNA Component 19 Nucleotide Target Sequences of Human Anti-C5
DsiRNAs Predicted to have >50% Knockdown Efficacy

| | | | | |
|---|---|---|---|---|
| C5-2515 | 19 nt | Target #1: | 5'-AAAGAUGUCUUCCUGGAAA-3' | (SEQ ID NO: 16161) |
| C5-2515 | 19 nt | Target #2: | 5'-CAAAGAUGUCUUCCUGGAA-3' | (SEQ ID NO: 18471) |
| C5-2515 | 19 nt | Target #3: | 5'-UCAAAGAUGUCUUCCUGGA-3' | (SEQ ID NO: 20781) |
| C5-2516 | 19 nt | Target #1: | 5'-AAGAUGUCUUCCUGGAAAU-3' | (SEQ ID NO: 16162) |
| C5-2516 | 19 nt | Target #2: | 5'-AAAGAUGUCUUCCUGGAAA-3' | (SEQ ID NO: 18472) |
| C5-2516 | 19 nt | Target #3: | 5'-CAAAGAUGUCUUCCUGGAA-3' | (SEQ ID NO: 20782) |
| C5-2517 | 19 nt | Target #1: | 5'-AGAUGUCUUCCUGGAAAUG-3' | (SEQ ID NO: 16163) |
| C5-2517 | 19 nt | Target #2: | 5'-AAGAUGUCUUCCUGGAAAU-3' | (SEQ ID NO: 18473) |
| C5-2517 | 19 nt | Target #3: | 5'-AAAGAUGUCUUCCUGGAAA-3' | (SEQ ID NO: 20783) |
| C5-2519 | 19 nt | Target #1: | 5'-AUGUCUUCCUGGAAAUGAA-3' | (SEQ ID NO: 16164) |
| C5-2519 | 19 nt | Target #2: | 5'-GAUGUCUUCCUGGAAAUGA-3' | (SEQ ID NO: 18474) |
| C5-2519 | 19 nt | Target #3: | 5'-AGAUGUCUUCCUGGAAAUG-3' | (SEQ ID NO: 20784) |
| C5-2520 | 19 nt | Target #1: | 5'-UGUCUUCCUGGAAAUGAAU-3' | (SEQ ID NO: 16165) |
| C5-2520 | 19 nt | Target #2: | 5'-AUGUCUUCCUGGAAAUGAA-3' | (SEQ ID NO: 18475) |
| C5-2520 | 19 nt | Target #3: | 5'-GAUGUCUUCCUGGAAAUGA-3' | (SEQ ID NO: 20785) |
| C5-2521 | 19 nt | Target #1: | 5'-GUCUUCCUGGAAAUGAAUA-3' | (SEQ ID NO: 16166) |
| C5-2521 | 19 nt | Target #2: | 5'-UGUCUUCCUGGAAAUGAAU-3' | (SEQ ID NO: 18476) |
| C5-2521 | 19 nt | Target #3: | 5'-AUGUCUUCCUGGAAAUGAA-3' | (SEQ ID NO: 20786) |
| C5-2522 | 19 nt | Target #1: | 5'-UCUUCCUGGAAAUGAAUAU-3' | (SEQ ID NO: 16167) |
| C5-2522 | 19 nt | Target #2: | 5'-GUCUUCCUGGAAAUGAAUA-3' | (SEQ ID NO: 18477) |
| C5-2522 | 19 nt | Target #3: | 5'-UGUCUUCCUGGAAAUGAAU-3' | (SEQ ID NO: 20787) |
| C5-2523 | 19 nt | Target #1: | 5'-CUUCCUGGAAAUGAAUAUA-3' | (SEQ ID NO: 16168) |
| C5-2523 | 19 nt | Target #2: | 5'-UCUUCCUGGAAAUGAAUAU-3' | (SEQ ID NO: 18478) |
| C5-2523 | 19 nt | Target #3: | 5'-GUCUUCCUGGAAAUGAAUA-3' | (SEQ ID NO: 20788) |
| C5-2524 | 19 nt | Target #1: | 5'-UUCCUGGAAAUGAAUAUAC-3' | (SEQ ID NO: 16169) |
| C5-2524 | 19 nt | Target #2: | 5'-CUUCCUGGAAAUGAAUAUA-3' | (SEQ ID NO: 18479) |
| C5-2524 | 19 nt | Target #3: | 5'-UCUUCCUGGAAAUGAAUAU-3' | (SEQ ID NO: 20789) |
| C5-2525 | 19 nt | Target #1: | 5'-UCCUGGAAAUGAAUAUACC-3' | (SEQ ID NO: 16170) |
| C5-2525 | 19 nt | Target #2: | 5'-UUCCUGGAAAUGAAUAUAC-3' | (SEQ ID NO: 18480) |
| C5-2525 | 19 nt | Target #3: | 5'-CUUCCUGGAAAUGAAUAUA-3' | (SEQ ID NO: 20790) |
| C5-2526 | 19 nt | Target #1: | 5'-CCUGGAAAUGAAUAUACCA-3' | (SEQ ID NO: 16171) |
| C5-2526 | 19 nt | Target #2: | 5'-UCCUGGAAAUGAAUAUACC-3' | (SEQ ID NO: 18481) |
| C5-2526 | 19 nt | Target #3: | 5'-UUCCUGGAAAUGAAUAUAC-3' | (SEQ ID NO: 20791) |
| C5-2538 | 19 nt | Target #1: | 5'-UAUACCAUAUUCUGUUGUA-3' | (SEQ ID NO: 16172) |
| C5-2538 | 19 nt | Target #2: | 5'-AUAUACCAUAUUCUGUUGU-3' | (SEQ ID NO: 18482) |
| C5-2538 | 19 nt | Target #3: | 5'-AAUAUACCAUAUUCUGUUG-3' | (SEQ ID NO: 20792) |
| C5-2539 | 19 nt | Target #1: | 5'-AUACCAUAUUCUGUUGUAC-3' | (SEQ ID NO: 16173) |
| C5-2539 | 19 nt | Target #2: | 5'-UAUACCAUAUUCUGUUGUA-3' | (SEQ ID NO: 18483) |
| C5-2539 | 19 nt | Target #3: | 5'-AUAUACCAUAUUCUGUUGU-3' | (SEQ ID NO: 20793) |
| C5-2540 | 19 nt | Target #1: | 5'-UACCAUAUUCUGUUGUACG-3' | (SEQ ID NO: 16174) |
| C5-2540 | 19 nt | Target #2: | 5'-AUACCAUAUUCUGUUGUAC-3' | (SEQ ID NO: 18484) |
| C5-2540 | 19 nt | Target #3: | 5'-UAUACCAUAUUCUGUUGUA-3' | (SEQ ID NO: 20794) |
| C5-2541 | 19 nt | Target #1: | 5'-ACCAUAUUCUGUUGUACGA-3' | (SEQ ID NO: 16175) |
| C5-2541 | 19 nt | Target #2: | 5'-UACCAUAUUCUGUUGUACG-3' | (SEQ ID NO: 18485) |
| C5-2541 | 19 nt | Target #3: | 5'-AUACCAUAUUCUGUUGUAC-3' | (SEQ ID NO: 20795) |
| C5-2542 | 19 nt | Target #1: | 5'-CCAUAUUCUGUUGUACGAG-3' | (SEQ ID NO: 16176) |
| C5-2542 | 19 nt | Target #2: | 5'-ACCAUAUUCUGUUGUACGA-3' | (SEQ ID NO: 18486) |
| C5-2542 | 19 nt | Target #3: | 5'-UACCAUAUUCUGUUGUACG-3' | (SEQ ID NO: 20796) |
| C5-2543 | 19 nt | Target #1: | 5'-CAUAUUCUGUUGUACGAGG-3' | (SEQ ID NO: 16177) |
| C5-2543 | 19 nt | Target #2: | 5'-CCAUAUUCUGUUGUACGAG-3' | (SEQ ID NO: 18487) |
| C5-2543 | 19 nt | Target #3: | 5'-ACCAUAUUCUGUUGUACGA-3' | (SEQ ID NO: 20797) |
| C5-2544 | 19 nt | Target #1: | 5'-AUAUUCUGUUGUACGAGGA-3' | (SEQ ID NO: 16178) |
| C5-2544 | 19 nt | Target #2: | 5'-CAUAUUCUGUUGUACGAGG-3' | (SEQ ID NO: 18488) |
| C5-2544 | 19 nt | Target #3: | 5'-CCAUAUUCUGUUGUACGAG-3' | (SEQ ID NO: 20798) |
| C5-2545 | 19 nt | Target #1: | 5'-UAUUCUGUUGUACGAGGAG-3' | (SEQ ID NO: 16179) |
| C5-2545 | 19 nt | Target #2: | 5'-AUAUUCUGUUGUACGAGGA-3' | (SEQ ID NO: 18489) |
| C5-2545 | 19 nt | Target #3: | 5'-CAUAUUCUGUUGUACGAGG-3' | (SEQ ID NO: 20799) |
| C5-2546 | 19 nt | Target #1: | 5'-AUUCUGUUGUACGAGGAGA-3' | (SEQ ID NO: 16180) |
| C5-2546 | 19 nt | Target #2: | 5'-UAUUCUGUUGUACGAGGAG-3' | (SEQ ID NO: 18490) |
| C5-2546 | 19 nt | Target #3: | 5'-AUAUUCUGUUGUACGAGGA-3' | (SEQ ID NO: 20800) |
| C5-2547 | 19 nt | Target #1: | 5'-UUCUGUUGUACGAGGAGAA-3' | (SEQ ID NO: 16181) |
| C5-2547 | 19 nt | Target #2: | 5'-AUUCUGUUGUACGAGGAGA-3' | (SEQ ID NO: 18491) |
| C5-2547 | 19 nt | Target #3: | 5'-UAUUCUGUUGUACGAGGAG-3' | (SEQ ID NO: 20801) |
| C5-2548 | 19 nt | Target #1: | 5'-UCUGUUGUACGAGGAGAAC-3' | (SEQ ID NO: 16182) |
| C5-2548 | 19 nt | Target #2: | 5'-UUCUGUUGUACGAGGAGAA-3' | (SEQ ID NO: 18492) |
| C5-2548 | 19 nt | Target #3: | 5'-AUUCUGUUGUACGAGGAGA-3' | (SEQ ID NO: 20802) |
| C5-2549 | 19 nt | Target #1: | 5'-CUGUUGUACGAGGAGAACA-3' | (SEQ ID NO: 16183) |
| C5-2549 | 19 nt | Target #2: | 5'-UCUGUUGUACGAGGAGAAC-3' | (SEQ ID NO: 18493) |
| C5-2549 | 19 nt | Target #3: | 5'-UUCUGUUGUACGAGGAGAA-3' | (SEQ ID NO: 20803) |
| C5-2550 | 19 nt | Target #1: | 5'-UGUUGUACGAGGAGAACAG-3' | (SEQ ID NO: 16184) |
| C5-2550 | 19 nt | Target #2: | 5'-CUGUUGUACGAGGAGAACA-3' | (SEQ ID NO: 18494) |
| C5-2550 | 19 nt | Target #3: | 5'-UCUGUUGUACGAGGAGAAC-3' | (SEQ ID NO: 20804) |
| C5-2582 | 19 nt | Target #1: | 5'-GAACUGUUUACAACUAUAG-3' | (SEQ ID NO: 16185) |
| C5-2582 | 19 nt | Target #2: | 5'-GGAACUGUUUACAACUAUA-3' | (SEQ ID NO: 18495) |
| C5-2582 | 19 nt | Target #3: | 5'-AGGAACUGUUUACAACUAU-3' | (SEQ ID NO: 20805) |
| C5-2583 | 19 nt | Target #1: | 5'-AACUGUUUACAACUAUAGG-3' | (SEQ ID NO: 16186) |
| C5-2583 | 19 nt | Target #2: | 5'-GAACUGUUUACAACUAUAG-3' | (SEQ ID NO: 18496) |

TABLE 10-continued

| DsiRNA Component 19 Nucleotide Target Sequences of Human Anti-C5 DsiRNAs Predicted to have >50% Knockdown Efficacy | | | | |
|---|---|---|---|---|
| C5-2583 | 19 nt | Target #3: | 5'-GGAACUGUUUACAACUAUA-3' | (SEQ ID NO: 20806) |
| C5-2584 | 19 nt | Target #1: | 5'-ACUGUUUACAACUAUAGGA-3' | (SEQ ID NO: 16187) |
| C5-2584 | 19 nt | Target #2: | 5'-AACUGUUUACAACUAUAGG-3' | (SEQ ID NO: 18497) |
| C5-2584 | 19 nt | Target #3: | 5'-GAACUGUUUACAACUAUAG-3' | (SEQ ID NO: 20807) |
| C5-2585 | 19 nt | Target #1: | 5'-CUGUUUACAACUAUAGGAC-3' | (SEQ ID NO: 16188) |
| C5-2585 | 19 nt | Target #2: | 5'-ACUGUUUACAACUAUAGGA-3' | (SEQ ID NO: 18498) |
| C5-2585 | 19 nt | Target #3: | 5'-AACUGUUUACAACUAUAGG-3' | (SEQ ID NO: 20808) |
| C5-2586 | 19 nt | Target #1: | 5'-UGUUUACAACUAUAGGACU-3' | (SEQ ID NO: 16189) |
| C5-2586 | 19 nt | Target #2: | 5'-CUGUUUACAACUAUAGGAC-3' | (SEQ ID NO: 18499) |
| C5-2586 | 19 nt | Target #3: | 5'-ACUGUUUACAACUAUAGGA-3' | (SEQ ID NO: 20809) |
| C5-2587 | 19 nt | Target #1: | 5'-GUUUACAACUAUAGGACUU-3' | (SEQ ID NO: 16190) |
| C5-2587 | 19 nt | Target #2: | 5'-UGUUUACAACUAUAGGACU-3' | (SEQ ID NO: 18500) |
| C5-2587 | 19 nt | Target #3: | 5'-CUGUUUACAACUAUAGGAC-3' | (SEQ ID NO: 20810) |
| C5-2588 | 19 nt | Target #1: | 5'-UUUACAACUAUAGGACUUC-3' | (SEQ ID NO: 16191) |
| C5-2588 | 19 nt | Target #2: | 5'-GUUUACAACUAUAGGACUU-3' | (SEQ ID NO: 18501) |
| C5-2588 | 19 nt | Target #3: | 5'-UGUUUACAACUAUAGGACU-3' | (SEQ ID NO: 20811) |
| C5-2589 | 19 nt | Target #1: | 5'-UUACAACUAUAGGACUUCU-3' | (SEQ ID NO: 16192) |
| C5-2589 | 19 nt | Target #2: | 5'-UUUACAACUAUAGGACUUC-3' | (SEQ ID NO: 18502) |
| C5-2589 | 19 nt | Target #3: | 5'-GUUUACAACUAUAGGACUU-3' | (SEQ ID NO: 20812) |
| C5-2590 | 19 nt | Target #1: | 5'-UACAACUAUAGGACUUCUG-3' | (SEQ ID NO: 16193) |
| C5-2590 | 19 nt | Target #2: | 5'-UUACAACUAUAGGACUUCU-3' | (SEQ ID NO: 18503) |
| C5-2590 | 19 nt | Target #3: | 5'-UUUACAACUAUAGGACUUC-3' | (SEQ ID NO: 20813) |
| C5-2591 | 19 nt | Target #1: | 5'-ACAACUAUAGGACUUCUGG-3' | (SEQ ID NO: 16194) |
| C5-2591 | 19 nt | Target #2: | 5'-UACAACUAUAGGACUUCUG-3' | (SEQ ID NO: 18504) |
| C5-2591 | 19 nt | Target #3: | 5'-UUACAACUAUAGGACUUCU-3' | (SEQ ID NO: 20814) |
| C5-2592 | 19 nt | Target #1: | 5'-CAACUAUAGGACUUCUGGG-3' | (SEQ ID NO: 16195) |
| C5-2592 | 19 nt | Target #2: | 5'-ACAACUAUAGGACUUCUGG-3' | (SEQ ID NO: 18505) |
| C5-2592 | 19 nt | Target #3: | 5'-UACAACUAUAGGACUUCUG-3' | (SEQ ID NO: 20815) |
| C5-2593 | 19 nt | Target #1: | 5'-AACUAUAGGACUUCUGGGA-3' | (SEQ ID NO: 16196) |
| C5-2593 | 19 nt | Target #2: | 5'-CAACUAUAGGACUUCUGGG-3' | (SEQ ID NO: 18506) |
| C5-2593 | 19 nt | Target #3: | 5'-ACAACUAUAGGACUUCUGG-3' | (SEQ ID NO: 20816) |
| C5-2594 | 19 nt | Target #1: | 5'-ACUAUAGGACUUCUGGGAU-3' | (SEQ ID NO: 16197) |
| C5-2594 | 19 nt | Target #2: | 5'-AACUAUAGGACUUCUGGGA-3' | (SEQ ID NO: 18507) |
| C5-2594 | 19 nt | Target #3: | 5'-CAACUAUAGGACUUCUGGG-3' | (SEQ ID NO: 20817) |
| C5-2595 | 19 nt | Target #1: | 5'-CUAUAGGACUUCUGGGAUG-3' | (SEQ ID NO: 16198) |
| C5-2595 | 19 nt | Target #2: | 5'-ACUAUAGGACUUCUGGGAU-3' | (SEQ ID NO: 18508) |
| C5-2595 | 19 nt | Target #3: | 5'-AACUAUAGGACUUCUGGGA-3' | (SEQ ID NO: 20818) |
| C5-2596 | 19 nt | Target #1: | 5'-UAUAGGACUUCUGGGAUGC-3' | (SEQ ID NO: 16199) |
| C5-2596 | 19 nt | Target #2: | 5'-CUAUAGGACUUCUGGGAUG-3' | (SEQ ID NO: 18509) |
| C5-2596 | 19 nt | Target #3: | 5'-ACUAUAGGACUUCUGGGAU-3' | (SEQ ID NO: 20819) |
| C5-2597 | 19 nt | Target #1: | 5'-AUAGGACUUCUGGGAUGCA-3' | (SEQ ID NO: 16200) |
| C5-2597 | 19 nt | Target #2: | 5'-UAUAGGACUUCUGGGAUGC-3' | (SEQ ID NO: 18510) |
| C5-2597 | 19 nt | Target #3: | 5'-CUAUAGGACUUCUGGGAUG-3' | (SEQ ID NO: 20820) |
| C5-2598 | 19 nt | Target #1: | 5'-UAGGACUUCUGGGAUGCAG-3' | (SEQ ID NO: 16201) |
| C5-2598 | 19 nt | Target #2: | 5'-AUAGGACUUCUGGGAUGCA-3' | (SEQ ID NO: 18511) |
| C5-2598 | 19 nt | Target #3: | 5'-UAUAGGACUUCUGGGAUGC-3' | (SEQ ID NO: 20821) |
| C5-2599 | 19 nt | Target #1: | 5'-AGGACUUCUGGGAUCGAGU-3' | (SEQ ID NO: 16202) |
| C5-2599 | 19 nt | Target #2: | 5'-UAGGACUUCUGGGAUCGAG-3' | (SEQ ID NO: 18512) |
| C5-2599 | 19 nt | Target #3: | 5'-AUAGGACUUCUGGGAUCGA-3' | (SEQ ID NO: 20822) |
| C5-2628 | 19 nt | Target #1: | 5'-AAUGUCUGCUGUGGAGGGA-3' | (SEQ ID NO: 16203) |
| C5-2628 | 19 nt | Target #2: | 5'-AAAUGUCUGCUGUGGAGGG-3' | (SEQ ID NO: 18513) |
| C5-2628 | 19 nt | Target #3: | 5'-AAAAUGUCUGCUGUGGAGG-3' | (SEQ ID NO: 20823) |
| C5-2629 | 19 nt | Target #1: | 5'-AUGUCUGCUGUGGAGGGAA-3' | (SEQ ID NO: 16204) |
| C5-2629 | 19 nt | Target #2: | 5'-AAUGUCUGCUGUGGAGGGA-3' | (SEQ ID NO: 18514) |
| C5-2629 | 19 nt | Target #3: | 5'-AAAUGUCUGCUGUGGAGGG-3' | (SEQ ID NO: 20824) |
| C5-2630 | 19 nt | Target #1: | 5'-UGUCUGCUGUGGAGGGAAU-3' | (SEQ ID NO: 16205) |
| C5-2630 | 19 nt | Target #2: | 5'-AUGUCUGCUGUGGAGGGAA-3' | (SEQ ID NO: 18515) |
| C5-2630 | 19 nt | Target #3: | 5'-AAUGUCUGCUGUGGAGGGA-3' | (SEQ ID NO: 20825) |
| C5-2631 | 19 nt | Target #1: | 5'-GUCUGCUGUGGAGGGAAUC-3' | (SEQ ID NO: 16206) |
| C5-2631 | 19 nt | Target #2: | 5'-UGUCUGCUGUGGAGGGAAU-3' | (SEQ ID NO: 18516) |
| C5-2631 | 19 nt | Target #3: | 5'-AUGUCUGCUGUGGAGGGAA-3' | (SEQ ID NO: 20826) |
| C5-2632 | 19 nt | Target #1: | 5'-UCUGCUGUGGAGGGAAUCU-3' | (SEQ ID NO: 16207) |
| C5-2632 | 19 nt | Target #2: | 5'-GUCUGCUGUGGAGGGAAUC-3' | (SEQ ID NO: 18517) |
| C5-2632 | 19 nt | Target #3: | 5'-UGUCUGCUGUGGAGGGAAU-3' | (SEQ ID NO: 20827) |
| C5-2633 | 19 nt | Target #1: | 5'-CUGCUGUGGAGGGAAUCUG-3' | (SEQ ID NO: 16208) |
| C5-2633 | 19 nt | Target #2: | 5'-UCUGCUGUGGAGGGAAUCU-3' | (SEQ ID NO: 18518) |
| C5-2633 | 19 nt | Target #3: | 5'-GUCUGCUGUGGAGGGAAUC-3' | (SEQ ID NO: 20828) |
| C5-2634 | 19 nt | Target #1: | 5'-UGCUGUGGAGGGAAUCUGC-3' | (SEQ ID NO: 16209) |
| C5-2634 | 19 nt | Target #2: | 5'-CUGCUGUGGAGGGAAUCUG-3' | (SEQ ID NO: 18519) |
| C5-2634 | 19 nt | Target #3: | 5'-UCUGCUGUGGAGGGAAUCU-3' | (SEQ ID NO: 20829) |
| C5-2635 | 19 nt | Target #1: | 5'-GCUGUGGAGGGAAUCUGCA-3' | (SEQ ID NO: 16210) |
| C5-2635 | 19 nt | Target #2: | 5'-UGCUGUGGAGGGAAUCUGC-3' | (SEQ ID NO: 18520) |
| C5-2635 | 19 nt | Target #3: | 5'-CUGCUGUGGAGGGAAUCUG-3' | (SEQ ID NO: 20830) |
| C5-2636 | 19 nt | Target #1: | 5'-CUGUGGAGGGAAUCUGCAC-3' | (SEQ ID NO: 16211) |
| C5-2636 | 19 nt | Target #2: | 5'-GCUGUGGAGGGAAUCUGCA-3' | (SEQ ID NO: 18521) |
| C5-2636 | 19 nt | Target #3: | 5'-UGCUGUGGAGGGAAUCUGC-3' | (SEQ ID NO: 20831) |
| C5-2637 | 19 nt | Target #1: | 5'-UGUGGAGGGAAUCUGCACU-3' | (SEQ ID NO: 16212) |

TABLE 10-continued

DsiRNA Component 19 Nucleotide Target Sequences of Human Anti-C5
DsiRNAs Predicted to have >50% Knockdown Efficacy

| | | | | |
|---|---|---|---|---|
| C5-2637 | 19 nt | Target #2: | 5'-CUGUGGAGGGAAUCUGCAC-3' | (SEQ ID NO: 18522) |
| C5-2637 | 19 nt | Target #3: | 5'-GCUGUGGAGGGAAUCUGCA-3' | (SEQ ID NO: 20832) |
| C5-2638 | 19 nt | Target #1: | 5'-GUGGAGGGAAUCUGCACUU-3' | (SEQ ID NO: 16213) |
| C5-2638 | 19 nt | Target #2: | 5'-UGUGGAGGGAAUCUGCACU-3' | (SEQ ID NO: 18523) |
| C5-2638 | 19 nt | Target #3: | 5'-CUGUGGAGGGAAUCUGCAC-3' | (SEQ ID NO: 20833) |
| C5-2639 | 19 nt | Target #1: | 5'-UGGAGGGAAUCUGCACUUC-3' | (SEQ ID NO: 16214) |
| C5-2639 | 19 nt | Target #2: | 5'-GUGGAGGGAAUCUGCACUU-3' | (SEQ ID NO: 18524) |
| C5-2639 | 19 nt | Target #3: | 5'-UGUGGAGGGAAUCUGCACU-3' | (SEQ ID NO: 20834) |
| C5-2659 | 19 nt | Target #1: | 5'-GAAAGCCCAGUCAUUGAUC-3' | (SEQ ID NO: 16215) |
| C5-2659 | 19 nt | Target #2: | 5'-GGAAAGCCCAGUCAUUGAU-3' | (SEQ ID NO: 18525) |
| C5-2659 | 19 nt | Target #3: | 5'-CGGAAAGCCCAGUCAUUGA-3' | (SEQ ID NO: 20835) |
| C5-2660 | 19 nt | Target #1: | 5'-AAAGCCCAGUCAUUGAUCA-3' | (SEQ ID NO: 16216) |
| C5-2660 | 19 nt | Target #2: | 5'-GAAAGCCCAGUCAUUGAUC-3' | (SEQ ID NO: 18526) |
| C5-2660 | 19 nt | Target #3: | 5'-GGAAAGCCCAGUCAUUGAU-3' | (SEQ ID NO: 20836) |
| C5-2661 | 19 nt | Target #1: | 5'-AAGCCCAGUCAUUGAUCAU-3' | (SEQ ID NO: 16217) |
| C5-2661 | 19 nt | Target #2: | 5'-AAAGCCCAGUCAUUGAUCA-3' | (SEQ ID NO: 18527) |
| C5-2661 | 19 nt | Target #3: | 5'-GAAAGCCCAGUCAUUGAUC-3' | (SEQ ID NO: 20837) |
| C5-2662 | 19 nt | Target #1: | 5'-AGCCCAGUCAUUGAUCAUC-3' | (SEQ ID NO: 16218) |
| C5-2662 | 19 nt | Target #2: | 5'-AAGCCCAGUCAUUGAUCAU-3' | (SEQ ID NO: 18528) |
| C5-2662 | 19 nt | Target #3: | 5'-AAAGCCCAGUCAUUGAUCA-3' | (SEQ ID NO: 20838) |
| C5-2663 | 19 nt | Target #1: | 5'-GCCCAGUCAUUGAUCAUCA-3' | (SEQ ID NO: 16219) |
| C5-2663 | 19 nt | Target #2: | 5'-AGCCCAGUCAUUGAUCAUC-3' | (SEQ ID NO: 18529) |
| C5-2663 | 19 nt | Target #3: | 5'-AAGCCCAGUCAUUGAUCAU-3' | (SEQ ID NO: 20839) |
| C5-2664 | 19 nt | Target #1: | 5'-CCCAGUCAUUGAUCAUCAG-3' | (SEQ ID NO: 16220) |
| C5-2664 | 19 nt | Target #2: | 5'-GCCCAGUCAUUGAUCAUCA-3' | (SEQ ID NO: 18530) |
| C5-2664 | 19 nt | Target #2: | 5'-AGCCCAGUCAUUGAUCAUC-3' | (SEQ ID NO: 20840) |
| C5-2665 | 19 nt | Target #1: | 5'-CCAGUCAUUGAUCAUCAGG-3' | (SEQ ID NO: 16221) |
| C5-2665 | 19 nt | Target #2: | 5'-CCCAGUCAUUGAUCAUCAG-3' | (SEQ ID NO: 18531) |
| C5-2665 | 19 nt | Target #3: | 5'-GCCCAGUCAUUGAUCAUCA-3' | (SEQ ID NO: 20841) |
| C5-2666 | 19 nt | Target #1: | 5'-CAGUCAUUGAUCAUCAGGG-3' | (SEQ ID NO: 16222) |
| C5-2666 | 19 nt | Target #2: | 5'-CCAGUCAUUGAUCAUCAGG-3' | (SEQ ID NO: 18532) |
| C5-2666 | 19 nt | Target #3: | 5'-CCCAGUCAUUGAUCAUCAG-3' | (SEQ ID NO: 20842) |
| C5-2667 | 19 nt | Target #1: | 5'-AGUCAUUGAUCAUCAGGGC-3' | (SEQ ID NO: 16223) |
| C5-2667 | 19 nt | Target #2: | 5'-CAGUCAUUGAUCAUCAGGG-3' | (SEQ ID NO: 18533) |
| C5-2667 | 19 nt | Target #3: | 5'-CCAGUCAUUGAUCAUCAGG-3' | (SEQ ID NO: 20843) |
| C5-2668 | 19 nt | Target #1: | 5'-GUCAUUGAUCAUCAGGGCA-3' | (SEQ ID NO: 16224) |
| C5-2668 | 19 nt | Target #2: | 5'-AGUCAUUGAUCAUCAGGGC-3' | (SEQ ID NO: 18534) |
| C5-2668 | 19 nt | Target #3: | 5'-CAGUCAUUGAUCAUCAGGG-3' | (SEQ ID NO: 20844) |
| C5-2669 | 19 nt | Target #1: | 5'-UCAUUGAUCAUCAGGGCAC-3' | (SEQ ID NO: 16225) |
| C5-2669 | 19 nt | Target #2: | 5'-GUCAUUGAUCAUCAGGGCA-3' | (SEQ ID NO: 18535) |
| C5-2669 | 19 nt | Target #3: | 5'-AGUCAUUGAUCAUCAGGGC-3' | (SEQ ID NO: 20845) |
| C5-2670 | 19 nt | Target #1: | 5'-CAUUGAUCAUCAGGGCACA-3' | (SEQ ID NO: 16226) |
| C5-2670 | 19 nt | Target #2: | 5'-UCAUUGAUCAUCAGGGCAC-3' | (SEQ ID NO: 18536) |
| C5-2670 | 19 nt | Target #3: | 5'-GUCAUUGAUCAUCAGGGCA-3' | (SEQ ID NO: 20846) |
| C5-2671 | 19 nt | Target #1: | 5'-AUUGAUCAUCAGGGCACAA-3' | (SEQ ID NO: 16227) |
| C5-2671 | 19 nt | Target #2: | 5'-CAUUGAUCAUCAGGGCACA-3' | (SEQ ID NO: 18537) |
| C5-2671 | 19 nt | Target #3: | 5'-UCAUUGAUCAUCAGGGCAC-3' | (SEQ ID NO: 20847) |
| C5-2672 | 19 nt | Target #1: | 5'-UUGAUCAUCAGGGCACAAA-3' | (SEQ ID NO: 16228) |
| C5-2672 | 19 nt | Target #2: | 5'-AUUGAUCAUCAGGGCACAA-3' | (SEQ ID NO: 18538) |
| C5-2672 | 19 nt | Target #3: | 5'-CAUUGAUCAUCAGGGCACA-3' | (SEQ ID NO: 20848) |
| C5-2673 | 19 nt | Target #1: | 5'-UGAUCAUCAGGGCACAAAG-3' | (SEQ ID NO: 16229) |
| C5-2673 | 19 nt | Target #2: | 5'-UUGAUCAUCAGGGCACAAA-3' | (SEQ ID NO: 18539) |
| C5-2673 | 19 nt | Target #3: | 5'-AUUGAUCAUCAGGGCACAA-3' | (SEQ ID NO: 20849) |
| C5-2674 | 19 nt | Target #1: | 5'-GAUCAUCAGGGCACAAAGU-3' | (SEQ ID NO: 16230) |
| C5-2674 | 19 nt | Target #2: | 5'-UGAUCAUCAGGGCACAAAG-3' | (SEQ ID NO: 18540) |
| C5-2674 | 19 nt | Target #3: | 5'-UUGAUCAUCAGGGCACAAA-3' | (SEQ ID NO: 20850) |
| C5-2675 | 19 nt | Target #1: | 5'-AUCAUCAGGGCACAAAGUC-3' | (SEQ ID NO: 16231) |
| C5-2675 | 19 nt | Target #2: | 5'-GAUCAUCAGGGCACAAAGU-3' | (SEQ ID NO: 18541) |
| C5-2675 | 19 nt | Target #3: | 5'-UGAUCAUCAGGGCACAAAG-3' | (SEQ ID NO: 20851) |
| C5-2676 | 19 nt | Target #1: | 5'-UCAUCAGGGCACAAAGUCC-3' | (SEQ ID NO: 16232) |
| C5-2676 | 19 nt | Target #2: | 5'-AUCAUCAGGGCACAAAGUC-3' | (SEQ ID NO: 18542) |
| C5-2676 | 19 nt | Target #3: | 5'-GAUCAUCAGGGCACAAAGU-3' | (SEQ ID NO: 20852) |
| C5-2677 | 19 nt | Target #1: | 5'-CAUCAGGGCACAAAGUCCU-3' | (SEQ ID NO: 16233) |
| C5-2677 | 19 nt | Target #2: | 5'-UCAUCAGGGCACAAAGUCC-3' | (SEQ ID NO: 18543) |
| C5-2677 | 19 nt | Target #3: | 5'-AUCAUCAGGGCACAAAGUC-3' | (SEQ ID NO: 20853) |
| C5-2678 | 19 nt | Target #1: | 5'-AUCAGGGCACAAAGUCCUC-3' | (SEQ ID NO: 16234) |
| C5-2678 | 19 nt | Target #2: | 5'-CAUCAGGGCACAAAGUCCU-3' | (SEQ ID NO: 18544) |
| C5-2678 | 19 nt | Target #3: | 5'-UCAUCAGGGCACAAAGUCC-3' | (SEQ ID NO: 20854) |
| C5-2679 | 19 nt | Target #1: | 5'-UCAGGGCACAAAGUCCUCC-3' | (SEQ ID NO: 16235) |
| C5-2679 | 19 nt | Target #2: | 5'-AUCAGGGCACAAAGUCCUC-3' | (SEQ ID NO: 18545) |
| C5-2679 | 19 nt | Target #3: | 5'-CAUCAGGGCACAAAGUCCU-3' | (SEQ ID NO: 20855) |
| C5-2680 | 19 nt | Target #1: | 5'-CAGGGCACAAAGUCCUCCA-3' | (SEQ ID NO: 16236) |
| C5-2680 | 19 nt | Target #2: | 5'-UCAGGGCACAAAGUCCUCC-3' | (SEQ ID NO: 18546) |
| C5-2680 | 19 nt | Target #3: | 5'-AUCAGGGCACAAAGUCCUC-3' | (SEQ ID NO: 20856) |
| C5-2711 | 19 nt | Target #1: | 5'-AGAAAGUAGAGGGCUCCUC-3' | (SEQ ID NO: 16237) |
| C5-2711 | 19 nt | Target #2: | 5'-CAGAAAGUAGAGGGCUCCU-3' | (SEQ ID NO: 18547) |
| C5-2711 | 19 nt | Target #3: | 5'-CCAGAAAGUAGAGGGCUCC-3' | (SEQ ID NO: 20857) |

TABLE 10-continued

DsiRNA Component 19 Nucleotide Target Sequences of Human Anti-C5
DsiRNAs Predicted to have >50% Knockdown Efficacy TABLE 10-continued DsiRNA Component 19 Nucleotide Target Sequences of Human Anti-C5
DsiRNAs Predicted to have >50% Knockdown Efficacy

```
C5-2847  19 nt  Target #3:  5'-CCAGAAGGUGUCAAAAGGG-3'  (SEQ ID NO: 20883)
C5-2848  19 nt  Target #1:  5'-GAAGGUGUCAAAAGGGAAA-3'  (SEQ ID NO: 16264)
C5-2848  19 nt  Target #2:  5'-AGAAGGUGUCAAAAGGGAA-3'  (SEQ ID NO: 18574)
C5-2848  19 nt  Target #3:  5'-CAGAAGGUGUCAAAAGGGA-3'  (SEQ ID NO: 20884)
C5-2849  19 nt  Target #1:  5'-AAGGUGUCAAAAGGGAAAG-3'  (SEQ ID NO: 16265)
C5-2849  19 nt  Target #2:  5'-GAAGGUGUCAAAAGGGAAA-3'  (SEQ ID NO: 18575)
C5-2849  19 nt  Target #3:  5'-AGAAGGUGUCAAAAGGGAA-3'  (SEQ ID NO: 20885)
C5-2850  19 nt  Target #1:  5'-AGGUGUCAAAAGGGAAAGC-3'  (SEQ ID NO: 16266)
C5-2850  19 nt  Target #2:  5'-AAGGUGUCAAAAGGGAAAG-3'  (SEQ ID NO: 18576)
C5-2850  19 nt  Target #3:  5'-GAAGGUGUCAAAAGGGAAA-3'  (SEQ ID NO: 20886)
C5-2851  19 nt  Target #1:  5'-GGUGUCAAAAGGGAAAGCU-3'  (SEQ ID NO: 16267)
C5-2851  19 nt  Target #2:  5'-AGGUGUCAAAAGGGAAAGC-3'  (SEQ ID NO: 18577)
C5-2851  19 nt  Target #3:  5'-AAGGUGUCAAAAGGGAAAG-3'  (SEQ ID NO: 20887)
C5-2852  19 nt  Target #1:  5'-GUGUCAAAAGGGAAAGCUA-3'  (SEQ ID NO: 16268)
C5-2852  19 nt  Target #2:  5'-GGUGUCAAAAGGGAAAGCU-3'  (SEQ ID NO: 18578)
C5-2852  19 nt  Target #3:  5'-AGGUGUCAAAAGGGAAAGC-3'  (SEQ ID NO: 20888)
C5-2853  19 nt  Target #1:  5'-UGUCAAAAGGGAAAGCUAU-3'  (SEQ ID NO: 16269)
C5-2853  19 nt  Target #2:  5'-GUGUCAAAAGGGAAAGCUA-3'  (SEQ ID NO: 18579)
C5-2853  19 nt  Target #3:  5'-GGUGUCAAAAGGGAAAGCU-3'  (SEQ ID NO: 20889)
C5-2854  19 nt  Target #1:  5'-GUCAAAAGGGAAAGCUAUU-3'  (SEQ ID NO: 16270)
C5-2854  19 nt  Target #2:  5'-UGUCAAAAGGGAAAGCUAU-3'  (SEQ ID NO: 18580)
C5-2854  19 nt  Target #3:  5'-GUGUCAAAAGGGAAAGCUA-3'  (SEQ ID NO: 20890)
C5-2855  19 nt  Target #1:  5'-UCAAAAGGGAAAGCUAUUC-3'  (SEQ ID NO: 16271)
C5-2855  19 nt  Target #2:  5'-GUCAAAAGGGAAAGCUAUU-3'  (SEQ ID NO: 18581)
C5-2855  19 nt  Target #3:  5'-UGUCAAAAGGGAAAGCUAU-3'  (SEQ ID NO: 20891)
C5-2856  19 nt  Target #1:  5'-CAAAAGGGAAAGCUAUUCU-3'  (SEQ ID NO: 16272)
C5-2856  19 nt  Target #2:  5'-UCAAAAGGGAAAGCUAUUC-3'  (SEQ ID NO: 18582)
C5-2856  19 nt  Target #3:  5'-GUCAAAAGGGAAAGCUAUU-3'  (SEQ ID NO: 20892)
C5-2857  19 nt  Target #1:  5'-AAAAGGGAAAGCUAUUCUG-3'  (SEQ ID NO: 16273)
C5-2857  19 nt  Target #2:  5'-CAAAAGGGAAAGCUAUUCU-3'  (SEQ ID NO: 18583)
C5-2857  19 nt  Target #3:  5'-UCAAAAGGGAAAGCUAUUC-3'  (SEQ ID NO: 20893)
C5-2858  19 nt  Target #1:  5'-AAAGGGAAAGCUAUUCUGG-3'  (SEQ ID NO: 16274)
C5-2858  19 nt  Target #2:  5'-AAAAGGGAAAGCUAUUCUG-3'  (SEQ ID NO: 18584)
C5-2858  19 nt  Target #3:  5'-CAAAAGGGAAAGCUAUUCU-3'  (SEQ ID NO: 20894)
C5-2859  19 nt  Target #1:  5'-AAGGGAAAGCUAUUCUGGU-3'  (SEQ ID NO: 16275)
C5-2859  19 nt  Target #2:  5'-AAAGGGAAAGCUAUUCUGG-3'  (SEQ ID NO: 18585)
C5-2859  19 nt  Target #3:  5'-AAAAGGGAAAGCUAUUCUG-3'  (SEQ ID NO: 20895)
C5-2879  19 nt  Target #1:  5'-UUACUUUGGAUCCUAGGGG-3'  (SEQ ID NO: 16276)
C5-2879  19 nt  Target #2:  5'-GUUACUUUGGAUCCUAGGG-3'  (SEQ ID NO: 18586)
C5-2879  19 nt  Target #3:  5'-UGUUACUUUGGAUCCUAGG-3'  (SEQ ID NO: 20896)
C5-2880  19 nt  Target #1:  5'-UACUUUGGAUCCUAGGGGU-3'  (SEQ ID NO: 16277)
C5-2880  19 nt  Target #2:  5'-UUACUUUGGAUCCUAGGGG-3'  (SEQ ID NO: 18587)
C5-2880  19 nt  Target #3:  5'-GUUACUUUGGAUCCUAGGG-3'  (SEQ ID NO: 20897)
C5-2881  19 nt  Target #1:  5'-ACUUUGGAUCCUAGGGGUA-3'  (SEQ ID NO: 16278)
C5-2881  19 nt  Target #2:  5'-UACUUUGGAUCCUAGGGGU-3'  (SEQ ID NO: 18588)
C5-2881  19 nt  Target #3:  5'-UUACUUUGGAUCCUAGGGG-3'  (SEQ ID NO: 20898)
C5-2882  19 nt  Target #1:  5'-CUUUGGAUCCUAGGGGUAU-3'  (SEQ ID NO: 16279)
C5-2882  19 nt  Target #2:  5'-ACUUUGGAUCCUAGGGGUA-3'  (SEQ ID NO: 18589)
C5-2882  19 nt  Target #3:  5'-UACUUUGGAUCCUAGGGGU-3'  (SEQ ID NO: 20899)
C5-2883  19 nt  Target #1:  5'-UUUGGAUCCUAGGGGUAUU-3'  (SEQ ID NO: 16280)
C5-2883  19 nt  Target #2:  5'-CUUUGGAUCCUAGGGGUAU-3'  (SEQ ID NO: 18590)
C5-2883  19 nt  Target #3:  5'-ACUUUGGAUCCUAGGGGUA-3'  (SEQ ID NO: 20900)
C5-2884  19 nt  Target #1:  5'-UUGGAUCCUAGGGGUAUUU-3'  (SEQ ID NO: 16281)
C5-2884  19 nt  Target #2:  5'-UUUGGAUCCUAGGGGUAUU-3'  (SEQ ID NO: 18591)
C5-2884  19 nt  Target #3:  5'-CUUUGGAUCCUAGGGGUAU-3'  (SEQ ID NO: 20901)
C5-2885  19 nt  Target #1:  5'-UGGAUCCUAGGGGUAUUUA-3'  (SEQ ID NO: 16282)
C5-2885  19 nt  Target #2:  5'-UUGGAUCCUAGGGGUAUUU-3'  (SEQ ID NO: 18592)
C5-2885  19 nt  Target #3:  5'-UUUGGAUCCUAGGGGUAUU-3'  (SEQ ID NO: 20902)
C5-2886  19 nt  Target #1:  5'-GGAUCCUAGGGGUAUUUAU-3'  (SEQ ID NO: 16283)
C5-2886  19 nt  Target #2:  5'-UGGAUCCUAGGGGUAUUUA-3'  (SEQ ID NO: 18593)
C5-2886  19 nt  Target #3:  5'-UUGGAUCCUAGGGGUAUUU-3'  (SEQ ID NO: 20903)
C5-2887  19 nt  Target #1:  5'-GAUCCUAGGGGUAUUUAUG-3'  (SEQ ID NO: 16284)
C5-2887  19 nt  Target #2:  5'-GGAUCCUAGGGGUAUUUAU-3'  (SEQ ID NO: 18594)
C5-2887  19 nt  Target #3:  5'-UGGAUCCUAGGGGUAUUUA-3'  (SEQ ID NO: 20904)
C5-2920  19 nt  Target #1:  5'-CGAAAGGAGUUCCCAUACA-3'  (SEQ ID NO: 16285)
C5-2920  19 nt  Target #2:  5'-ACGAAAGGAGUUCCCAUAC-3'  (SEQ ID NO: 18595)
C5-2920  19 nt  Target #3:  5'-GACGAAAGGAGUUCCCAUA-3'  (SEQ ID NO: 20905)
C5-2921  19 nt  Target #1:  5'-GAAAGGAGUUCCCAUACAG-3'  (SEQ ID NO: 16286)
C5-2921  19 nt  Target #2:  5'-CGAAAGGAGUUCCCAUACA-3'  (SEQ ID NO: 18596)
C5-2921  19 nt  Target #3:  5'-ACGAAAGGAGUUCCCAUAC-3'  (SEQ ID NO: 20906)
C5-2922  19 nt  Target #1:  5'-AAAGGAGUUCCCAUACAGG-3'  (SEQ ID NO: 16287)
C5-2922  19 nt  Target #2:  5'-GAAAGGAGUUCCCAUACAG-3'  (SEQ ID NO: 18597)
C5-2922  19 nt  Target #3:  5'-CGAAAGGAGUUCCCAUACA-3'  (SEQ ID NO: 20907)
C5-2923  19 nt  Target #1:  5'-AAGGAGUUCCCAUACAGGA-3'  (SEQ ID NO: 16288)
C5-2923  19 nt  Target #2:  5'-AAAGGAGUUCCCAUACAGG-3'  (SEQ ID NO: 18598)
C5-2923  19 nt  Target #3:  5'-GAAAGGAGUUCCCAUACAG-3'  (SEQ ID NO: 20908)
C5-2924  19 nt  Target #1:  5'-AGGAGUUCCCAUACAGGAU-3'  (SEQ ID NO: 16289)
```

TABLE 10-continued

DsiRNA Component 19 Nucleotide Target Sequences of Human Anti-C5
DsiRNAs Predicted to have >50% Knockdown Efficacy

| | | | | |
|---|---|---|---|---|
| C5-2924 | 19 nt | Target #2: | 5'-AAGGAGUUCCCAUACAGGA-3' | (SEQ ID NO: 18599) |
| C5-2924 | 19 nt | Target #3: | 5'-AAAGGAGUUCCCAUACAGG-3' | (SEQ ID NO: 20909) |
| C5-2925 | 19 nt | Target #1: | 5'-GGAGUUCCCAUACAGGAUA-3' | (SEQ ID NO: 16290) |
| C5-2925 | 19 nt | Target #2: | 5'-AGGAGUUCCCAUACAGGAU-3' | (SEQ ID NO: 18600) |
| C5-2925 | 19 nt | Target #3: | 5'-AAGGAGUUCCCAUACAGGA-3' | (SEQ ID NO: 20910) |
| C5-2926 | 19 nt | Target #1: | 5'-GAGUUCCCAUACAGGAUAC-3' | (SEQ ID NO: 16291) |
| C5-2926 | 19 nt | Target #2: | 5'-GGAGUUCCCAUACAGGAUA-3' | (SEQ ID NO: 18601) |
| C5-2926 | 19 nt | Target #3: | 5'-AGGAGUUCCCAUACAGGAU-3' | (SEQ ID NO: 20911) |
| C5-2927 | 19 nt | Target #1: | 5'-AGUUCCCAUACAGGAUACC-3' | (SEQ ID NO: 16292) |
| C5-2927 | 19 nt | Target #2: | 5'-GAGUUCCCAUACAGGAUAC-3' | (SEQ ID NO: 18602) |
| C5-2927 | 19 nt | Target #3: | 5'-GGAGUUCCCAUACAGGAUA-3' | (SEQ ID NO: 20912) |
| C5-2947 | 19 nt | Target #1: | 5'-UUAGAUUUGGUCCCCAAAA-3' | (SEQ ID NO: 16293) |
| C5-2947 | 19 nt | Target #2: | 5'-CUUAGAUUUGGUCCCCAAA-3' | (SEQ ID NO: 18603) |
| C5-2947 | 19 nt | Target #3: | 5'-CCUUAGAUUUGGUCCCCAA-3' | (SEQ ID NO: 20913) |
| C5-2948 | 19 nt | Target #1: | 5'-UAGAUUUGGUCCCCAAAAC-3' | (SEQ ID NO: 16294) |
| C5-2948 | 19 nt | Target #2: | 5'-UUAGAUUUGGUCCCCAAAA-3' | (SEQ ID NO: 18604) |
| C5-2948 | 19 nt | Target #3: | 5'-CUUAGAUUUGGUCCCCAAA-3' | (SEQ ID NO: 20914) |
| C5-2949 | 19 nt | Target #1: | 5'-AGAUUUGGUCCCCAAAACA-3' | (SEQ ID NO: 16295) |
| C5-2949 | 19 nt | Target #2: | 5'-UAGAUUUGGUCCCCAAAAC-3' | (SEQ ID NO: 18605) |
| C5-2949 | 19 nt | Target #3: | 5'-UUAGAUUUGGUCCCCAAAA-3' | (SEQ ID NO: 20915) |
| C5-2950 | 19 nt | Target #1: | 5'-GAUUUGGUCCCCAAAACAG-3' | (SEQ ID NO: 16296) |
| C5-2950 | 19 nt | Target #2: | 5'-AGAUUUGGUCCCCAAAACA-3' | (SEQ ID NO: 18606) |
| C5-2950 | 19 nt | Target #3: | 5'-UAGAUUUGGUCCCCAAAAC-3' | (SEQ ID NO: 20916) |
| C5-2951 | 19 nt | Target #1: | 5'-AUUUGGUCCCCAAAACAGA-3' | (SEQ ID NO: 16297) |
| C5-2951 | 19 nt | Target #2: | 5'-GAUUUGGUCCCCAAAACAG-3' | (SEQ ID NO: 18607) |
| C5-2951 | 19 nt | Target #3: | 5'-AGAUUUGGUCCCCAAAACA-3' | (SEQ ID NO: 20917) |
| C5-2952 | 19 nt | Target #1: | 5'-UUUGGUCCCCAAAACAGAA-3' | (SEQ ID NO: 16298) |
| C5-2952 | 19 nt | Target #2: | 5'-AUUUGGUCCCCAAAACAGA-3' | (SEQ ID NO: 18608) |
| C5-2952 | 19 nt | Target #3: | 5'-GAUUUGGUCCCCAAAACAG-3' | (SEQ ID NO: 20918) |
| C5-2953 | 19 nt | Target #1: | 5'-UUGGUCCCCAAAACAGAAA-3' | (SEQ ID NO: 16299) |
| C5-2953 | 19 nt | Target #2: | 5'-UUUGGUCCCCAAAACAGAA-3' | (SEQ ID NO: 18609) |
| C5-2953 | 19 nt | Target #3: | 5'-AUUUGGUCCCCAAAACAGA-3' | (SEQ ID NO: 20919) |
| C5-2954 | 19 nt | Target #1: | 5'-UGGUCCCCAAAACAGAAAU-3' | (SEQ ID NO: 16300) |
| C5-2954 | 19 nt | Target #2: | 5'-UUGGUCCCCAAAACAGAAA-3' | (SEQ ID NO: 18610) |
| C5-2954 | 19 nt | Target #3: | 5'-UUUGGUCCCCAAAACAGAA-3' | (SEQ ID NO: 20920) |
| C5-2955 | 19 nt | Target #1: | 5'-GGUCCCCAAAACAGAAAUC-3' | (SEQ ID NO: 16301) |
| C5-2955 | 19 nt | Target #2: | 5'-UGGUCCCCAAAACAGAAAU-3' | (SEQ ID NO: 18611) |
| C5-2955 | 19 nt | Target #3: | 5'-UUGGUCCCCAAAACAGAAA-3' | (SEQ ID NO: 20921) |
| C5-2956 | 19 nt | Target #1: | 5'-GUCCCCAAAACAGAAAUCA-3' | (SEQ ID NO: 16302) |
| C5-2956 | 19 nt | Target #2: | 5'-GGUCCCCAAAACAGAAAUC-3' | (SEQ ID NO: 18612) |
| C5-2956 | 19 nt | Target #3: | 5'-UGGUCCCCAAAACAGAAAU-3' | (SEQ ID NO: 20922) |
| C5-2957 | 19 nt | Target #1: | 5'-UCCCCAAAACAGAAAUCAA-3' | (SEQ ID NO: 16303) |
| C5-2957 | 19 nt | Target #2: | 5'-GUCCCCAAAACAGAAAUCA-3' | (SEQ ID NO: 18613) |
| C5-2957 | 19 nt | Target #3: | 5'-GGUCCCCAAAACAGAAAUC-3' | (SEQ ID NO: 20923) |
| C5-2958 | 19 nt | Target #1: | 5'-CCCCAAAACAGAAAUCAAA-3' | (SEQ ID NO: 16304) |
| C5-2958 | 19 nt | Target #2: | 5'-UCCCCAAAACAGAAAUCAA-3' | (SEQ ID NO: 18614) |
| C5-2958 | 19 nt | Target #3: | 5'-GUCCCCAAAACAGAAAUCA-3' | (SEQ ID NO: 20924) |
| C5-2959 | 19 nt | Target #1: | 5'-CCCAAAACAGAAAUCAAAA-3' | (SEQ ID NO: 16305) |
| C5-2959 | 19 nt | Target #2: | 5'-CCCCAAAACAGAAAUCAAA-3' | (SEQ ID NO: 18615) |
| C5-2959 | 19 nt | Target #3: | 5'-UCCCCAAAACAGAAAUCAA-3' | (SEQ ID NO: 20925) |
| C5-2960 | 19 nt | Target #1: | 5'-CCAAAACAGAAAUCAAAAG-3' | (SEQ ID NO: 16306) |
| C5-2960 | 19 nt | Target #2: | 5'-CCCAAAACAGAAAUCAAAA-3' | (SEQ ID NO: 18616) |
| C5-2960 | 19 nt | Target #3: | 5'-CCCCAAAACAGAAAUCAAA-3' | (SEQ ID NO: 20926) |
| C5-2961 | 19 nt | Target #1: | 5'-CAAAACAGAAAUCAAAAGG-3' | (SEQ ID NO: 16307) |
| C5-2961 | 19 nt | Target #2: | 5'-CCAAAACAGAAAUCAAAAG-3' | (SEQ ID NO: 18617) |
| C5-2961 | 19 nt | Target #3: | 5'-CCCAAAACAGAAAUCAAAA-3' | (SEQ ID NO: 20927) |
| C5-2962 | 19 nt | Target #1: | 5'-AAAACAGAAAUCAAAAGGA-3' | (SEQ ID NO: 16308) |
| C5-2962 | 19 nt | Target #2: | 5'-CAAAACAGAAAUCAAAAGG-3' | (SEQ ID NO: 18618) |
| C5-2962 | 19 nt | Target #3: | 5'-CCAAAACAGAAAUCAAAAG-3' | (SEQ ID NO: 20928) |
| C5-2963 | 19 nt | Target #1: | 5'-AAACAGAAAUCAAAAGGAU-3' | (SEQ ID NO: 16309) |
| C5-2963 | 19 nt | Target #2: | 5'-AAAACAGAAAUCAAAAGGA-3' | (SEQ ID NO: 18619) |
| C5-2963 | 19 nt | Target #3: | 5'-CAAAACAGAAAUCAAAAGG-3' | (SEQ ID NO: 20929) |
| C5-2964 | 19 nt | Target #1: | 5'-AACAGAAAUCAAAAGGAUU-3' | (SEQ ID NO: 16310) |
| C5-2964 | 19 nt | Target #2: | 5'-AAACAGAAAUCAAAAGGAU-3' | (SEQ ID NO: 18620) |
| C5-2964 | 19 nt | Target #3: | 5'-AAAACAGAAAUCAAAAGGA-3' | (SEQ ID NO: 20930) |
| C5-2965 | 19 nt | Target #1: | 5'-ACAGAAAUCAAAAGGAUUU-3' | (SEQ ID NO: 16311) |
| C5-2965 | 19 nt | Target #2: | 5'-AACAGAAAUCAAAAGGAUU-3' | (SEQ ID NO: 18621) |
| C5-2965 | 19 nt | Target #3: | 5'-AAACAGAAAUCAAAAGGAU-3' | (SEQ ID NO: 20931) |
| C5-2966 | 19 nt | Target #1: | 5'-CAGAAAUCAAAAGGAUUUU-3' | (SEQ ID NO: 16312) |
| C5-2966 | 19 nt | Target #2: | 5'-ACAGAAAUCAAAAGGAUUU-3' | (SEQ ID NO: 18622) |
| C5-2966 | 19 nt | Target #3: | 5'-AACAGAAAUCAAAAGGAUU-3' | (SEQ ID NO: 20932) |
| C5-2969 | 19 nt | Target #1: | 5'-AAAUCAAAAGGAUUUGAG-3' | (SEQ ID NO: 16313) |
| C5-2969 | 19 nt | Target #2: | 5'-GAAAUCAAAAGGAUUUGA-3' | (SEQ ID NO: 18623) |
| C5-2969 | 19 nt | Target #3: | 5'-AGAAAUCAAAAGGAUUUG-3' | (SEQ ID NO: 20933) |
| C5-2970 | 19 nt | Target #1: | 5'-AAUCAAAAGGAUUUUGAGU-3' | (SEQ ID NO: 16314) |
| C5-2970 | 19 nt | Target #2: | 5'-AAAUCAAAAGGAUUUUGAG-3' | (SEQ ID NO: 18624) |
| C5-2970 | 19 nt | Target #3: | 5'-GAAAUCAAAAGGAUUUUGA-3' | (SEQ ID NO: 20934) |

TABLE 10-continued

DsiRNA Component 19 Nucleotide Target Sequences of Human Anti-C5
DsiRNAs Predicted to have >50% Knockdown Efficacy

| |

TABLE 10-continued

DsiRNA Component 19 Nucleotide Target Sequences of Human Anti-C5
DsiRNAs Predicted to have >50% Knockdown Efficacy

| |

TABLE 10-continued

DsiRNA Component 19 Nucleotide Target Sequences of Human Anti-C5
DsiRNAs Predicted to have >50% Knockdown Efficacy

| |

TABLE 10-continued

DsiRNA Component 19 Nucleotide Target Sequences of Human Anti-C5
DsiRNAs Predicted to have >50% Knockdown Efficacy

| |

TABLE 10-continued

DsiRNA Component 19 Nucleotide Target Sequences of Human Anti-C5
DsiRNAs Predicted to have >50% Knockdown Efficacy

| |

TABLE 10-continued

DsiRNA Component 19 Nucleotide Target Sequences of Human Anti-C5
DsiRNAs Predicted to have >50% Knockdown Efficacy TABLE 10-continued DsiRNA Component 19 Nucleotide Target Sequences of Human Anti-C5
DsiRNAs Predicted to have >50% Knockdown Efficacy

| | | | | |
|---|---|---|---|---|
| C5-3289 | 19 nt | Target #1: | 5'-ACAGCUUUUGCUUUAAGAG-3' | (SEQ ID NO: 16469) |
| C5-3289 | 19 nt | Target #2: | 5'-AACAGCUUUUGCUUUAAGA-3' | (SEQ ID NO: 18779) |
| C5-3289 | 19 nt | Target #3: | 5'-UAACAGCUUUUGCUUUAAG-3' | (SEQ ID NO: 21089) |
| C5-3290 | 19 nt | Target #1: | 5'-CAGCUUUUGCUUUAAGAGU-3' | (SEQ ID NO: 16470) |
| C5-3290 | 19 nt | Target #2: | 5'-ACAGCUUUUGCUUUAAGAG-3' | (SEQ ID NO: 18780) |
| C5-3290 | 19 nt | Target #3: | 5'-AACAGCUUUUGCUUUAAGA-3' | (SEQ ID NO: 21090) |
| C5-3291 | 19 nt | Target #1: | 5'-AGCUUUUGCUUUAAGAGUA-3' | (SEQ ID NO: 16471) |
| C5-3291 | 19 nt | Target #2: | 5'-CAGCUUUUGCUUUAAGAGU-3' | (SEQ ID NO: 18781) |
| C5-3291 | 19 nt | Target #3: | 5'-ACAGCUUUUGCUUUAAGAG-3' | (SEQ ID NO: 21091) |
| C5-3292 | 19 nt | Target #1: | 5'-GCUUUUGCUUUAAGAGUAC-3' | (SEQ ID NO: 16472) |
| C5-3292 | 19 nt | Target #2: | 5'-AGCUUUUGCUUUAAGAGUA-3' | (SEQ ID NO: 18782) |
| C5-3292 | 19 nt | Target #3: | 5'-CAGCUUUUGCUUUAAGAGU-3' | (SEQ ID NO: 21092) |
| C5-3293 | 19 nt | Target #1: | 5'-CUUUUGCUUUAAGAGUACU-3' | (SEQ ID NO: 16473) |
| C5-3293 | 19 nt | Target #2: | 5'-GCUUUUGCUUUAAGAGUAC-3' | (SEQ ID NO: 18783) |
| C5-3293 | 19 nt | Target #3: | 5'-AGCUUUUGCUUUAAGAGUA-3' | (SEQ ID NO: 21093) |
| C5-3294 | 19 nt | Target #1: | 5'-UUUUGCUUUAAGAGUACUU-3' | (SEQ ID NO: 16474) |
| C5-3294 | 19 nt | Target #2: | 5'-CUUUUGCUUUAAGAGUACU-3' | (SEQ ID NO: 18784) |
| C5-3294 | 19 nt | Target #3: | 5'-GCUUUUGCUUUAAGAGUAC-3' | (SEQ ID NO: 21094) |
| C5-3295 | 19 nt | Target #1: | 5'-UUUGCUUUAAGAGUACUUG-3' | (SEQ ID NO: 16475) |
| C5-3295 | 19 nt | Target #2: | 5'-UUUUGCUUUAAGAGUACUU-3' | (SEQ ID NO: 18785) |
| C5-3295 | 19 nt | Target #3: | 5'-CUUUUGCUUUAAGAGUACU-3' | (SEQ ID NO: 21095) |
| C5-3296 | 19 nt | Target #1: | 5'-UUGCUUUAAGAGUACUUGG-3' | (SEQ ID NO: 16476) |
| C5-3296 | 19 nt | Target #2: | 5'-UUUGCUUUAAGAGUACUUG-3' | (SEQ ID NO: 18786) |
| C5-3296 | 19 nt | Target #3: | 5'-UUUUGCUUUAAGAGUACUU-3' | (SEQ ID NO: 21096) |
| C5-3297 | 19 nt | Target #1: | 5'-UGCUUUAAGAGUACUUGGA-3' | (SEQ ID NO: 16477) |
| C5-3297 | 19 nt | Target #2: | 5'-UUGCUUUAAGAGUACUUGG-3' | (SEQ ID NO: 18787) |
| C5-3297 | 19 nt | Target #3: | 5'-UUUGCUUUAAGAGUACUUG-3' | (SEQ ID NO: 21097) |
| C5-3300 | 19 nt | Target #1: | 5'-UUUAAGAGUACUUGGACAA-3' | (SEQ ID NO: 16478) |
| C5-3300 | 19 nt | Target #2: | 5'-CUUUAAGAGUACUUGGACA-3' | (SEQ ID NO: 18788) |
| C5-3300 | 19 nt | Target #3: | 5'-GCUUUAAGAGUACUUGGAC-3' | (SEQ ID NO: 21098) |
| C5-3301 | 19 nt | Target #1: | 5'-UUAAGAGUACUUGGACAAG-3' | (SEQ ID NO: 16479) |
| C5-3301 | 19 nt | Target #2: | 5'-UUUAAGAGUACUUGGACAA-3' | (SEQ ID NO: 18789) |
| C5-3301 | 19 nt | Target #3: | 5'-CUUUAAGAGUACUUGGACA-3' | (SEQ ID NO: 21099) |
| C5-3331 | 19 nt | Target #1: | 5'-GUAGAGCAGAACCAAAAUU-3' | (SEQ ID NO: 16480) |
| C5-3331 | 19 nt | Target #2: | 5'-CGUAGAGCAGAACCAAAAU-3' | (SEQ ID NO: 18790) |
| C5-3331 | 19 nt | Target #3: | 5'-ACGUAGAGCAGAACCAAAA-3' | (SEQ ID NO: 21100) |
| C5-3355 | 19 nt | Target #1: | 5'-UGUAAUUCUUUAUUGUGGC-3' | (SEQ ID NO: 16481) |
| C5-3355 | 19 nt | Target #2: | 5'-UUGUAAUUCUUUAUUGUGG-3' | (SEQ ID NO: 18791) |
| C5-3355 | 19 nt | Target #3: | 5'-UUUGUAAUUCUUUAUUGUG-3' | (SEQ ID NO: 21101) |
| C5-3356 | 19 nt | Target #1: | 5'-GUAAUUCUUUAUUGUGGCU-3' | (SEQ ID NO: 16482) |
| C5-3356 | 19 nt | Target #2: | 5'-UGUAAUUCUUUAUUGUGGC-3' | (SEQ ID NO: 18792) |
| C5-3356 | 19 nt | Target #3: | 5'-UUGUAAUUCUUUAUUGUGG-3' | (SEQ ID NO: 21102) |
| C5-3406 | 19 nt | Target #1: | 5'-UUCAAGGAAAAUUCACAGU-3' | (SEQ ID NO: 16483) |
| C5-3406 | 19 nt | Target #2: | 5'-UUUCAAGGAAAAUUCACAG-3' | (SEQ ID NO: 18793) |
| C5-3406 | 19 nt | Target #3: | 5'-CUUUCAAGGAAAAUUCACA-3' | (SEQ ID NO: 21103) |
| C5-3407 | 19 nt | Target #1: | 5'-UCAAGGAAAAUUCACAGUA-3' | (SEQ ID NO: 16484) |
| C5-3407 | 19 nt | Target #2: | 5'-UUCAAGGAAAAUUCACAGU-3' | (SEQ ID NO: 18794) |
| C5-3407 | 19 nt | Target #3: | 5'-UUUCAAGGAAAAUUCACAG-3' | (SEQ ID NO: 21104) |
| C5-3408 | 19 nt | Target #1: | 5'-CAAGGAAAAUUCACAGUAU-3' | (SEQ ID NO: 16485) |
| C5-3408 | 19 nt | Target #2: | 5'-UCAAGGAAAAUUCACAGUA-3' | (SEQ ID NO: 18795) |
| C5-3408 | 19 nt | Target #3: | 5'-UUCAAGGAAAAUUCACAGU-3' | (SEQ ID NO: 21105) |
| C5-3409 | 19 nt | Target #1: | 5'-AAGGAAAAUUCACAGUAUC-3' | (SEQ ID NO: 16486) |
| C5-3409 | 19 nt | Target #2: | 5'-CAAGGAAAAUUCACAGUAU-3' | (SEQ ID NO: 18796) |
| C5-3409 | 19 nt | Target #3: | 5'-UCAAGGAAAAUUCACAGUA-3' | (SEQ ID NO: 21106) |
| C5-3410 | 19 nt | Target #1: | 5'-AGGAAAAUUCACAGUAUCA-3' | (SEQ ID NO: 16487) |
| C5-3410 | 19 nt | Target #2: | 5'-AAGGAAAAUUCACAGUAUC-3' | (SEQ ID NO: 18797) |
| C5-3410 | 19 nt | Target #3: | 5'-CAAGGAAAAUUCACAGUAU-3' | (SEQ ID NO: 21107) |
| C5-3411 | 19 nt | Target #1: | 5'-GGAAAAUUCACAGUAUCAA-3' | (SEQ ID NO: 16488) |
| C5-3411 | 19 nt | Target #2: | 5'-AGGAAAAUUCACAGUAUCA-3' | (SEQ ID NO: 18798) |
| C5-3411 | 19 nt | Target #3: | 5'-AAGGAAAAUUCACAGUAUC-3' | (SEQ ID NO: 21108) |
| C5-3412 | 19 nt | Target #1: | 5'-GAAAAUUCACAGUAUCAAC-3' | (SEQ ID NO: 16489) |
| C5-3412 | 19 nt | Target #2: | 5'-GGAAAAUUCACAGUAUCAA-3' | (SEQ ID NO: 18799) |
| C5-3412 | 19 nt | Target #3: | 5'-AGGAAAAUUCACAGUAUCA-3' | (SEQ ID NO: 21109) |
| C5-3413 | 19 nt | Target #1: | 5'-AAAAUUCACAGUAUCAACC-3' | (SEQ ID NO: 16490) |
| C5-3413 | 19 nt | Target #2: | 5'-GAAAAUUCACAGUAUCAAC-3' | (SEQ ID NO: 18800) |
| C5-3413 | 19 nt | Target #3: | 5'-GGAAAAUUCACAGUAUCAA-3' | (SEQ ID NO: 21110) |
| C5-3414 | 19 nt | Target #1: | 5'-AAAUUCACAGUAUCAACCA-3' | (SEQ ID NO: 16491) |
| C5-3414 | 19 nt | Target #2: | 5'-AAAAUUCACAGUAUCAACC-3' | (SEQ ID NO: 18801) |
| C5-3414 | 19 nt | Target #3: | 5'-GAAAAUUCACAGUAUCAAC-3' | (SEQ ID NO: 21111) |
| C5-3415 | 19 nt | Target #1: | 5'-AAUUCACAGUAUCAACCAA-3' | (SEQ ID NO: 16492) |
| C5-3415 | 19 nt | Target #2: | 5'-AAAUUCACAGUAUCAACCA-3' | (SEQ ID NO: 18802) |
| C5-3415 | 19 nt | Target #3: | 5'-AAAAUUCACAGUAUCAACC-3' | (SEQ ID NO: 21112) |
| C5-3416 | 19 nt | Target #1: | 5'-AUUCACAGUAUCAACCAAU-3' | (SEQ ID NO: 16493) |
| C5-3416 | 19 nt | Target #2: | 5'-AAUUCACAGUAUCAACCAA-3' | (SEQ ID NO: 18803) |
| C5-3416 | 19 nt | Target #3: | 5'-AAAUUCACAGUAUCAACCA-3' | (SEQ ID NO: 21113) |
| C5-3417 | 19 nt | Target #1: | 5'-UUCACAGUAUCAACCAAUA-3' | (SEQ ID NO: 16494) |
| C5-3417 | 19 nt | Target #2: | 5'-AUUCACAGUAUCAACCAAU-3' | (SEQ ID NO: 18804) |

TABLE 10-continued

DsiRNA Component 19 Nucleotide Target Sequences of Human Anti-C5
DsiRNAs Predicted to have >50% Knockdown Efficacy

| | | | |

TABLE 10-continued

| DsiRNA Component 19 Nucleotide Target Sequences of Human Anti-C5 DsiRNAs Predicted to have >50% Knockdown Efficacy | | | | |
|---|---|---|---|---|
| C5-3587 | 19 nt | Target #2: | 5'-AAUACACUGCCAGCCCAGA-3' | (SEQ ID NO: 18830) |
| C5-3587 | 19 nt | Target #3: | 5'-AAAUACACUGCCAGCCCAG-3' | (SEQ ID NO: 21140) |
| C5-3588 | 19 nt | Target #1: | 5'-UACACUGCCAGCCCAGAGC-3' | (SEQ ID NO: 16521) |
| C5-3588 | 19 nt | Target #2: | 5'-AUACACUGCCAGCCCAGAG-3' | (SEQ ID NO: 18831) |
| C5-3588 | 19 nt | Target #3: | 5'-AAUACACUGCCAGCCCAGA-3' | (SEQ ID NO: 21141) |
| C5-3589 | 19 nt | Target #1: | 5'-ACACUGCCAGCCCAGAGCA-3' | (SEQ ID NO: 16522) |
| C5-3589 | 19 nt | Target #2: | 5'-UACACUGCCAGCCCAGAGC-3' | (SEQ ID NO: 18832) |
| C5-3589 | 19 nt | Target #3: | 5'-AUACACUGCCAGCCCAGAG-3' | (SEQ ID NO: 21142) |
| C5-3590 | 19 nt | Target #1: | 5'-CACUGCCAGCCCAGAGCAC-3' | (SEQ ID NO: 16523) |
| C5-3590 | 19 nt | Target #2: | 5'-ACACUGCCAGCCCAGAGCA-3' | (SEQ ID NO: 18833) |
| C5-3590 | 19 nt | Target #3: | 5'-UACACUGCCAGCCCAGAGC-3' | (SEQ ID NO: 21143) |
| C5-3591 | 19 nt | Target #1: | 5'-ACUGCCAGCCCAGAGCACC-3' | (SEQ ID NO: 16524) |
| C5-3591 | 19 nt | Target #2: | 5'-CACUGCCAGCCCAGAGCAC-3' | (SEQ ID NO: 18834) |
| C5-3591 | 19 nt | Target #3: | 5'-ACACUGCCAGCCCAGAGCA-3' | (SEQ ID NO: 21144) |
| C5-3592 | 19 nt | Target #1: | 5'-CUGCCAGCCCAGAGCACCU-3' | (SEQ ID NO: 16525) |
| C5-3592 | 19 nt | Target #2: | 5'-ACUGCCAGCCCAGAGCACC-3' | (SEQ ID NO: 18835) |
| C5-3592 | 19 nt | Target #3: | 5'-CACUGCCAGCCCAGAGCAC-3' | (SEQ ID NO: 21145) |
| C5-3593 | 19 nt | Target #1: | 5'-UGCCAGCCCAGAGCACCUU-3' | (SEQ ID NO: 16526) |
| C5-3593 | 19 nt | Target #2: | 5'-CUGCCAGCCCAGAGCACCU-3' | (SEQ ID NO: 18836) |
| C5-3593 | 19 nt | Target #3: | 5'-ACUGCCAGCCCAGAGCACC-3' | (SEQ ID NO: 21146) |
| C5-3594 | 19 nt | Target #1: | 5'-GCCAGCCCAGAGCACCUUU-3' | (SEQ ID NO: 16527) |
| C5-3594 | 19 nt | Target #2: | 5'-UGCCAGCCCAGAGCACCUU-3' | (SEQ ID NO: 18837) |
| C5-3594 | 19 nt | Target #3: | 5'-CUGCCAGCCCAGAGCACCU-3' | (SEQ ID NO: 21147) |
| C5-3595 | 19 nt | Target #1: | 5'-CCAGCCCAGAGCACCUUUA-3' | (SEQ ID NO: 16528) |
| C5-3595 | 19 nt | Target #2: | 5'-GCCAGCCCAGAGCACCUUU-3' | (SEQ ID NO: 18838) |
| C5-3595 | 19 nt | Target #3: | 5'-UGCCAGCCCAGAGCACCUU-3' | (SEQ ID NO: 21148) |
| C5-3596 | 19 nt | Target #1: | 5'-CAGCCCAGAGCACCUUUAC-3' | (SEQ ID NO: 16529) |
| C5-3596 | 19 nt | Target #2: | 5'-CCAGCCCAGAGCACCUUUA-3' | (SEQ ID NO: 18839) |
| C5-3596 | 19 nt | Target #3: | 5'-GCCAGCCCAGAGCACCUUU-3' | (SEQ ID NO: 21149) |
| C5-3597 | 19 nt | Target #1: | 5'-AGCCCAGAGCACCUUUACA-3' | (SEQ ID NO: 16530) |
| C5-3597 | 19 nt | Target #2: | 5'-CAGCCCAGAGCACCUUUAC-3' | (SEQ ID NO: 18840) |
| C5-3597 | 19 nt | Target #3: | 5'-CCAGCCCAGAGCACCUUUA-3' | (SEQ ID NO: 21150) |
| C5-3598 | 19 nt | Target #1: | 5'-GCCCAGAGCACCUUUACAU-3' | (SEQ ID NO: 16531) |
| C5-3598 | 19 nt | Target #2: | 5'-AGCCCAGAGCACCUUUACA-3' | (SEQ ID NO: 18841) |
| C5-3598 | 19 nt | Target #3: | 5'-CAGCCCAGAGCACCUUUAC-3' | (SEQ ID NO: 21151) |
| C5-3599 | 19 nt | Target #1: | 5'-CCCAGAGCACCUUUACAUU-3' | (SEQ ID NO: 16532) |
| C5-3599 | 19 nt | Target #2: | 5'-GCCCAGAGCACCUUUACAU-3' | (SEQ ID NO: 18842) |
| C5-3599 | 19 nt | Target #3: | 5'-AGCCCAGAGCACCUUUACA-3' | (SEQ ID NO: 21152) |
| C5-3600 | 19 nt | Target #1: | 5'-CCAGAGCACCUUUACAUUG-3' | (SEQ ID NO: 16533) |
| C5-3600 | 19 nt | Target #2: | 5'-CCCAGAGCACCUUUACAUU-3' | (SEQ ID NO: 18843) |
| C5-3600 | 19 nt | Target #3: | 5'-GCCCAGAGCACCUUUACAU-3' | (SEQ ID NO: 21153) |
| C5-3601 | 19 nt | Target #1: | 5'-CAGAGCACCUUUACAUUGG-3' | (SEQ ID NO: 16534) |
| C5-3601 | 19 nt | Target #2: | 5'-CCAGAGCACCUUUACAUUG-3' | (SEQ ID NO: 18844) |
| C5-3601 | 19 nt | Target #3: | 5'-CCCAGAGCACCUUUACAUU-3' | (SEQ ID NO: 21154) |
| C5-3602 | 19 nt | Target #1: | 5'-AGAGCACCUUUACAUUGGC-3' | (SEQ ID NO: 16535) |
| C5-3602 | 19 nt | Target #2: | 5'-CAGAGCACCUUUACAUUGG-3' | (SEQ ID NO: 18845) |
| C5-3602 | 19 nt | Target #3: | 5'-CCAGAGCACCUUUACAUUG-3' | (SEQ ID NO: 21155) |
| C5-3603 | 19 nt | Target #1: | 5'-GAGCACCUUUACAUUGGCC-3' | (SEQ ID NO: 16536) |
| C5-3603 | 19 nt | Target #2: | 5'-AGAGCACCUUUACAUUGGC-3' | (SEQ ID NO: 18846) |
| C5-3603 | 19 nt | Target #3: | 5'-CAGAGCACCUUUACAUUGG-3' | (SEQ ID NO: 21156) |
| C5-3604 | 19 nt | Target #1: | 5'-AGCACCUUUACAUUGGCCA-3' | (SEQ ID NO: 16537) |
| C5-3604 | 19 nt | Target #2: | 5'-GAGCACCUUUACAUUGGCC-3' | (SEQ ID NO: 18847) |
| C5-3604 | 19 nt | Target #3: | 5'-AGAGCACCUUUACAUUGGC-3' | (SEQ ID NO: 21157) |
| C5-3605 | 19 nt | Target #1: | 5'-GCACCUUUACAUUGGCCAU-3' | (SEQ ID NO: 16538) |
| C5-3605 | 19 nt | Target #2: | 5'-AGCACCUUUACAUUGGCCA-3' | (SEQ ID NO: 18848) |
| C5-3605 | 19 nt | Target #3: | 5'-GAGCACCUUUACAUUGGCC-3' | (SEQ ID NO: 21158) |
| C5-3606 | 19 nt | Target #1: | 5'-CACCUUUACAUUGGCCAUU-3' | (SEQ ID NO: 16539) |
| C5-3606 | 19 nt | Target #2: | 5'-GCACCUUUACAUUGGCCAU-3' | (SEQ ID NO: 18849) |
| C5-3606 | 19 nt | Target #3: | 5'-AGCACCUUUACAUUGGCCA-3' | (SEQ ID NO: 21159) |
| C5-3607 | 19 nt | Target #1: | 5'-ACCUUUACAUUGGCCAUUU-3' | (SEQ ID NO: 16540) |
| C5-3607 | 19 nt | Target #2: | 5'-CACCUUUACAUUGGCCAUU-3' | (SEQ ID NO: 18850) |
| C5-3607 | 19 nt | Target #3: | 5'-GCACCUUUACAUUGGCCAU-3' | (SEQ ID NO: 21160) |
| C5-3608 | 19 nt | Target #1: | 5'-CCUUUACAUUGGCCAUUUC-3' | (SEQ ID NO: 16541) |
| C5-3608 | 19 nt | Target #2: | 5'-ACCUUUACAUUGGCCAUUU-3' | (SEQ ID NO: 18851) |
| C5-3608 | 19 nt | Target #3: | 5'-CACCUUUACAUUGGCCAUU-3' | (SEQ ID NO: 21161) |
| C5-3609 | 19 nt | Target #1: | 5'-CUUUACAUUGGCCAUUUCU-3' | (SEQ ID NO: 16542) |
| C5-3609 | 19 nt | Target #2: | 5'-CCUUUACAUUGGCCAUUUC-3' | (SEQ ID NO: 18852) |
| C5-3609 | 19 nt | Target #3: | 5'-ACCUUUACAUUGGCCAUUU-3' | (SEQ ID NO: 21162) |
| C5-3610 | 19 nt | Target #1: | 5'-UUUACAUUGGCCAUUUCUG-3' | (SEQ ID NO: 16543) |
| C5-3610 | 19 nt | Target #2: | 5'-CUUUACAUUGGCCAUUUCU-3' | (SEQ ID NO: 18853) |
| C5-3610 | 19 nt | Target #3: | 5'-CCUUUACAUUGGCCAUUUC-3' | (SEQ ID NO: 21163) |
| C5-3611 | 19 nt | Target #1: | 5'-UUACAUUGGCCAUUUCUGC-3' | (SEQ ID NO: 16544) |
| C5-3611 | 19 nt | Target #2: | 5'-UUUACAUUGGCCAUUUCUG-3' | (SEQ ID NO: 18854) |
| C5-3611 | 19 nt | Target #3: | 5'-CUUUACAUUGGCCAUUUCU-3' | (SEQ ID NO: 21164) |
| C5-3631 | 19 nt | Target #1: | 5'-UAUGCUCUUUCCCUGGGAG-3' | (SEQ ID NO: 16545) |
| C5-3631 | 19 nt | Target #2: | 5'-GUAUGCUCUUUCCCUGGGA-3' | (SEQ ID NO: 18855) |
| C5-3631 | 19 nt | Target #3: | 5'-CGUAUGCUCUUUCCCUGGG-3' | (SEQ ID NO: 21165) |

TABLE 10-continued

DsiRNA Component 19 Nucleotide Target Sequences of Human Anti-C5 DsiRNAs Predicted to have >50% Knockdown Efficacy

| | | | | |
|---|---|---|---|---|
| C5-3632 | 19 nt | Target #1: | 5'-AUGCUCUUUCCCUGGGAGA-3' | (SEQ ID NO: 16546) |
| C5-3632 | 19 nt | Target #2: | 5'-UAUGCUCUUUCCCUGGGAG-3' | (SEQ ID NO: 18856) |
| C5-3632 | 19 nt | Target #3: | 5'-GUAUGCUCUUUCCCUGGGA-3' | (SEQ ID NO: 21166) |
| C5-3633 | 19 nt | Target #1: | 5'-UGCUCUUUCCCUGGGAGAU-3' | (SEQ ID NO: 16547) |
| C5-3633 | 19 nt | Target #2: | 5'-AUGCUCUUUCCCUGGGAGA-3' | (SEQ ID NO: 18857) |
| C5-3633 | 19 nt | Target #3: | 5'-UAUGCUCUUUCCCUGGGAG-3' | (SEQ ID NO: 21167) |
| C5-3634 | 19 nt | Target #1: | 5'-GCUCUUUCCCUGGGAGAUA-3' | (SEQ ID NO: 16548) |
| C5-3634 | 19 nt | Target #2: | 5'-UGCUCUUUCCCUGGGAGAU-3' | (SEQ ID NO: 18858) |
| C5-3634 | 19 nt | Target #3: | 5'-AUGCUCUUUCCCUGGGAGA-3' | (SEQ ID NO: 21168) |
| C5-3635 | 19 nt | Target #1: | 5'-CUCUUUCCCUGGGAGAUAA-3' | (SEQ ID NO: 16549) |
| C5-3635 | 19 nt | Target #2: | 5'-GCUCUUUCCCUGGGAGAUA-3' | (SEQ ID NO: 18859) |
| C5-3635 | 19 nt | Target #3: | 5'-UGCUCUUUCCCUGGGAGAU-3' | (SEQ ID NO: 21169) |
| C5-3636 | 19 nt | Target #1: | 5'-UCUUUCCCUGGGAGAUAAA-3' | (SEQ ID NO: 16550) |
| C5-3636 | 19 nt | Target #2: | 5'-CUCUUUCCCUGGGAGAUAA-3' | (SEQ ID NO: 18860) |
| C5-3636 | 19 nt | Target #3: | 5'-GCUCUUUCCCUGGGAGAUA-3' | (SEQ ID NO: 21170) |
| C5-3637 | 19 nt | Target #1: | 5'-CUUUCCCUGGGAGAUAAAA-3' | (SEQ ID NO: 16551) |
| C5-3637 | 19 nt | Target #2: | 5'-UCUUUCCCUGGGAGAUAAA-3' | (SEQ ID NO: 18861) |
| C5-3637 | 19 nt | Target #3: | 5'-CUCUUUCCCUGGGAGAUAA-3' | (SEQ ID NO: 21171) |
| C5-3638 | 19 nt | Target #1: | 5'-UUUCCCUGGGAGAUAAAAC-3' | (SEQ ID NO: 16552) |
| C5-3638 | 19 nt | Target #2: | 5'-CUUUCCCUGGGAGAUAAAA-3' | (SEQ ID NO: 18862) |
| C5-3638 | 19 nt | Target #3: | 5'-UCUUUCCCUGGGAGAUAAA-3' | (SEQ ID NO: 21172) |
| C5-3639 | 19 nt | Target #1: | 5'-UUCCCUGGGAGAUAAAACU-3' | (SEQ ID NO: 16553) |
| C5-3639 | 19 nt | Target #2: | 5'-UUUCCCUGGGAGAUAAAAC-3' | (SEQ ID NO: 18863) |
| C5-3639 | 19 nt | Target #3: | 5'-CUUUCCCUGGGAGAUAAAA-3' | (SEQ ID NO: 21173) |
| C5-3640 | 19 nt | Target #1: | 5'-UCCCUGGGAGAUAAAACUC-3' | (SEQ ID NO: 16554) |
| C5-3640 | 19 nt | Target #2: | 5'-UUCCCUGGGAGAUAAAACU-3' | (SEQ ID NO: 18864) |
| C5-3640 | 19 nt | Target #3: | 5'-UUUCCCUGGGAGAUAAAAC-3' | (SEQ ID NO: 21174) |
| C5-3641 | 19 nt | Target #1: | 5'-CCCUGGGAGAUAAAACUCA-3' | (SEQ ID NO: 16555) |
| C5-3641 | 19 nt | Target #2: | 5'-UCCCUGGGAGAUAAAACUC-3' | (SEQ ID NO: 18865) |
| C5-3641 | 19 nt | Target #3: | 5'-UUCCCUGGGAGAUAAAACU-3' | (SEQ ID NO: 21175) |
| C5-3642 | 19 nt | Target #1: | 5'-CCUGGGAGAUAAAACUCAC-3' | (SEQ ID NO: 16556) |
| C5-3642 | 19 nt | Target #2: | 5'-CCCUGGGAGAUAAAACUCA-3' | (SEQ ID NO: 18866) |
| C5-3642 | 19 nt | Target #3: | 5'-UCCCUGGGAGAUAAAACUC-3' | (SEQ ID NO: 21176) |
| C5-3643 | 19 nt | Target #1: | 5'-CUGGGAGAUAAAACUCACC-3' | (SEQ ID NO: 16557) |
| C5-3643 | 19 nt | Target #2: | 5'-CCUGGGAGAUAAAACUCAC-3' | (SEQ ID NO: 18867) |
| C5-3643 | 19 nt | Target #3: | 5'-CCCUGGGAGAUAAAACUCA-3' | (SEQ ID NO: 21177) |
| C5-3644 | 19 nt | Target #1: | 5'-UGGGAGAUAAAACUCACCC-3' | (SEQ ID NO: 16558) |
| C5-3644 | 19 nt | Target #2: | 5'-CUGGGAGAUAAAACUCACC-3' | (SEQ ID NO: 18868) |
| C5-3644 | 19 nt | Target #3: | 5'-CCUGGGAGAUAAAACUCAC-3' | (SEQ ID NO: 21178) |
| C5-3645 | 19 nt | Target #1: | 5'-GGGAGAUAAAACUCACCCA-3' | (SEQ ID NO: 16559) |
| C5-3645 | 19 nt | Target #2: | 5'-UGGGAGAUAAAACUCACCC-3' | (SEQ ID NO: 18869) |
| C5-3645 | 19 nt | Target #3: | 5'-CUGGGAGAUAAAACUCACC-3' | (SEQ ID NO: 21179) |
| C5-3646 | 19 nt | Target #1: | 5'-GGAGAUAAAACUCACCCAC-3' | (SEQ ID NO: 16560) |
| C5-3646 | 19 nt | Target #2: | 5'-GGGAGAUAAAACUCACCCA-3' | (SEQ ID NO: 18870) |
| C5-3646 | 19 nt | Target #3: | 5'-UGGGAGAUAAAACUCACCC-3' | (SEQ ID NO: 21180) |
| C5-3647 | 19 nt | Target #1: | 5'-GAGAUAAAACUCACCCACA-3' | (SEQ ID NO: 16561) |
| C5-3647 | 19 nt | Target #2: | 5'-GGAGAUAAAACUCACCCAC-3' | (SEQ ID NO: 18871) |
| C5-3647 | 19 nt | Target #3: | 5'-GGGAGAUAAAACUCACCCA-3' | (SEQ ID NO: 21181) |
| C5-3648 | 19 nt | Target #1: | 5'-AGAUAAAACUCACCCACAG-3' | (SEQ ID NO: 16562) |
| C5-3648 | 19 nt | Target #2: | 5'-GAGAUAAAACUCACCCACA-3' | (SEQ ID NO: 18872) |
| C5-3648 | 19 nt | Target #3: | 5'-GGAGAUAAAACUCACCCAC-3' | (SEQ ID NO: 21182) |
| C5-3649 | 19 nt | Target #1: | 5'-GAUAAAACUCACCCACAGU-3' | (SEQ ID NO: 16563) |
| C5-3649 | 19 nt | Target #2: | 5'-AGAUAAAACUCACCCACAG-3' | (SEQ ID NO: 18873) |
| C5-3649 | 19 nt | Target #3: | 5'-GAGAUAAAACUCACCCACA-3' | (SEQ ID NO: 21183) |
| C5-3650 | 19 nt | Target #1: | 5'-AUAAAACUCACCCACAGUU-3' | (SEQ ID NO: 16564) |
| C5-3650 | 19 nt | Target #2: | 5'-GAUAAAACUCACCCACAGU-3' | (SEQ ID NO: 18874) |
| C5-3650 | 19 nt | Target #3: | 5'-AGAUAAAACUCACCCACAG-3' | (SEQ ID NO: 21184) |
| C5-3651 | 19 nt | Target #1: | 5'-UAAAACUCACCCACAGUUU-3' | (SEQ ID NO: 16565) |
| C5-3651 | 19 nt | Target #2: | 5'-AUAAAACUCACCCACAGUU-3' | (SEQ ID NO: 18875) |
| C5-3651 | 19 nt | Target #3: | 5'-GAUAAAACUCACCCACAGU-3' | (SEQ ID NO: 21185) |
| C5-3671 | 19 nt | Target #1: | 5'-GUUCAAUUGUUUCAGCUUU-3' | (SEQ ID NO: 16566) |
| C5-3671 | 19 nt | Target #2: | 5'-CGUUCAAUUGUUUCAGCUU-3' | (SEQ ID NO: 18876) |
| C5-3671 | 19 nt | Target #3: | 5'-UCGUUCAAUUGUUUCAGCU-3' | (SEQ ID NO: 21186) |
| C5-3673 | 19 nt | Target #1: | 5'-UCAAUUGUUUCAGCUUUGA-3' | (SEQ ID NO: 16567) |
| C5-3673 | 19 nt | Target #2: | 5'-UUCAAUUGUUUCAGCUUUG-3' | (SEQ ID NO: 18877) |
| C5-3673 | 19 nt | Target #3: | 5'-GUUCAAUUGUUUCAGCUUU-3' | (SEQ ID NO: 21187) |
| C5-3674 | 19 nt | Target #1: | 5'-CAAUUGUUUCAGCUUUGAA-3' | (SEQ ID NO: 16568) |
| C5-3674 | 19 nt | Target #2: | 5'-UCAAUUGUUUCAGCUUUGA-3' | (SEQ ID NO: 18878) |
| C5-3674 | 19 nt | Target #3: | 5'-UUCAAUUGUUUCAGCUUUG-3' | (SEQ ID NO: 21188) |
| C5-3675 | 19 nt | Target #1: | 5'-AAUUGUUUCAGCUUUGAAG-3' | (SEQ ID NO: 16569) |
| C5-3675 | 19 nt | Target #2: | 5'-CAAUUGUUUCAGCUUUGAA-3' | (SEQ ID NO: 18879) |
| C5-3675 | 19 nt | Target #3: | 5'-UCAAUUGUUUCAGCUUUGA-3' | (SEQ ID NO: 21189) |
| C5-3676 | 19 nt | Target #1: | 5'-AUUGUUUCAGCUUUGAAGA-3' | (SEQ ID NO: 16570) |
| C5-3676 | 19 nt | Target #2: | 5'-AAUUGUUUCAGCUUUGAAG-3' | (SEQ ID NO: 18880) |
| C5-3676 | 19 nt | Target #3: | 5'-CAAUUGUUUCAGCUUUGAA-3' | (SEQ ID NO: 21190) |
| C5-3677 | 19 nt | Target #1: | 5'-UUGUUUCAGCUUUGAAGAG-3' | (SEQ ID NO: 16571) |
| C5-3677 | 19 nt | Target #2: | 5'-AUUGUUUCAGCUUUGAAGA-3' | (SEQ ID NO: 18881) |

TABLE 10-continued

DsiRNA Component 19 Nucleotide Target Sequences of Human Anti-C5
DsiRNAs Predicted to have >50% Knockdown Efficacy

| | | | | |
|---|---|---|---|---|
| C5-3677 | 19 nt | Target #3: | 5'-AAUUGUUUCAGCUUUGAAG-3' | (SEQ ID NO: 21191) |
| C5-3678 | 19 nt | Target #1: | 5'-UGUUUCAGCUUUGAAGAGA-3' | (SEQ ID NO: 16572) |
| C5-3678 | 19 nt | Target #2: | 5'-UUGUUUCAGCUUUGAAGAG-3' | (SEQ ID NO: 18882) |
| C5-3678 | 19 nt | Target #3: | 5'-AUUGUUUCAGCUUUGAAGA-3' | (SEQ ID NO: 21192) |
| C5-3679 | 19 nt | Target #1: | 5'-GUUUCAGCUUUGAAGAGAG-3' | (SEQ ID NO: 16573) |
| C5-3679 | 19 nt | Target #2: | 5'-UGUUUCAGCUUUGAAGAGA-3' | (SEQ ID NO: 18883) |
| C5-3679 | 19 nt | Target #3: | 5'-UUGUUUCAGCUUUGAAGAG-3' | (SEQ ID NO: 21193) |
| C5-3680 | 19 nt | Target #1: | 5'-UUUCAGCUUUGAAGAGAGA-3' | (SEQ ID NO: 16574) |
| C5-3680 | 19 nt | Target #2: | 5'-GUUUCAGCUUUGAAGAGAG-3' | (SEQ ID NO: 18884) |
| C5-3680 | 19 nt | Target #3: | 5'-UGUUUCAGCUUUGAAGAGA-3' | (SEQ ID NO: 21194) |
| C5-3681 | 19 nt | Target #1: | 5'-UUCAGCUUUGAAGAGAGAA-3' | (SEQ ID NO: 16575) |
| C5-3681 | 19 nt | Target #2: | 5'-UUUCAGCUUUGAAGAGAGA-3' | (SEQ ID NO: 18885) |
| C5-3681 | 19 nt | Target #3: | 5'-GUUUCAGCUUUGAAGAGAG-3' | (SEQ ID NO: 21195) |
| C5-3682 | 19 nt | Target #1: | 5'-UCAGCUUUGAAGAGAGAAG-3' | (SEQ ID NO: 16576) |
| C5-3682 | 19 nt | Target #2: | 5'-UUCAGCUUUGAAGAGAGAA-3' | (SEQ ID NO: 18886) |
| C5-3682 | 19 nt | Target #3: | 5'-UUUCAGCUUUGAAGAGAGA-3' | (SEQ ID NO: 21196) |
| C5-3683 | 19 nt | Target #1: | 5'-CAGCUUUGAAGAGAGAAGC-3' | (SEQ ID NO: 16577) |
| C5-3683 | 19 nt | Target #2: | 5'-UCAGCUUUGAAGAGAGAAG-3' | (SEQ ID NO: 18887) |
| C5-3683 | 19 nt | Target #3: | 5'-UUCAGCUUUGAAGAGAGAA-3' | (SEQ ID NO: 21197) |
| C5-3684 | 19 nt | Target #1: | 5'-AGCUUUGAAGAGAGAAGCU-3' | (SEQ ID NO: 16578) |
| C5-3684 | 19 nt | Target #2: | 5'-CAGCUUUGAAGAGAGAAGC-3' | (SEQ ID NO: 18888) |
| C5-3684 | 19 nt | Target #3: | 5'-UCAGCUUUGAAGAGAGAAG-3' | (SEQ ID NO: 21198) |
| C5-3685 | 19 nt | Target #1: | 5'-GCUUUGAAGAGAGAAGCUU-3' | (SEQ ID NO: 16579) |
| C5-3685 | 19 nt | Target #2: | 5'-AGCUUUGAAGAGAGAAGCU-3' | (SEQ ID NO: 18889) |
| C5-3685 | 19 nt | Target #3: | 5'-CAGCUUUGAAGAGAGAAGC-3' | (SEQ ID NO: 21199) |
| C5-3686 | 19 nt | Target #1: | 5'-CUUUGAAGAGAGAAGCUUU-3' | (SEQ ID NO: 16580) |
| C5-3686 | 19 nt | Target #2: | 5'-GCUUUGAAGAGAGAAGCUU-3' | (SEQ ID NO: 18890) |
| C5-3686 | 19 nt | Target #3: | 5'-AGCUUUGAAGAGAGAAGCU-3' | (SEQ ID NO: 21200) |
| C5-3687 | 19 nt | Target #1: | 5'-UUUGAAGAGAGAAGCUUUG-3' | (SEQ ID NO: 16581) |
| C5-3687 | 19 nt | Target #2: | 5'-CUUUGAAGAGAGAAGCUUU-3' | (SEQ ID NO: 18891) |
| C5-3687 | 19 nt | Target #3: | 5'-GCUUUGAAGAGAGAAGCUU-3' | (SEQ ID NO: 21201) |
| C5-3688 | 19 nt | Target #1: | 5'-UUGAAGAGAGAAGCUUUGG-3' | (SEQ ID NO: 16582) |
| C5-3688 | 19 nt | Target #2: | 5'-UUUGAAGAGAGAAGCUUUG-3' | (SEQ ID NO: 18892) |
| C5-3688 | 19 nt | Target #3: | 5'-CUUUGAAGAGAGAAGCUUU-3' | (SEQ ID NO: 21202) |
| C5-3689 | 19 nt | Target #1: | 5'-UGAAGAGAGAAGCUUUGGU-3' | (SEQ ID NO: 16583) |
| C5-3689 | 19 nt | Target #2: | 5'-UUGAAGAGAGAAGCUUUGG-3' | (SEQ ID NO: 18893) |
| C5-3689 | 19 nt | Target #3: | 5'-UUUGAAGAGAGAAGCUUUG-3' | (SEQ ID NO: 21203) |
| C5-3693 | 19 nt | Target #1: | 5'-GAGAGAAGCUUUGGUUAAA-3' | (SEQ ID NO: 16584) |
| C5-3693 | 19 nt | Target #2: | 5'-AGAGAGAAGCUUUGGUUAA-3' | (SEQ ID NO: 18894) |
| C5-3693 | 19 nt | Target #3: | 5'-AAGAGAGAAGCUUUGGUUA-3' | (SEQ ID NO: 21204) |
| C5-3694 | 19 nt | Target #1: | 5'-AGAGAAGCUUUGGUUAAAG-3' | (SEQ ID NO: 16585) |
| C5-3694 | 19 nt | Target #2: | 5'-GAGAGAAGCUUUGGUUAAA-3' | (SEQ ID NO: 18895) |
| C5-3694 | 19 nt | Target #3: | 5'-AGAGAGAAGCUUUGGUUAA-3' | (SEQ ID NO: 21205) |
| C5-3695 | 19 nt | Target #1: | 5'-GAGAAGCUUUGGUUAAAGG-3' | (SEQ ID NO: 16586) |
| C5-3695 | 19 nt | Target #2: | 5'-AGAGAAGCUUUGGUUAAAG-3' | (SEQ ID NO: 18896) |
| C5-3695 | 19 nt | Target #3: | 5'-GAGAGAAGCUUUGGUUAAA-3' | (SEQ ID NO: 21206) |
| C5-3698 | 19 nt | Target #1: | 5'-AAGCUUUGGUUAAAGGUAA-3' | (SEQ ID NO: 16587) |
| C5-3698 | 19 nt | Target #2: | 5'-GAAGCUUUGGUUAAAGGUA-3' | (SEQ ID NO: 18897) |
| C5-3698 | 19 nt | Target #3: | 5'-AGAAGCUUUGGUUAAAGGU-3' | (SEQ ID NO: 21207) |
| C5-3699 | 19 nt | Target #1: | 5'-AGCUUUGGUUAAAGGUAAU-3' | (SEQ ID NO: 16588) |
| C5-3699 | 19 nt | Target #2: | 5'-AAGCUUUGGUUAAAGGUAA-3' | (SEQ ID NO: 18898) |
| C5-3699 | 19 nt | Target #3: | 5'-GAAGCUUUGGUUAAAGGUA-3' | (SEQ ID NO: 21208) |
| C5-3700 | 19 nt | Target #1: | 5'-GCUUUGGUUAAAGGUAAUC-3' | (SEQ ID NO: 16589) |
| C5-3700 | 19 nt | Target #2: | 5'-AGCUUUGGUUAAAGGUAAU-3' | (SEQ ID NO: 18899) |
| C5-3700 | 19 nt | Target #3: | 5'-AAGCUUUGGUUAAAGGUAA-3' | (SEQ ID NO: 21209) |
| C5-3701 | 19 nt | Target #1: | 5'-CUUUGGUUAAAGGUAAUCC-3' | (SEQ ID NO: 16590) |
| C5-3701 | 19 nt | Target #2: | 5'-GCUUUGGUUAAAGGUAAUC-3' | (SEQ ID NO: 18900) |
| C5-3701 | 19 nt | Target #3: | 5'-AGCUUUGGUUAAAGGUAAU-3' | (SEQ ID NO: 21210) |
| C5-3702 | 19 nt | Target #1: | 5'-UUUGGUUAAAGGUAAUCCA-3' | (SEQ ID NO: 16591) |
| C5-3702 | 19 nt | Target #2: | 5'-CUUUGGUUAAAGGUAAUCC-3' | (SEQ ID NO: 18901) |
| C5-3702 | 19 nt | Target #3: | 5'-GCUUUGGUUAAAGGUAAUC-3' | (SEQ ID NO: 21211) |
| C5-3703 | 19 nt | Target #1: | 5'-UUGGUUAAAGGUAAUCCAC-3' | (SEQ ID NO: 16592) |
| C5-3703 | 19 nt | Target #2: | 5'-UUUGGUUAAAGGUAAUCCA-3' | (SEQ ID NO: 18902) |
| C5-3703 | 19 nt | Target #3: | 5'-CUUUGGUUAAAGGUAAUCC-3' | (SEQ ID NO: 21212) |
| C5-3704 | 19 nt | Target #1: | 5'-UGGUUAAAGGUAAUCCACC-3' | (SEQ ID NO: 16593) |
| C5-3704 | 19 nt | Target #2: | 5'-UUGGUUAAAGGUAAUCCAC-3' | (SEQ ID NO: 18903) |
| C5-3704 | 19 nt | Target #3: | 5'-UUUGGUUAAAGGUAAUCCA-3' | (SEQ ID NO: 21213) |
| C5-3705 | 19 nt | Target #1: | 5'-GGUUAAAGGUAAUCCACCC-3' | (SEQ ID NO: 16594) |
| C5-3705 | 19 nt | Target #2: | 5'-UGGUUAAAGGUAAUCCACC-3' | (SEQ ID NO: 18904) |
| C5-3705 | 19 nt | Target #3: | 5'-UUGGUUAAAGGUAAUCCAC-3' | (SEQ ID NO: 21214) |
| C5-3706 | 19 nt | Target #1: | 5'-GUUAAAGGUAAUCCACCCA-3' | (SEQ ID NO: 16595) |
| C5-3706 | 19 nt | Target #2: | 5'-GGUUAAAGGUAAUCCACCC-3' | (SEQ ID NO: 18905) |
| C5-3706 | 19 nt | Target #3: | 5'-UGGUUAAAGGUAAUCCACC-3' | (SEQ ID NO: 21215) |
| C5-3707 | 19 nt | Target #1: | 5'-UUAAAGGUAAUCCACCCAU-3' | (SEQ ID NO: 16596) |
| C5-3707 | 19 nt | Target #2: | 5'-GUUAAAGGUAAUCCACCCA-3' | (SEQ ID NO: 18906) |
| C5-3707 | 19 nt | Target #3: | 5'-GGUUAAAGGUAAUCCACCC-3' | (SEQ ID NO: 21216) |
| C5-3708 | 19 nt | Target #1: | 5'-UAAAGGUAAUCCACCCAUU-3' | (SEQ ID NO: 16597) |

TABLE 10-continued

DsiRNA Component 19 Nucleotide Target Sequences of Human Anti-C5
DsiRNAs Predicted to have >50% Knockdown Efficacy

|

TABLE 10-continued

DsiRNA Component 19 Nucleotide Target Sequences of Human Anti-C5
DsiRNAs Predicted to have >50% Knockdown Efficacy

```
C5-3761

TABLE 10-continued

DsiRNA Component 19 Nucleotide Target Sequences of Human Anti-C5
DsiRNAs Predicted to have >50% Knockdown Efficacy

| | | | | |
|---|---|---|---|---|
| C5-3805 | 19 nt | Target #3: | 5'-CAACUGCCUAUGCUUUACU-3' | (SEQ TABLE 10-continued DsiRNA Component 19 Nucleotide Target Sequences of Human Anti-C5
DsiRNAs Predicted to have >50% Knockdown Efficacy

| |

TABLE 10-continued

DsiRNA Component 19 Nucleotide Target Sequences of Human Anti-C5
DsiRNAs Predicted to have >50% Knockdown Efficacy

| |

TABLE 10-continued

DsiRNA Component 19 Nucleotide Target Sequences of Human Anti-C5
DsiRNAs Predicted to have >50% Knockdown Efficac TABLE 10-continued DsiRNA Component 19 Nucleotide Target Sequences of Human Anti-C5
DsiRNAs Predicted to have >50% Knockdown Efficacy

```
C5-4095  19 nt  Target #2:  5'-UUGUCAGUACAGGAUUUGG-3'  (SEQ ID NO: 19061)
C5-4095  19 nt  Target #3:  5'-AUUGUCAGUACAGGAUUUG-3'  (SEQ ID NO: 21371)
C5-4096  19 nt  Target #1:  5'-GUCAGUACAGGAUUUGGCA-3'  (SEQ ID NO: 16752)
C5-4096  19 nt  Target #2:  5'-UGUCAGUACAGGAUUUGGC-3'  (SEQ ID NO: 19062)
C5-4096  19 nt  Target #3:  5'-UUGUCAGUACAGGAUUUGG-3'  (SEQ ID NO: 21372)
C5-4097  19 nt  Target #1:  5'-UCAGUACAGGAUUUGGCAG-3'  (SEQ ID NO: 16753)
C5-4097  19 nt  Target #2:  5'-GUCAGUACAGGAUUUGGCA-3'  (SEQ ID NO: 19063)
C5-4097  19 nt  Target #3:  5'-UGUCAGUACAGGAUUUGGC-3'  (SEQ ID NO: 21373)
C5-4098  19 nt  Target #1:  5'-CAGUACAGGAUUUGGCAGU-3'  (SEQ ID NO: 16754)
C5-4098  19 nt  Target #2:  5'-UCAGUACAGGAUUUGGCAG-3'  (SEQ ID NO: 19064)
C5-4098  19 nt  Target #3:  5'-GUCAGUACAGGAUUUGGCA-3'  (SEQ ID NO: 21374)
C5-4099  19 nt  Target #1:  5'-AGUACAGGAUUUGGCAGUG-3'  (SEQ ID NO: 16755)
C5-4099  19 nt  Target #2:  5'-CAGUACAGGAUUUGGCAGU-3'  (SEQ ID NO: 19065)
C5-4099  19 nt  Target #3:  5'-UCAGUACAGGAUUUGGCAG-3'  (SEQ ID NO: 21375)
C5-4100  19 nt  Target #1:  5'-GUACAGGAUUUGGCAGUGG-3'  (SEQ ID NO: 16756)
C5-4100  19 nt  Target #2:  5'-AGUACAGGAUUUGGCAGUG-3'  (SEQ ID NO: 19066)
C5-4100  19 nt  Target #3:  5'-CAGUACAGGAUUUGGCAGU-3'  (SEQ ID NO: 21376)
C5-4101  19 nt  Target #1:  5'-UACAGGAUUUGGCAGUGGC-3'  (SEQ ID NO: 16757)
C5-4101  19 nt  Target #2:  5'-GUACAGGAUUUGGCAGUGG-3'  (SEQ ID NO: 19067)
C5-4101  19 nt  Target #3:  5'-AGUACAGGAUUUGGCAGUG-3'  (SEQ ID NO: 21377)
C5-4102  19 nt  Target #1:  5'-ACAGGAUUUGGCAGUGGCU-3'  (SEQ ID NO: 16758)
C5-4102  19 nt  Target #2:  5'-UACAGGAUUUGGCAGUGGC-3'  (SEQ ID NO: 19068)
C5-4102  19 nt  Target #3:  5'-GUACAGGAUUUGGCAGUGG-3'  (SEQ ID NO: 21378)
C5-4103  19 nt  Target #1:  5'-CAGGAUUUGGCAGUGGCUU-3'  (SEQ ID NO: 16759)
C5-4103  19 nt  Target #2:  5'-ACAGGAUUUGGCAGUGGCU-3'  (SEQ ID NO: 19069)
C5-4103  19 nt  Target #3:  5'-UACAGGAUUUGGCAGUGGC-3'  (SEQ ID NO: 21379)
C5-4104  19 nt  Target #1:  5'-AGGAUUUGGCAGUGGCUUG-3'  (SEQ ID NO: 16760)
C5-4104  19 nt  Target #2:  5'-CAGGAUUUGGCAGUGGCUU-3'  (SEQ ID NO: 19070)
C5-4104  19 nt  Target #3:  5'-ACAGGAUUUGGCAGUGGCU-3'  (SEQ ID NO: 21380)
C5-4106  19 nt  Target #1:  5'-GAUUUGGCAGUGGCUUGGC-3'  (SEQ ID NO: 16761)
C5-4106  19 nt  Target #2:  5'-GGAUUUGGCAGUGGCUUGG-3'  (SEQ ID NO: 19071)
C5-4106  19 nt  Target #3:  5'-AGGAUUUGGCAGUGGCUUG-3'  (SEQ ID NO: 21381)
C5-4107  19 nt  Target #1:  5'-AUUUGGCAGUGGCUUGGCU-3'  (SEQ ID NO: 16762)
C5-4107  19 nt  Target #2:  5'-GAUUUGGCAGUGGCUUGGC-3'  (SEQ ID NO: 19072)
C5-4107  19 nt  Target #3:  5'-GGAUUUGGCAGUGGCUUGG-3'  (SEQ ID NO: 21382)
C5-4108  19 nt  Target #1:  5'-UUUGGCAGUGGCUUGGCUA-3'  (SEQ ID NO: 16763)
C5-4108  19 nt  Target #2:  5'-AUUUGGCAGUGGCUUGGCU-3'  (SEQ ID NO: 19073)
C5-4108  19 nt  Target #3:  5'-GAUUUGGCAGUGGCUUGGC-3'  (SEQ ID NO: 21383)
C5-4109  19 nt  Target #1:  5'-UUGGCAGUGGCUUGGCUAC-3'  (SEQ ID NO: 16764)
C5-4109  19 nt  Target #2:  5'-UUUGGCAGUGGCUUGGCUA-3'  (SEQ ID NO: 19074)
C5-4109  19 nt  Target #3:  5'-AUUUGGCAGUGGCUUGGCU-3'  (SEQ ID NO: 21384)
C5-4129  19 nt  Target #1:  5'-GUACAUGUAACAACUGUAG-3'  (SEQ ID NO: 16765)
C5-4129  19 nt  Target #2:  5'-AGUACAUGUAACAACUGUA-3'  (SEQ ID NO: 19075)
C5-4129  19 nt  Target #3:  5'-CAGUACAUGUAACAACUGU-3'  (SEQ ID NO: 21385)
C5-4130  19 nt  Target #1:  5'-UACAUGUAACAACUGUAGU-3'  (SEQ ID NO: 16766)
C5-4130  19 nt  Target #2:  5'-GUACAUGUAACAACUGUAG-3'  (SEQ ID NO: 19076)
C5-4130  19 nt  Target #3:  5'-AGUACAUGUAACAACUGUA-3'  (SEQ ID NO: 21386)
C5-4131  19 nt  Target #1:  5'-ACAUGUAACAACUGUAGUU-3'  (SEQ ID NO: 16767)
C5-4131  19 nt  Target #2:  5'-UACAUGUAACAACUGUAGU-3'  (SEQ ID NO: 19077)
C5-4131  19 nt  Target #3:  5'-GUACAUGUAACAACUGUAG-3'  (SEQ ID NO: 21387)
C5-4133  19 nt  Target #1:  5'-AUGUAACAACUGUAGUUCA-3'  (SEQ ID NO: 16768)
C5-4133  19 nt  Target #2:  5'-CAUGUAACAACUGUAGUUC-3'  (SEQ ID NO: 19078)
C5-4133  19 nt  Target #3:  5'-ACAUGUAACAACUGUAGUU-3'  (SEQ ID NO: 21388)
C5-4134  19 nt  Target #1:  5'-UGUAACAACUGUAGUUCAC-3'  (SEQ ID NO: 16769)
C5-4134  19 nt  Target #2:  5'-AUGUAACAACUGUAGUUCA-3'  (SEQ ID NO: 19079)
C5-4134  19 nt  Target #3:  5'-CAUGUAACAACUGUAGUUC-3'  (SEQ ID NO: 21389)
C5-4135  19 nt  Target #1:  5'-GUAACAACUGUAGUUCACA-3'  (SEQ ID NO: 16770)
C5-4135  19 nt  Target #2:  5'-UGUAACAACUGUAGUUCAC-3'  (SEQ ID NO: 19080)
C5-4135  19 nt  Target #3:  5'-AUGUAACAACUGUAGUUCA-3'  (SEQ ID NO: 21390)
C5-4136  19 nt  Target #1:  5'-UAACAACUGUAGUUCACAA-3'  (SEQ ID NO: 16771)
C5-4136  19 nt  Target #2:  5'-GUAACAACUGUAGUUCACA-3'  (SEQ ID NO: 19081)
C5-4136  19 nt  Target #3:  5'-UGUAACAACUGUAGUUCAC-3'  (SEQ ID NO: 21391)
C5-4137  19 nt  Target #1:  5'-AACAACUGUAGUUCACAAA-3'  (SEQ ID NO: 16772)
C5-4137  19 nt  Target #2:  5'-UAACAACUGUAGUUCACAA-3'  (SEQ ID NO: 19082)
C5-4137  19 nt  Target #3:  5'-GUAACAACUGUAGUUCACA-3'  (SEQ ID NO: 21392)
C5-4138  19 nt  Target #1:  5'-ACAACUGUAGUUCACAAAA-3'  (SEQ ID NO: 16773)
C5-4138  19 nt  Target #2:  5'-AACAACUGUAGUUCACAAA-3'  (SEQ ID NO: 19083)
C5-4138  19 nt  Target #3:  5'-UAACAACUGUAGUUCACAA-3'  (SEQ ID NO: 21393)
C5-4139  19 nt  Target #1:  5'-CAACUGUAGUUCACAAAAC-3'  (SEQ ID NO: 16774)
C5-4139  19 nt  Target #2:  5'-ACAACUGUAGUUCACAAAA-3'  (SEQ ID NO: 19084)
C5-4139  19 nt  Target #3:  5'-AACAACUGUAGUUCACAAA-3'  (SEQ ID NO: 21394)
C5-4140  19 nt  Target #1:  5'-AACUGUAGUUCACAAAACC-3'  (SEQ ID NO: 16775)
C5-4140  19 nt  Target #2:  5'-CAACUGUAGUUCACAAAAC-3'  (SEQ ID NO: 19085)
C5-4140  19 nt  Target #3:  5'-ACAACUGUAGUUCACAAAA-3'  (SEQ ID NO: 21395)
C5-4141  19 nt  Target #1:  5'-ACUGUAGUUCACAAAACCA-3'  (SEQ ID NO: 16776)
C5-4141  19 nt  Target #2:  5'-AACUGUAGUUCACAAAACC-3'  (SEQ ID NO: 19086)
C5-4141  19 nt  Target #3:  5'-CAACUGUAGUUCACAAAAC-3'  (SEQ ID NO: 21396)
```

TABLE 10-continued

DsiRNA Component 19 Nucleotide Target Sequences of Human Anti-C5
DsiRNAs Predicted to have >50% Knockdown Efficacy

| | | | | |
|---|---|---|---|---|
| C5-4142 | 19 nt | Target #1: | 5'-CUGUAGUUCACAAAACCAG-3' | (SEQ ID NO: 16777) |
| C5-4142 | 19 nt | Target #2: | 5'-ACUGUAGUUCACAAAACCA-3' | (SEQ ID NO: 19087) |
| C5-4142 | 19 nt | Target #3: | 5'-AACUGUAGUUCACAAAACC-3' | (SEQ ID NO: 21397) |
| C5-4143 | 19 nt | Target #1: | 5'-UGUAGUUCACAAAACCAGU-3' | (SEQ ID NO: 16778) |
| C5-4143 | 19 nt | Target #2: | 5'-CUGUAGUUCACAAAACCAG-3' | (SEQ ID NO: 19088) |
| C5-4143 | 19 nt | Target #3: | 5'-ACUGUAGUUCACAAAACCA-3' | (SEQ ID NO: 21398) |
| C5-4144 | 19 nt | Target #1: | 5'-GUAGUUCACAAAACCAGUA-3' | (SEQ ID NO: 16779) |
| C5-4144 | 19 nt | Target #2: | 5'-UGUAGUUCACAAAACCAGU-3' | (SEQ ID NO: 19089) |
| C5-4144 | 19 nt | Target #3: | 5'-CUGUAGUUCACAAAACCAG-3' | (SEQ ID NO: 21399) |
| C5-4145 | 19 nt | Target #1: | 5'-UAGUUCACAAAACCAGUAC-3' | (SEQ ID NO: 16780) |
| C5-4145 | 19 nt | Target #2: | 5'-GUAGUUCACAAAACCAGUA-3' | (SEQ ID NO: 19090) |
| C5-4145 | 19 nt | Target #3: | 5'-UGUAGUUCACAAAACCAGU-3' | (SEQ ID NO: 21400) |
| C5-4146 | 19 nt | Target #1: | 5'-AGUUCACAAAACCAGUACC-3' | (SEQ ID NO: 16781) |
| C5-4146 | 19 nt | Target #2: | 5'-UAGUUCACAAAACCAGUAC-3' | (SEQ ID NO: 19091) |
| C5-4146 | 19 nt | Target #3: | 5'-GUAGUUCACAAAACCAGUA-3' | (SEQ ID NO: 21401) |
| C5-4147 | 19 nt | Target #1: | 5'-GUUCACAAAACCAGUACCU-3' | (SEQ ID NO: 16782) |
| C5-4147 | 19 nt | Target #2: | 5'-AGUUCACAAAACCAGUACC-3' | (SEQ ID NO: 19092) |
| C5-4147 | 19 nt | Target #3: | 5'-UAGUUCACAAAACCAGUAC-3' | (SEQ ID NO: 21402) |
| C5-4148 | 19 nt | Target #1: | 5'-UUCACAAAACCAGUACCUC-3' | (SEQ ID NO: 16783) |
| C5-4148 | 19 nt | Target #2: | 5'-GUUCACAAAACCAGUACCU-3' | (SEQ ID NO: 19093) |
| C5-4148 | 19 nt | Target #3: | 5'-AGUUCACAAAACCAGUACC-3' | (SEQ ID NO: 21403) |
| C5-4149 | 19 nt | Target #1: | 5'-UCACAAAACCAGUACCUCU-3' | (SEQ ID NO: 16784) |
| C5-4149 | 19 nt | Target #2: | 5'-UUCACAAAACCAGUACCUC-3' | (SEQ ID NO: 19094) |
| C5-4149 | 19 nt | Target #3: | 5'-GUUCACAAAACCAGUACCU-3' | (SEQ ID NO: 21404) |
| C5-4150 | 19 nt | Target #1: | 5'-CACAAAACCAGUACCUCUG-3' | (SEQ ID NO: 16785) |
| C5-4150 | 19 nt | Target #2: | 5'-UCACAAAACCAGUACCUCU-3' | (SEQ ID NO: 19095) |
| C5-4150 | 19 nt | Target #3: | 5'-UUCACAAAACCAGUACCUC-3' | (SEQ ID NO: 21405) |
| C5-4151 | 19 nt | Target #1: | 5'-ACAAAACCAGUACCUCUGA-3' | (SEQ ID NO: 16786) |
| C5-4151 | 19 nt | Target #2: | 5'-CACAAAACCAGUACCUCUG-3' | (SEQ ID NO: 19096) |
| C5-4151 | 19 nt | Target #3: | 5'-UCACAAAACCAGUACCUCU-3' | (SEQ ID NO: 21406) |
| C5-4152 | 19 nt | Target #1: | 5'-CAAAACCAGUACCUCUGAG-3' | (SEQ ID NO: 16787) |
| C5-4152 | 19 nt | Target #2: | 5'-ACAAAACCAGUACCUCUGA-3' | (SEQ ID NO: 19097) |
| C5-4152 | 19 nt | Target #3: | 5'-CACAAAACCAGUACCUCUG-3' | (SEQ ID NO: 21407) |
| C5-4153 | 19 nt | Target #1: | 5'-AAAACCAGUACCUCUGAGG-3' | (SEQ ID NO: 16788) |
| C5-4153 | 19 nt | Target #2: | 5'-CAAAACCAGUACCUCUGAG-3' | (SEQ ID NO: 19098) |
| C5-4153 | 19 nt | Target #3: | 5'-ACAAAACCAGUACCUCUGA-3' | (SEQ ID NO: 21408) |
| C5-4154 | 19 nt | Target #1: | 5'-AAACCAGUACCUCUGAGGA-3' | (SEQ ID NO: 16789) |
| C5-4154 | 19 nt | Target #2: | 5'-AAAACCAGUACCUCUGAGG-3' | (SEQ ID NO: 19099) |
| C5-4154 | 19 nt | Target #3: | 5'-CAAAACCAGUACCUCUGAG-3' | (SEQ ID NO: 21409) |
| C5-4155 | 19 nt | Target #1: | 5'-AACCAGUACCUCUGAGGAA-3' | (SEQ ID NO: 16790) |
| C5-4155 | 19 nt | Target #2: | 5'-AAACCAGUACCUCUGAGGA-3' | (SEQ ID NO: 19100) |
| C5-4155 | 19 nt | Target #3: | 5'-AAAACCAGUACCUCUGAGG-3' | (SEQ ID NO: 21410) |
| C5-4156 | 19 nt | Target #1: | 5'-ACCAGUACCUCUGAGGAAG-3' | (SEQ ID NO: 16791) |
| C5-4156 | 19 nt | Target #2: | 5'-AACCAGUACCUCUGAGGAA-3' | (SEQ ID NO: 19101) |
| C5-4156 | 19 nt | Target #3: | 5'-AAACCAGUACCUCUGAGGA-3' | (SEQ ID NO: 21411) |
| C5-4157 | 19 nt | Target #1: | 5'-CCAGUACCUCUGAGGAAGU-3' | (SEQ ID NO: 16792) |
| C5-4157 | 19 nt | Target #2: | 5'-ACCAGUACCUCUGAGGAAG-3' | (SEQ ID NO: 19102) |
| C5-4157 | 19 nt | Target #3: | 5'-AACCAGUACCUCUGAGGAA-3' | (SEQ ID NO: 21412) |
| C5-4158 | 19 nt | Target #1: | 5'-CAGUACCUCUGAGGAAGUU-3' | (SEQ ID NO: 16793) |
| C5-4158 | 19 nt | Target #2: | 5'-CCAGUACCUCUGAGGAAGU-3' | (SEQ ID NO: 19103) |
| C5-4158 | 19 nt | Target #3: | 5'-ACCAGUACCUCUGAGGAAG-3' | (SEQ ID NO: 21413) |
| C5-4159 | 19 nt | Target #1: | 5'-AGUACCUCUGAGGAAGUUU-3' | (SEQ ID NO: 16794) |
| C5-4159 | 19 nt | Target #2: | 5'-CAGUACCUCUGAGGAAGUU-3' | (SEQ ID NO: 19104) |
| C5-4159 | 19 nt | Target #3: | 5'-CCAGUACCUCUGAGGAAGU-3' | (SEQ ID NO: 21414) |
| C5-4160 | 19 nt | Target #1: | 5'-GUACCUCUGAGGAAGUUUG-3' | (SEQ ID NO: 16795) |
| C5-4160 | 19 nt | Target #2: | 5'-AGUACCUCUGAGGAAGUUU-3' | (SEQ ID NO: 19105) |
| C5-4160 | 19 nt | Target #3: | 5'-CAGUACCUCUGAGGAAGUU-3' | (SEQ ID NO: 21415) |
| C5-4161 | 19 nt | Target #1: | 5'-UACCUCUGAGGAAGUUUGC-3' | (SEQ ID NO: 16796) |
| C5-4161 | 19 nt | Target #2: | 5'-GUACCUCUGAGGAAGUUUG-3' | (SEQ ID NO: 19106) |
| C5-4161 | 19 nt | Target #3: | 5'-AGUACCUCUGAGGAAGUUU-3' | (SEQ ID NO: 21416) |
| C5-4162 | 19 nt | Target #1: | 5'-ACCUCUGAGGAAGUUUGCA-3' | (SEQ ID NO: 16797) |
| C5-4162 | 19 nt | Target #2: | 5'-UACCUCUGAGGAAGUUUGC-3' | (SEQ ID NO: 19107) |
| C5-4162 | 19 nt | Target #3: | 5'-GUACCUCUGAGGAAGUUUG-3' | (SEQ ID NO: 21417) |
| C5-4163 | 19 nt | Target #1: | 5'-CCUCUGAGGAAGUUUGCAG-3' | (SEQ ID NO: 16798) |
| C5-4163 | 19 nt | Target #2: | 5'-ACCUCUGAGGAAGUUUGCA-3' | (SEQ ID NO: 19108) |
| C5-4163 | 19 nt | Target #3: | 5'-UACCUCUGAGGAAGUUUGC-3' | (SEQ ID NO: 21418) |
| C5-4164 | 19 nt | Target #1: | 5'-CUCUGAGGAAGUUUGCAGC-3' | (SEQ ID NO: 16799) |
| C5-4164 | 19 nt | Target #2: | 5'-CCUCUGAGGAAGUUUGCAG-3' | (SEQ ID NO: 19109) |
| C5-4164 | 19 nt | Target #3: | 5'-ACCUCUGAGGAAGUUUGCA-3' | (SEQ ID NO: 21419) |
| C5-4165 | 19 nt | Target #1: | 5'-UCUGAGGAAGUUUGCAGCU-3' | (SEQ ID NO: 16800) |
| C5-4165 | 19 nt | Target #2: | 5'-CUCUGAGGAAGUUUGCAGC-3' | (SEQ ID NO: 19110) |
| C5-4165 | 19 nt | Target #3: | 5'-CCUCUGAGGAAGUUUGCAG-3' | (SEQ ID NO: 21420) |
| C5-4166 | 19 nt | Target #1: | 5'-CUGAGGAAGUUUGCAGCUU-3' | (SEQ ID NO: 16801) |
| C5-4166 | 19 nt | Target #2: | 5'-UCUGAGGAAGUUUGCAGCU-3' | (SEQ ID NO: 19111) |
| C5-4166 | 19 nt | Target #3: | 5'-CUCUGAGGAAGUUUGCAGC-3' | (SEQ ID NO: 21421) |
| C5-4167 | 19 nt | Target #1: | 5'-UGAGGAAGUUUGCAGCUUU-3' | (SEQ ID NO: 16802) |
| C5-4167 | 19 nt | Target #2: | 5'-CUGAGGAAGUUUGCAGCUU-3' | (SEQ ID NO: 19112) |

TABLE 10-continued

| DsiRNA Component 19 Nucleotide Target Sequences of Human Anti-C5 DsiRNAs Predicted to have >50% Knockdown Efficacy | | | | |
|---|---|---|---|---|
| C5-4167 | 19 nt | Target #3: | 5'-UCUGAGGAAGUUUGCAGCU-3' | (SEQ ID NO: 21422) |
| C5-4176 | 19 nt | Target #1: | 5'-UUGCAGCUUUUAUUUGAAA-3' | (SEQ ID NO: 16803) |
| C5-4176 | 19 nt | Target #2: | 5'-UUUGCAGCUUUUAUUUGAA-3' | (SEQ ID NO: 19113) |
| C5-4176 | 19 nt | Target #3: | 5'-GUUUGCAGCUUUUAUUUGA-3' | (SEQ ID NO: 21423) |
| C5-4177 | 19 nt | Target #1: | 5'-UGCAGCUUUUAUUUGAAAA-3' | (SEQ ID NO: 16804) |
| C5-4177 | 19 nt | Target #2: | 5'-UUGCAGCUUUUAUUUGAAA-3' | (SEQ ID NO: 19114) |
| C5-4177 | 19 nt | Target #3: | 5'-UUUGCAGCUUUUAUUUGAA-3' | (SEQ ID NO: 21424) |
| C5-4198 | 19 nt | Target #1: | 5'-GAUACUCAGGAUAUUGAAG-3' | (SEQ ID NO: 16805) |
| C5-4198 | 19 nt | Target #2: | 5'-CGAUACUCAGGAUAUUGAA-3' | (SEQ ID NO: 19115) |
| C5-4198 | 19 nt | Target #3: | 5'-UCGAUACUCAGGAUAUUGA-3' | (SEQ ID NO: 21425) |
| C5-4200 | 19 nt | Target #1: | 5'-UACUCAGGAUAUUGAAGCA-3' | (SEQ ID NO: 16806) |
| C5-4200 | 19 nt | Target #2: | 5'-AUACUCAGGAUAUUGAAGC-3' | (SEQ ID NO: 19116) |
| C5-4200 | 19 nt | Target #3: | 5'-GAUACUCAGGAUAUUGAAG-3' | (SEQ ID NO: 21426) |
| C5-4201 | 19 nt | Target #1: | 5'-ACUCAGGAUAUUGAAGCAU-3' | (SEQ ID NO: 16807) |
| C5-4201 | 19 nt | Target #2: | 5'-UACUCAGGAUAUUGAAGCA-3' | (SEQ ID NO: 19117) |
| C5-4201 | 19 nt | Target #3: | 5'-AUACUCAGGAUAUUGAAGC-3' | (SEQ ID NO: 21427) |
| C5-4202 | 19 nt | Target #1: | 5'-CUCAGGAUAUUGAAGCAUC-3' | (SEQ ID NO: 16808) |
| C5-4202 | 19 nt | Target #2: | 5'-ACUCAGGAUAUUGAAGCAU-3' | (SEQ ID NO: 19118) |
| C5-4202 | 19 nt | Target #3: | 5'-UACUCAGGAUAUUGAAGCA-3' | (SEQ ID NO: 21428) |
| C5-4203 | 19 nt | Target #1: | 5'-UCAGGAUAUUGAAGCAUCC-3' | (SEQ ID NO: 16809) |
| C5-4203 | 19 nt | Target #2: | 5'-CUCAGGAUAUUGAAGCAUC-3' | (SEQ ID NO: 19119) |
| C5-4203 | 19 nt | Target #3: | 5'-ACUCAGGAUAUUGAAGCAU-3' | (SEQ ID NO: 21429) |
| C5-4205 | 19 nt | Target #1: | 5'-AGGAUAUUGAAGCAUCCCA-3' | (SEQ ID NO: 16810) |
| C5-4205 | 19 nt | Target #2: | 5'-CAGGAUAUUGAAGCAUCCC-3' | (SEQ ID NO: 19120) |
| C5-4205 | 19 nt | Target #3: | 5'-UCAGGAUAUUGAAGCAUCC-3' | (SEQ ID NO: 21430) |
| C5-4206 | 19 nt | Target #1: | 5'-GGAUAUUGAAGCAUCCCAC-3' | (SEQ ID NO: 16811) |
| C5-4206 | 19 nt | Target #2: | 5'-AGGAUAUUGAAGCAUCCCA-3' | (SEQ ID NO: 19121) |
| C5-4206 | 19 nt | Target #3: | 5'-CAGGAUAUUGAAGCAUCCC-3' | (SEQ ID NO: 21431) |
| C5-4207 | 19 nt | Target #1: | 5'-GAUAUUGAAGCAUCCCACU-3' | (SEQ ID NO: 16812) |
| C5-4207 | 19 nt | Target #2: | 5'-GGAUAUUGAAGCAUCCCAC-3' | (SEQ ID NO: 19122) |
| C5-4207 | 19 nt | Target #3: | 5'-AGGAUAUUGAAGCAUCCCA-3' | (SEQ ID NO: 21432) |
| C5-4208 | 19 nt | Target #1: | 5'-AUAUUGAAGCAUCCCACUA-3' | (SEQ ID NO: 16813) |
| C5-4208 | 19 nt | Target #2: | 5'-GAUAUUGAAGCAUCCCACU-3' | (SEQ ID NO: 19123) |
| C5-4208 | 19 nt | Target #3: | 5'-GGAUAUUGAAGCAUCCCAC-3' | (SEQ ID NO: 21433) |
| C5-4209 | 19 nt | Target #1: | 5'-UAUUGAAGCAUCCCACUAC-3' | (SEQ ID NO: 16814) |
| C5-4209 | 19 nt | Target #2: | 5'-AUAUUGAAGCAUCCCACUA-3' | (SEQ ID NO: 19124) |
| C5-4209 | 19 nt | Target #3: | 5'-GAUAUUGAAGCAUCCCACU-3' | (SEQ ID NO: 21434) |
| C5-4210 | 19 nt | Target #1: | 5'-AUUGAAGCAUCCCACUACA-3' | (SEQ ID NO: 16815) |
| C5-4210 | 19 nt | Target #2: | 5'-UAUUGAAGCAUCCCACUAC-3' | (SEQ ID NO: 19125) |
| C5-4210 | 19 nt | Target #3: | 5'-AUAUUGAAGCAUCCCACUA-3' | (SEQ ID NO: 21435) |
| C5-4211 | 19 nt | Target #1: | 5'-UUGAAGCAUCCCACUACAG-3' | (SEQ ID NO: 16816) |
| C5-4211 | 19 nt | Target #2: | 5'-AUUGAAGCAUCCCACUACA-3' | (SEQ ID NO: 19126) |
| C5-4211 | 19 nt | Target #3: | 5'-UAUUGAAGCAUCCCACUAC-3' | (SEQ ID NO: 21436) |
| C5-4212 | 19 nt | Target #1: | 5'-UGAAGCAUCCCACUACAGA-3' | (SEQ ID NO: 16817) |
| C5-4212 | 19 nt | Target #2: | 5'-UUGAAGCAUCCCACUACAG-3' | (SEQ ID NO: 19127) |
| C5-4212 | 19 nt | Target #3: | 5'-AUUGAAGCAUCCCACUACA-3' | (SEQ ID NO: 21437) |
| C5-4213 | 19 nt | Target #1: | 5'-GAAGCAUCCCACUACAGAG-3' | (SEQ ID NO: 16818) |
| C5-4213 | 19 nt | Target #2: | 5'-UGAAGCAUCCCACUACAGA-3' | (SEQ ID NO: 19128) |
| C5-4213 | 19 nt | Target #3: | 5'-UUGAAGCAUCCCACUACAG-3' | (SEQ ID NO: 21438) |
| C5-4214 | 19 nt | Target #1: | 5'-AAGCAUCCCACUACAGAGG-3' | (SEQ ID NO: 16819) |
| C5-4214 | 19 nt | Target #2: | 5'-GAAGCAUCCCACUACAGAG-3' | (SEQ ID NO: 19129) |
| C5-4214 | 19 nt | Target #3: | 5'-UGAAGCAUCCCACUACAGA-3' | (SEQ ID NO: 21439) |
| C5-4215 | 19 nt | Target #1: | 5'-AGCAUCCCACUACAGAGGC-3' | (SEQ ID NO: 16820) |
| C5-4215 | 19 nt | Target #2: | 5'-AAGCAUCCCACUACAGAGG-3' | (SEQ ID NO: 19130) |
| C5-4215 | 19 nt | Target #3: | 5'-GAAGCAUCCCACUACAGAG-3' | (SEQ ID NO: 21440) |
| C5-4216 | 19 nt | Target #1: | 5'-GCAUCCCACUACAGAGGCU-3' | (SEQ ID NO: 16821) |
| C5-4216 | 19 nt | Target #2: | 5'-AGCAUCCCACUACAGAGGC-3' | (SEQ ID NO: 19131) |
| C5-4216 | 19 nt | Target #3: | 5'-AAGCAUCCCACUACAGAGG-3' | (SEQ ID NO: 21441) |
| C5-4217 | 19 nt | Target #1: | 5'-CAUCCCACUACAGAGGCUA-3' | (SEQ ID NO: 16822) |
| C5-4217 | 19 nt | Target #2: | 5'-GCAUCCCACUACAGAGGCU-3' | (SEQ ID NO: 19132) |
| C5-4217 | 19 nt | Target #3: | 5'-AGCAUCCCACUACAGAGGC-3' | (SEQ ID NO: 21442) |
| C5-4218 | 19 nt | Target #1: | 5'-AUCCCACUACAGAGGCUAC-3' | (SEQ ID NO: 16823) |
| C5-4218 | 19 nt | Target #2: | 5'-CAUCCCACUACAGAGGCUA-3' | (SEQ ID NO: 19133) |
| C5-4218 | 19 nt | Target #3: | 5'-GCAUCCCACUACAGAGGCU-3' | (SEQ ID NO: 21443) |
| C5-4219 | 19 nt | Target #1: | 5'-UCCCACUACAGAGGCUACG-3' | (SEQ ID NO: 16824) |
| C5-4219 | 19 nt | Target #2: | 5'-AUCCCACUACAGAGGCUAC-3' | (SEQ ID NO: 19134) |
| C5-4219 | 19 nt | Target #3: | 5'-CAUCCCACUACAGAGGCUA-3' | (SEQ ID NO: 21444) |
| C5-4220 | 19 nt | Target #1: | 5'-CCCACUACAGAGGCUACGG-3' | (SEQ ID NO: 16825) |
| C5-4220 | 19 nt | Target #2: | 5'-UCCCACUACAGAGGCUACG-3' | (SEQ ID NO: 19135) |
| C5-4220 | 19 nt | Target #3: | 5'-AUCCCACUACAGAGGCUAC-3' | (SEQ ID NO: 21445) |
| C5-4221 | 19 nt | Target #1: | 5'-CCACUACAGAGGCUACGGA-3' | (SEQ ID NO: 16826) |
| C5-4221 | 19 nt | Target #2: | 5'-CCCACUACAGAGGCUACGG-3' | (SEQ ID NO: 19136) |
| C5-4221 | 19 nt | Target #3: | 5'-UCCCACUACAGAGGCUACG-3' | (SEQ ID NO: 21446) |
| C5-4222 | 19 nt | Target #1: | 5'-CACUACAGAGGCUACGGAA-3' | (SEQ ID NO: 16827) |
| C5-4222 | 19 nt | Target #2: | 5'-CCACUACAGAGGCUACGGA-3' | (SEQ ID NO: 19137) |
| C5-4222 | 19 nt | Target #3: | 5'-CCCACUACAGAGGCUACGG-3' | (SEQ ID NO: 21447) |
| C5-4223 | 19 nt | Target #1: | 5'-ACUACAGAGGCUACGGAAA-3' | (SEQ ID NO: 16828) |

TABLE 10-continued

DsiRNA Component 19 Nucleotide Target Sequences of Human Anti-C5 DsiRNAs Predicted to have >50% Knockdown Efficacy

| | | | | |
|---|---|---|---|---|
| C5-4223 | 19 nt | Target #2: | 5'-CACUACAGAGGCUACGGAA-3' | (SEQ ID NO: 19138) |
| C5-4223 | 19 nt | Target #3: | 5'-CCACUACAGAGGCUACGGA-3' | (SEQ ID NO: 21448) |
| C5-4224 | 19 nt | Target #1: | 5'-CUACAGAGGCUACGGAAAC-3' | (SEQ ID NO: 16829) |
| C5-4224 | 19 nt | Target #2: | 5'-ACUACAGAGGCUACGGAAA-3' | (SEQ ID NO: 19139) |
| C5-4224 | 19 nt | Target #3: | 5'-CACUACAGAGGCUACGGAA-3' | (SEQ ID NO: 21449) |
| C5-4225 | 19 nt | Target #1: | 5'-UACAGAGGCUACGGAAACU-3' | (SEQ ID NO: 16830) |
| C5-4225 | 19 nt | Target #2: | 5'-CUACAGAGGCUACGGAAAC-3' | (SEQ ID NO: 19140) |
| C5-4225 | 19 nt | Target #3: | 5'-ACUACAGAGGCUACGGAAA-3' | (SEQ ID NO: 21450) |
| C5-4226 | 19 nt | Target #1: | 5'-ACAGAGGCUACGGAAACUC-3' | (SEQ ID NO: 16831) |
| C5-4226 | 19 nt | Target #2: | 5'-UACAGAGGCUACGGAAACU-3' | (SEQ ID NO: 19141) |
| C5-4226 | 19 nt | Target #3: | 5'-CUACAGAGGCUACGGAAAC-3' | (SEQ ID NO: 21451) |
| C5-4227 | 19 nt | Target #1: | 5'-CAGAGGCUACGGAAACUCU-3' | (SEQ ID NO: 16832) |
| C5-4227 | 19 nt | Target #2: | 5'-ACAGAGGCUACGGAAACUC-3' | (SEQ ID NO: 19142) |
| C5-4227 | 19 nt | Target #3: | 5'-UACAGAGGCUACGGAAACU-3' | (SEQ ID NO: 21452) |
| C5-4228 | 19 nt | Target #1: | 5'-AGAGGCUACGGAAACUCUG-3' | (SEQ ID NO: 16833) |
| C5-4228 | 19 nt | Target #2: | 5'-CAGAGGCUACGGAAACUCU-3' | (SEQ ID NO: 19143) |
| C5-4228 | 19 nt | Target #3: | 5'-ACAGAGGCUACGGAAACUC-3' | (SEQ ID NO: 21453) |
| C5-4229 | 19 nt | Target #1: | 5'-GAGGCUACGGAAACUCUGA-3' | (SEQ ID NO: 16834) |
| C5-4229 | 19 nt | Target #2: | 5'-AGAGGCUACGGAAACUCUG-3' | (SEQ ID NO: 19144) |
| C5-4229 | 19 nt | Target #3: | 5'-CAGAGGCUACGGAAACUCU-3' | (SEQ ID NO: 21454) |
| C5-4230 | 19 nt | Target #1: | 5'-AGGCUACGGAAACUCUGAU-3' | (SEQ ID NO: 16835) |
| C5-4230 | 19 nt | Target #2: | 5'-GAGGCUACGGAAACUCUGA-3' | (SEQ ID NO: 19145) |
| C5-4230 | 19 nt | Target #3: | 5'-AGAGGCUACGGAAACUCUG-3' | (SEQ ID NO: 21455) |
| C5-4231 | 19 nt | Target #1: | 5'-GGCUACGGAAACUCUGAUU-3' | (SEQ ID NO: 16836) |
| C5-4231 | 19 nt | Target #2: | 5'-AGGCUACGGAAACUCUGAU-3' | (SEQ ID NO: 19146) |
| C5-4231 | 19 nt | Target #3: | 5'-GAGGCUACGGAAACUCUGA-3' | (SEQ ID NO: 21456) |
| C5-4232 | 19 nt | Target #1: | 5'-GCUACGGAAACUCUGAUUA-3' | (SEQ ID NO: 16837) |
| C5-4232 | 19 nt | Target #2: | 5'-GGCUACGGAAACUCUGAUU-3' | (SEQ ID NO: 19147) |
| C5-4232 | 19 nt | Target #3: | 5'-AGGCUACGGAAACUCUGAU-3' | (SEQ ID NO: 21457) |
| C5-4233 | 19 nt | Target #1: | 5'-CUACGGAAACUCUGAUUAC-3' | (SEQ ID NO: 16838) |
| C5-4233 | 19 nt | Target #2: | 5'-GCUACGGAAACUCUGAUUA-3' | (SEQ ID NO: 19148) |
| C5-4233 | 19 nt | Target #3: | 5'-GGCUACGGAAACUCUGAUU-3' | (SEQ ID NO: 21458) |
| C5-4234 | 19 nt | Target #1: | 5'-UACGGAAACUCUGAUUACA-3' | (SEQ ID NO: 16839) |
| C5-4234 | 19 nt | Target #2: | 5'-CUACGGAAACUCUGAUUAC-3' | (SEQ ID NO: 19149) |
| C5-4234 | 19 nt | Target #3: | 5'-GCUACGGAAACUCUGAUUA-3' | (SEQ ID NO: 21459) |
| C5-4235 | 19 nt | Target #1: | 5'-ACGGAAACUCUGAUUACAA-3' | (SEQ ID NO: 16840) |
| C5-4235 | 19 nt | Target #2: | 5'-UACGGAAACUCUGAUUACA-3' | (SEQ ID NO: 19150) |
| C5-4235 | 19 nt | Target #3: | 5'-CUACGGAAACUCUGAUUAC-3' | (SEQ ID NO: 21460) |
| C5-4236 | 19 nt | Target #1: | 5'-CGGAAACUCUGAUUACAAA-3' | (SEQ ID NO: 16841) |
| C5-4236 | 19 nt | Target #2: | 5'-ACGGAAACUCUGAUUACAA-3' | (SEQ ID NO: 19151) |
| C5-4236 | 19 nt | Target #3: | 5'-UACGGAAACUCUGAUUACA-3' | (SEQ ID NO: 21461) |
| C5-4237 | 19 nt | Target #1: | 5'-GGAAACUCUGAUUACAAAC-3' | (SEQ ID NO: 16842) |
| C5-4237 | 19 nt | Target #2: | 5'-CGGAAACUCUGAUUACAAA-3' | (SEQ ID NO: 19152) |
| C5-4237 | 19 nt | Target #3: | 5'-ACGGAAACUCUGAUUACAA-3' | (SEQ ID NO: 21462) |
| C5-4238 | 19 nt | Target #1: | 5'-GAAACUCUGAUUACAAACG-3' | (SEQ ID NO: 16843) |
| C5-4238 | 19 nt | Target #2: | 5'-GGAAACUCUGAUUACAAAC-3' | (SEQ ID NO: 19153) |
| C5-4238 | 19 nt | Target #3: | 5'-CGGAAACUCUGAUUACAAA-3' | (SEQ ID NO: 21463) |
| C5-4239 | 19 nt | Target #1: | 5'-AAACUCUGAUUACAAACGC-3' | (SEQ ID NO: 16844) |
| C5-4239 | 19 nt | Target #2: | 5'-GAAACUCUGAUUACAAACG-3' | (SEQ ID NO: 19154) |
| C5-4239 | 19 nt | Target #3: | 5'-GGAAACUCUGAUUACAAAC-3' | (SEQ ID NO: 21464) |
| C5-4240 | 19 nt | Target #1: | 5'-AACUCUGAUUACAAACGCA-3' | (SEQ ID NO: 16845) |
| C5-4240 | 19 nt | Target #2: | 5'-AAACUCUGAUUACAAACGC-3' | (SEQ ID NO: 19155) |
| C5-4240 | 19 nt | Target #3: | 5'-GAAACUCUGAUUACAAACG-3' | (SEQ ID NO: 21465) |
| C5-4241 | 19 nt | Target #1: | 5'-ACUCUGAUUACAAACGCAU-3' | (SEQ ID NO: 16846) |
| C5-4241 | 19 nt | Target #2: | 5'-AACUCUGAUUACAAACGCA-3' | (SEQ ID NO: 19156) |
| C5-4241 | 19 nt | Target #3: | 5'-AAACUCUGAUUACAAACGC-3' | (SEQ ID NO: 21466) |
| C5-4242 | 19 nt | Target #1: | 5'-CUCUGAUUACAAACGCAUA-3' | (SEQ ID NO: 16847) |
| C5-4242 | 19 nt | Target #2: | 5'-ACUCUGAUUACAAACGCAU-3' | (SEQ ID NO: 19157) |
| C5-4242 | 19 nt | Target #3: | 5'-AACUCUGAUUACAAACGCA-3' | (SEQ ID NO: 21467) |
| C5-4243 | 19 nt | Target #1: | 5'-UCUGAUUACAAACGCAUAG-3' | (SEQ ID NO: 16848) |
| C5-4243 | 19 nt | Target #2: | 5'-CUCUGAUUACAAACGCAUA-3' | (SEQ ID NO: 19158) |
| C5-4243 | 19 nt | Target #3: | 5'-ACUCUGAUUACAAACGCAU-3' | (SEQ ID NO: 21468) |
| C5-4244 | 19 nt | Target #1: | 5'-CUGAUUACAAACGCAUAGU-3' | (SEQ ID NO: 16849) |
| C5-4244 | 19 nt | Target #2: | 5'-UCUGAUUACAAACGCAUAG-3' | (SEQ ID NO: 19159) |
| C5-4244 | 19 nt | Target #3: | 5'-CUCUGAUUACAAACGCAUA-3' | (SEQ ID NO: 21469) |
| C5-4245 | 19 nt | Target #1: | 5'-UGAUUACAAACGCAUAGUA-3' | (SEQ ID NO: 16850) |
| C5-4245 | 19 nt | Target #2: | 5'-CUGAUUACAAACGCAUAGU-3' | (SEQ ID NO: 19160) |
| C5-4245 | 19 nt | Target #3: | 5'-UCUGAUUACAAACGCAUAG-3' | (SEQ ID NO: 21470) |
| C5-4246 | 19 nt | Target #1: | 5'-GAUUACAAACGCAUAGUAG-3' | (SEQ ID NO: 16851) |
| C5-4246 | 19 nt | Target #2: | 5'-UGAUUACAAACGCAUAGUA-3' | (SEQ ID NO: 19161) |
| C5-4246 | 19 nt | Target #3: | 5'-CUGAUUACAAACGCAUAGU-3' | (SEQ ID NO: 21471) |
| C5-4247 | 19 nt | Target #1: | 5'-AUUACAAACGCAUAGUAGC-3' | (SEQ ID NO: 16852) |
| C5-4247 | 19 nt | Target #2: | 5'-GAUUACAAACGCAUAGUAG-3' | (SEQ ID NO: 19162) |
| C5-4247 | 19 nt | Target #3: | 5'-UGAUUACAAACGCAUAGUA-3' | (SEQ ID NO: 21472) |
| C5-4248 | 19 nt | Target #1: | 5'-UUACAAACGCAUAGUAGCA-3' | (SEQ ID NO: 16853) |
| C5-4248 | 19 nt | Target #2: | 5'-AUUACAAACGCAUAGUAGC-3' | (SEQ ID NO: 19163) |
| C5-4248 | 19 nt | Target #3: | 5'-GAUUACAAACGCAUAGUAG-3' | (SEQ ID NO: 21473) |

TABLE 10-continued

DsiRNA Component 19 Nucleotide Target Sequences of Human Anti-C5
DsiRNAs Predicted to have >50% Knockdown Efficacy

| | | | | |
|---|---|---|---|---|
| C5-4249 | 19 nt | Target #1: | 5'-UACAAACGCAUAGUAGCAU-3' | (SEQ ID NO: 16854) |
| C5-4249 | 19 nt | Target #2: | 5'-UUACAAACGCAUAGUAGCA-3' | (SEQ ID NO: 19164) |
| C5-4249 | 19 nt | Target #3: | 5'-AUUACAAACGCAUAGUAGC-3' | (SEQ ID NO: 21474) |
| C5-4250 | 19 nt | Target #1: | 5'-ACAAACGCAUAGUAGCAUG-3' | (SEQ ID NO: 16855) |
| C5-4250 | 19 nt | Target #2: | 5'-UACAAACGCAUAGUAGCAU-3' | (SEQ ID NO: 19165) |
| C5-4250 | 19 nt | Target #3: | 5'-UUACAAACGCAUAGUAGCA-3' | (SEQ ID NO: 21475) |
| C5-4251 | 19 nt | Target #1: | 5'-CAAACGCAUAGUAGCAUGU-3' | (SEQ ID NO: 16856) |
| C5-4251 | 19 nt | Target #2: | 5'-ACAAACGCAUAGUAGCAUG-3' | (SEQ ID NO: 19166) |
| C5-4251 | 19 nt | Target #3: | 5'-UACAAACGCAUAGUAGCAU-3' | (SEQ ID NO: 21476) |
| C5-4252 | 19 nt | Target #1: | 5'-AAACGCAUAGUAGCAUGUG-3' | (SEQ ID NO: 16857) |
| C5-4252 | 19 nt | Target #2: | 5'-CAAACGCAUAGUAGCAUGU-3' | (SEQ ID NO: 19167) |
| C5-4252 | 19 nt | Target #3: | 5'-ACAAACGCAUAGUAGCAUG-3' | (SEQ ID NO: 21477) |
| C5-4253 | 19 nt | Target #1: | 5'-AACGCAUAGUAGCAUGUGC-3' | (SEQ ID NO: 16858) |
| C5-4253 | 19 nt | Target #2: | 5'-AAACGCAUAGUAGCAUGUG-3' | (SEQ ID NO: 19168) |
| C5-4253 | 19 nt | Target #3: | 5'-CAAACGCAUAGUAGCAUGU-3' | (SEQ ID NO: 21478) |
| C5-4254 | 19 nt | Target #1: | 5'-ACGCAUAGUAGCAUGUGCC-3' | (SEQ ID NO: 16859) |
| C5-4254 | 19 nt | Target #2: | 5'-AACGCAUAGUAGCAUGUGC-3' | (SEQ ID NO: 19169) |
| C5-4254 | 19 nt | Target #3: | 5'-AAACGCAUAGUAGCAUGUG-3' | (SEQ ID NO: 21479) |
| C5-4255 | 19 nt | Target #1: | 5'-CGCAUAGUAGCAUGUGCCA-3' | (SEQ ID NO: 16860) |
| C5-4255 | 19 nt | Target #2: | 5'-ACGCAUAGUAGCAUGUGCC-3' | (SEQ ID NO: 19170) |
| C5-4255 | 19 nt | Target #3: | 5'-AACGCAUAGUAGCAUGUGC-3' | (SEQ ID NO: 21480) |
| C5-4256 | 19 nt | Target #1: | 5'-GCAUAGUAGCAUGUGCCAG-3' | (SEQ ID NO: 16861) |
| C5-4256 | 19 nt | Target #2: | 5'-CGCAUAGUAGCAUGUGCCA-3' | (SEQ ID NO: 19171) |
| C5-4256 | 19 nt | Target #3: | 5'-ACGCAUAGUAGCAUGUGCC-3' | (SEQ ID NO: 21481) |
| C5-4257 | 19 nt | Target #1: | 5'-CAUAGUAGCAUGUGCCAGC-3' | (SEQ ID NO: 16862) |
| C5-4257 | 19 nt | Target #2: | 5'-GCAUAGUAGCAUGUGCCAG-3' | (SEQ ID NO: 19172) |
| C5-4257 | 19 nt | Target #3: | 5'-CGCAUAGUAGCAUGUGCCA-3' | (SEQ ID NO: 21482) |
| C5-4258 | 19 nt | Target #1: | 5'-AUAGUAGCAUGUGCCAGCU-3' | (SEQ ID NO: 16863) |
| C5-4258 | 19 nt | Target #2: | 5'-CAUAGUAGCAUGUGCCAGC-3' | (SEQ ID NO: 19173) |
| C5-4258 | 19 nt | Target #3: | 5'-GCAUAGUAGCAUGUGCCAG-3' | (SEQ ID NO: 21483) |
| C5-4259 | 19 nt | Target #1: | 5'-UAGUAGCAUGUGCCAGCUA-3' | (SEQ ID NO: 16864) |
| C5-4259 | 19 nt | Target #2: | 5'-AUAGUAGCAUGUGCCAGCU-3' | (SEQ ID NO: 19174) |
| C5-4259 | 19 nt | Target #3: | 5'-CAUAGUAGCAUGUGCCAGC-3' | (SEQ ID NO: 21484) |
| C5-4260 | 19 nt | Target #1: | 5'-AGUAGCAUGUGCCAGCUAC-3' | (SEQ ID NO: 16865) |
| C5-4260 | 19 nt | Target #2: | 5'-UAGUAGCAUGUGCCAGCUA-3' | (SEQ ID NO: 19175) |
| C5-4260 | 19 nt | Target #3: | 5'-AUAGUAGCAUGUGCCAGCU-3' | (SEQ ID NO: 21485) |
| C5-4261 | 19 nt | Target #1: | 5'-GUAGCAUGUGCCAGCUACA-3' | (SEQ ID NO: 16866) |
| C5-4261 | 19 nt | Target #2: | 5'-AGUAGCAUGUGCCAGCUAC-3' | (SEQ ID NO: 19176) |
| C5-4261 | 19 nt | Target #3: | 5'-UAGUAGCAUGUGCCAGCUA-3' | (SEQ ID NO: 21486) |
| C5-4321 | 19 nt | Target #1: | 5'-GUGAUGGACAUCUCCUUGC-3' | (SEQ ID NO: 16867) |
| C5-4321 | 19 nt | Target #2: | 5'-GGUGAUGGACAUCUCCUUG-3' | (SEQ ID NO: 19177) |
| C5-4321 | 19 nt | Target #3: | 5'-CGGUGAUGGACAUCUCCUU-3' | (SEQ ID NO: 21487) |
| C5-4322 | 19 nt | Target #1: | 5'-UGAUGGACAUCUCCUUGCC-3' | (SEQ ID NO: 16868) |
| C5-4322 | 19 nt | Target #2: | 5'-GUGAUGGACAUCUCCUUGC-3' | (SEQ ID NO: 19178) |
| C5-4322 | 19 nt | Target #3: | 5'-GGUGAUGGACAUCUCCUUG-3' | (SEQ ID NO: 21488) |
| C5-4323 | 19 nt | Target #1: | 5'-GAUGGACAUCUCCUUGCCU-3' | (SEQ ID NO: 16869) |
| C5-4323 | 19 nt | Target #2: | 5'-UGAUGGACAUCUCCUUGCC-3' | (SEQ ID NO: 19179) |
| C5-4323 | 19 nt | Target #3: | 5'-GUGAUGGACAUCUCCUUGC-3' | (SEQ ID NO: 21489) |
| C5-4324 | 19 nt | Target #1: | 5'-AUGGACAUCUCCUUGCCUA-3' | (SEQ ID NO: 16870) |
| C5-4324 | 19 nt | Target #2: | 5'-GAUGGACAUCUCCUUGCCU-3' | (SEQ ID NO: 19180) |
| C5-4324 | 19 nt | Target #3: | 5'-UGAUGGACAUCUCCUUGCC-3' | (SEQ ID NO: 21490) |
| C5-4325 | 19 nt | Target #1: | 5'-UGGACAUCUCCUUGCCUAC-3' | (SEQ ID NO: 16871) |
| C5-4325 | 19 nt | Target #2: | 5'-AUGGACAUCUCCUUGCCUA-3' | (SEQ ID NO: 19181) |
| C5-4325 | 19 nt | Target #3: | 5'-GAUGGACAUCUCCUUGCCU-3' | (SEQ ID NO: 21491) |
| C5-4326 | 19 nt | Target #1: | 5'-GGACAUCUCCUUGCCUACU-3' | (SEQ ID NO: 16872) |
| C5-4326 | 19 nt | Target #2: | 5'-UGGACAUCUCCUUGCCUAC-3' | (SEQ ID NO: 19182) |
| C5-4326 | 19 nt | Target #3: | 5'-AUGGACAUCUCCUUGCCUA-3' | (SEQ ID NO: 21492) |
| C5-4327 | 19 nt | Target #1: | 5'-GACAUCUCCUUGCCUACUG-3' | (SEQ ID NO: 16873) |
| C5-4327 | 19 nt | Target #2: | 5'-GGACAUCUCCUUGCCUACU-3' | (SEQ ID NO: 19183) |
| C5-4327 | 19 nt | Target #3: | 5'-UGGACAUCUCCUUGCCUAC-3' | (SEQ ID NO: 21493) |
| C5-4328 | 19 nt | Target #1: | 5'-ACAUCUCCUUGCCUACUGG-3' | (SEQ ID NO: 16874) |
| C5-4328 | 19 nt | Target #2: | 5'-GACAUCUCCUUGCCUACUG-3' | (SEQ ID NO: 19184) |
| C5-4328 | 19 nt | Target #3: | 5'-GGACAUCUCCUUGCCUACU-3' | (SEQ ID NO: 21494) |
| C5-4329 | 19 nt | Target #1: | 5'-CAUCUCCUUGCCUACUGGA-3' | (SEQ ID NO: 16875) |
| C5-4329 | 19 nt | Target #2: | 5'-ACAUCUCCUUGCCUACUGG-3' | (SEQ ID NO: 19185) |
| C5-4329 | 19 nt | Target #3: | 5'-GACAUCUCCUUGCCUACUG-3' | (SEQ ID NO: 21495) |
| C5-4330 | 19 nt | Target #1: | 5'-AUCUCCUUGCCUACUGGAA-3' | (SEQ ID NO: 16876) |
| C5-4330 | 19 nt | Target #2: | 5'-CAUCUCCUUGCCUACUGGA-3' | (SEQ ID NO: 19186) |
| C5-4330 | 19 nt | Target #3: | 5'-ACAUCUCCUUGCCUACUGG-3' | (SEQ ID NO: 21496) |
| C5-4331 | 19 nt | Target #1: | 5'-UCUCCUUGCCUACUGGAAU-3' | (SEQ ID NO: 16877) |
| C5-4331 | 19 nt | Target #2: | 5'-AUCUCCUUGCCUACUGGAA-3' | (SEQ ID NO: 19187) |
| C5-4331 | 19 nt | Target #3: | 5'-CAUCUCCUUGCCUACUGGA-3' | (SEQ ID NO: 21497) |
| C5-4332 | 19 nt | Target #1: | 5'-CUCCUUGCCUACUGGAAUC-3' | (SEQ ID NO: 16878) |
| C5-4332 | 19 nt | Target #2: | 5'-UCUCCUUGCCUACUGGAAU-3' | (SEQ ID NO: 19188) |
| C5-4332 | 19 nt | Target #3: | 5'-AUCUCCUUGCCUACUGGAA-3' | (SEQ ID NO: 21498) |
| C5-4333 | 19 nt | Target #1: | 5'-UCCUUGCCUACUGGAAUCA-3' | (SEQ ID NO: 16879) |
| C5-4333 | 19 nt | Target #2: | 5'-CUCCUUGCCUACUGGAAUC-3' | (SEQ ID NO: 19189) |

TABLE 10-continued

DsiRNA Component 19 Nucleotide Target Sequences of Human Anti-C5
DsiRNAs Predicted to have >50% Knockdown Efficacy

| ID | Length | Target | Sequence | SEQ ID NO |
|---|---|---|---|---|
| C5-4333 | 19 nt | Target #3: | 5'-UCUCCUUGCCUACUGGAAU-3' | (SEQ ID NO: 21499

TABLE 10-continued

DsiRNA Component 19 Nucleotide Target Sequences of Human Anti-C5
DsiRNAs Predicted to have >50% Knockdown Efficac TABLE 10-continued DsiRNA Component 19 Nucleotide Target Sequences of Human Anti-C5
DsiRNAs Predicted to have >50% Knockdown Efficacy

```

TABLE 10-continued

DsiRNA Component 19 Nucleotide Target Sequences of Human Anti-C5
DsiRNAs Predicted to have >50% Knockdown Efficacy TABLE 10-continued DsiRNA Component 19 Nucleotide Target Sequences of Human Anti-C5
DsiRNAs Predicted to have >50% Knockdown Efficacy

```

TABLE 10-continued

DsiRNA Component 19 Nucleotide Target Sequences of Human Anti-C5
DsiRNAs Predicted to have >50% Knockdown Efficacy

|

TABLE 10-continued

DsiRNA Component 19 Nucleotide Target Sequences of Human Anti-C5
DsiRNAs Predicted to have >50% Knockdown Efficac TABLE 10-continued DsiRNA Component 19 Nucleotide Target Sequences of Human Anti-C5
DsiRNAs Predicted to have >50% Knockdown Efficacy

```
C5-4953  19 nt  Target #2:  5'-UCAGGUACAUCUACCCUUU-3'   (SEQ ID NO: 19369)
C5-4953  19 nt  Target #3:  5'-UUCAGGUACAUCUACCCUU-3'   (SEQ ID NO: 21679)
C5-4954  19 nt  Target #1:  5'-AGGUACAUCUACCCUUUAG-3'   (SEQ ID NO: 17060)
C5-4954  19 nt  Target #2:  5'-CAGGUACAUCUACCCUUUA-3'   (SEQ ID NO: 19370)
C5-4954  19 nt  Target #3:  5'-UCAGGUACAUCUACCCUUU-3'   (SEQ ID NO: 21680)
C5-4955  19 nt  Target #1:  5'-GGUACAUCUACCCUUUAGA-3'   (SEQ ID NO: 17061)
C5-4955  19 nt  Target #2:  5'-AGGUACAUCUACCCUUUAG-3'   (SEQ ID NO: 19371)
C5-4955  19 nt  Target #3:  5'-CAGGUACAUCUACCCUUUA-3'   (SEQ ID NO: 21681)
C5-4956  19 nt  Target #1:  5'-GUACAUCUACCCUUUAGAU-3'   (SEQ ID NO: 17062)
C5-4956  19 nt  Target #2:  5'-GGUACAUCUACCCUUUAGA-3'   (SEQ ID NO: 19372)
C5-4956  19 nt  Target #3:  5'-AGGUACAUCUACCCUUUAG-3'   (SEQ ID NO: 21682)
C5-4957  19 nt  Target #1:  5'-UACAUCUACCCUUUAGAUU-3'   (SEQ ID NO: 17063)
C5-4957  19 nt  Target #2:  5'-GUACAUCUACCCUUUAGAU-3'   (SEQ ID NO: 19373)
C5-4957  19 nt  Target #3:  5'-GGUACAUCUACCCUUUAGA-3'   (SEQ ID NO: 21683)
C5-4958  19 nt  Target #1:  5'-ACAUCUACCCUUUAGAUUC-3'   (SEQ ID NO: 17064)
C5-4958  19 nt  Target #2:  5'-UACAUCUACCCUUUAGAUU-3'   (SEQ ID NO: 19374)
C5-4958  19 nt  Target #3:  5'-GUACAUCUACCCUUUAGAU-3'   (SEQ ID NO: 21684)
C5-4959  19 nt  Target #1:  5'-CAUCUACCCUUUAGAUUCC-3'   (SEQ ID NO: 17065)
C5-4959  19 nt  Target #2:  5'-ACAUCUACCCUUUAGAUUC-3'   (SEQ ID NO: 19375)
C5-4959  19 nt  Target #3:  5'-UACAUCUACCCUUUAGAUU-3'   (SEQ ID NO: 21685)
C5-4960  19 nt  Target #1:  5'-AUCUACCCUUUAGAUUCCU-3'   (SEQ ID NO: 17066)
C5-4960  19 nt  Target #2:  5'-CAUCUACCCUUUAGAUUCC-3'   (SEQ ID NO: 19376)
C5-4960  19 nt  Target #3:  5'-ACAUCUACCCUUUAGAUUC-3'   (SEQ ID NO: 21686)
C5-4961  19 nt  Target #1:  5'-UCUACCCUUUAGAUUCCUU-3'   (SEQ ID NO: 17067)
C5-4961  19 nt  Target #2:  5'-AUCUACCCUUUAGAUUCCU-3'   (SEQ ID NO: 19377)
C5-4961  19 nt  Target #3:  5'-CAUCUACCCUUUAGAUUCC-3'   (SEQ ID NO: 21687)
C5-4962  19 nt  Target #1:  5'-CUACCCUUUAGAUUCCUUG-3'   (SEQ ID NO: 17068)
C5-4962  19 nt  Target #2:  5'-UCUACCCUUUAGAUUCCUU-3'   (SEQ ID NO: 19378)
C5-4962  19 nt  Target #3:  5'-AUCUACCCUUUAGAUUCCU-3'   (SEQ ID NO: 21688)
C5-4963  19 nt  Target #1:  5'-UACCCUUUAGAUUCCUUGA-3'   (SEQ ID NO: 17069)
C5-4963  19 nt  Target #2:  5'-CUACCCUUUAGAUUCCUUG-3'   (SEQ ID NO: 19379)
C5-4963  19 nt  Target #3:  5'-UCUACCCUUUAGAUUCCUU-3'   (SEQ ID NO: 21689)
C5-4964  19 nt  Target #1:  5'-ACCCUUUAGAUUCCUUGAC-3'   (SEQ ID NO: 17070)
C5-4964  19 nt  Target #2:  5'-UACCCUUUAGAUUCCUUGA-3'   (SEQ ID NO: 19380)
C5-4964  19 nt  Target #3:  5'-CUACCCUUUAGAUUCCUUG-3'   (SEQ ID NO: 21690)
C5-4965  19 nt  Target #1:  5'-CCCUUUAGAUUCCUUGACC-3'   (SEQ ID NO: 17071)
C5-4965  19 nt  Target #2:  5'-ACCCUUUAGAUUCCUUGAC-3'   (SEQ ID NO: 19381)
C5-4965  19 nt  Target #3:  5'-UACCCUUUAGAUUCCUUGA-3'   (SEQ ID NO: 21691)
C5-4966  19 nt  Target #1:  5'-CCUUUAGAUUCCUUGACCU-3'   (SEQ ID NO: 17072)
C5-4966  19 nt  Target #2:  5'-CCCUUUAGAUUCCUUGACC-3'   (SEQ ID NO: 19382)
C5-4966  19 nt  Target #3:  5'-ACCCUUUAGAUUCCUUGAC-3'   (SEQ ID NO: 21692)
C5-4967  19 nt  Target #1:  5'-CUUUAGAUUCCUUGACCUG-3'   (SEQ ID NO: 17073)
C5-4967  19 nt  Target #2:  5'-CCUUUAGAUUCCUUGACCU-3'   (SEQ ID NO: 19383)
C5-4967  19 nt  Target #3:  5'-CCCUUUAGAUUCCUUGACC-3'   (SEQ ID NO: 21693)
C5-4968  19 nt  Target #1:  5'-UUUAGAUUCCUUGACCUGG-3'   (SEQ ID NO: 17074)
C5-4968  19 nt  Target #2:  5'-CUUUAGAUUCCUUGACCUG-3'   (SEQ ID NO: 19384)
C5-4968  19 nt  Target #3:  5'-CCUUUAGAUUCCUUGACCU-3'   (SEQ ID NO: 21694)
C5-4969  19 nt  Target #1:  5'-UUAGAUUCCUUGACCUGGA-3'   (SEQ ID NO: 17075)
C5-4969  19 nt  Target #2:  5'-UUUAGAUUCCUUGACCUGG-3'   (SEQ ID NO: 19385)
C5-4969  19 nt  Target #3:  5'-CUUUAGAUUCCUUGACCUG-3'   (SEQ ID NO: 21695)
C5-4970  19 nt  Target #1:  5'-UAGAUUCCUUGACCUGGAU-3'   (SEQ ID NO: 17076)
C5-4970  19 nt  Target #2:  5'-UUAGAUUCCUUGACCUGGA-3'   (SEQ ID NO: 19386)
C5-4970  19 nt  Target #3:  5'-UUUAGAUUCCUUGACCUGG-3'   (SEQ ID NO: 21696)
C5-4971  19 nt  Target #1:  5'-AGAUUCCUUGACCUGGAUU-3'   (SEQ ID NO: 17077)
C5-4971  19 nt  Target #2:  5'-UAGAUUCCUUGACCUGGAU-3'   (SEQ ID NO: 19387)
C5-4971  19 nt  Target #3:  5'-UUAGAUUCCUUGACCUGGA-3'   (SEQ ID NO: 21697)
C5-4972  19 nt  Target #1:  5'-GAUUCCUUGACCUGGAUUG-3'   (SEQ ID NO: 17078)
C5-4972  19 nt  Target #2:  5'-AGAUUCCUUGACCUGGAUU-3'   (SEQ ID NO: 19388)
C5-4972  19 nt  Target #3:  5'-UAGAUUCCUUGACCUGGAU-3'   (SEQ ID NO: 21698)
C5-4973  19 nt  Target #1:  5'-AUUCCUUGACCUGGAUUGA-3'   (SEQ ID NO: 17079)
C5-4973  19 nt  Target #2:  5'-GAUUCCUUGACCUGGAUUG-3'   (SEQ ID NO: 19389)
C5-4973  19 nt  Target #3:  5'-AGAUUCCUUGACCUGGAUU-3'   (SEQ ID NO: 21699)
C5-4974  19 nt  Target #1:  5'-UUCCUUGACCUGGAUUGAA-3'   (SEQ ID NO: 17080)
C5-4974  19 nt  Target #2:  5'-AUUCCUUGACCUGGAUUGA-3'   (SEQ ID NO: 19390)
C5-4974  19 nt  Target #3:  5'-GAUUCCUUGACCUGGAUUG-3'   (SEQ ID NO: 21700)
C5-4975  19 nt  Target #1:  5'-UCCUUGACCUGGAUUGAAU-3'   (SEQ ID NO: 17081)
C5-4975  19 nt  Target #2:  5'-UUCCUUGACCUGGAUUGAA-3'   (SEQ ID NO: 19391)
C5-4975  19 nt  Target #3:  5'-AUUCCUUGACCUGGAUUGA-3'   (SEQ ID NO: 21701)
C5-4976  19 nt  Target #1:  5'-CCUUGACCUGGAUUGAAUA-3'   (SEQ ID NO: 17082)
C5-4976  19 nt  Target #2:  5'-UCCUUGACCUGGAUUGAAU-3'   (SEQ ID NO: 19392)
C5-4976  19 nt  Target #3:  5'-UUCCUUGACCUGGAUUGAA-3'   (SEQ ID NO: 21702)
C5-4977  19 nt  Target #1:  5'-CUUGACCUGGAUUGAAUAC-3'   (SEQ ID NO: 17083)
C5-4977  19 nt  Target #2:  5'-CCUUGACCUGGAUUGAAUA-3'   (SEQ ID NO: 19393)
C5-4977  19 nt  Target #3:  5'-UCCUUGACCUGGAUUGAAU-3'   (SEQ ID NO: 21703)
C5-4978  19 nt  Target #1:  5'-UUGACCUGGAUUGAAUACU-3'   (SEQ ID NO: 17084)
C5-4978  19 nt  Target #2:  5'-CUUGACCUGGAUUGAAUAC-3'   (SEQ ID NO: 19394)
C5-4978  19 nt  Target #3:  5'-CCUUGACCUGGAUUGAAUA-3'   (SEQ ID NO: 21704)
```

TABLE 10-continued

DsiRNA Component 19 Nucleotide Target Sequences of Human Anti-C5
DsiRNAs Predicted to have >50% Knockdown Efficacy

| | | | | |
|---|---|---|---|---|
| C5-4979 | 19 nt | Target #1: | 5'-UGACCUGGAUUGAAUACUG-3' | (SEQ ID NO: 17085) |
| C5-4979 | 19 nt | Target #2: | 5'-UUGACCUGGAUUGAAUACU-3' | (SEQ ID NO: 19395) |
| C5-4979 | 19 nt | Target #3: | 5'-CUUGACCUGGAUUGAAUAC-3' | (SEQ ID NO: 21705) |
| C5-4980 | 19 nt | Target #1: | 5'-GACCUGGAUUGAAUACUGG-3' | (SEQ ID NO: 17086) |
| C5-4980 | 19 nt | Target #2: | 5'-UGACCUGGAUUGAAUACUG-3' | (SEQ ID NO: 19396) |
| C5-4980 | 19 nt | Target #3: | 5'-UUGACCUGGAUUGAAUACU-3' | (SEQ ID NO: 21706) |
| C5-4981 | 19 nt | Target #1: | 5'-ACCUGGAUUGAAUACUGGC-3' | (SEQ ID NO: 17087) |
| C5-4981 | 19 nt | Target #2: | 5'-GACCUGGAUUGAAUACUGG-3' | (SEQ ID NO: 19397) |
| C5-4981 | 19 nt | Target #3: | 5'-UGACCUGGAUUGAAUACUG-3' | (SEQ ID NO: 21707) |
| C5-4982 | 19 nt | Target #1: | 5'-CCUGGAUUGAAUACUGGCC-3' | (SEQ ID NO: 17088) |
| C5-4982 | 19 nt | Target #2: | 5'-ACCUGGAUUGAAUACUGGC-3' | (SEQ ID NO: 19398) |
| C5-4982 | 19 nt | Target #3: | 5'-GACCUGGAUUGAAUACUGG-3' | (SEQ ID NO: 21708) |
| C5-4983 | 19 nt | Target #1: | 5'-CUGGAUUGAAUACUGGCCU-3' | (SEQ ID NO: 17089) |
| C5-4983 | 19 nt | Target #2: | 5'-CCUGGAUUGAAUACUGGCC-3' | (SEQ ID NO: 19399) |
| C5-4983 | 19 nt | Target #3: | 5'-ACCUGGAUUGAAUACUGGC-3' | (SEQ ID NO: 21709) |
| C5-4984 | 19 nt | Target #1: | 5'-UGGAUUGAAUACUGGCCUA-3' | (SEQ ID NO: 17090) |
| C5-4984 | 19 nt | Target #2: | 5'-CUGGAUUGAAUACUGGCCU-3' | (SEQ ID NO: 19400) |
| C5-4984 | 19 nt | Target #3: | 5'-CCUGGAUUGAAUACUGGCC-3' | (SEQ ID NO: 21710) |
| C5-4985 | 19 nt | Target #1: | 5'-GGAUUGAAUACUGGCCUAG-3' | (SEQ ID NO: 17091) |
| C5-4985 | 19 nt | Target #2: | 5'-UGGAUUGAAUACUGGCCUA-3' | (SEQ ID NO: 19401) |
| C5-4985 | 19 nt | Target #3: | 5'-CUGGAUUGAAUACUGGCCU-3' | (SEQ ID NO: 21711) |
| C5-5009 | 19 nt | Target #1: | 5'-CAACAUGUUCAUCGUGUCA-3' | (SEQ ID NO: 17092) |
| C5-5009 | 19 nt | Target #2: | 5'-ACAACAUGUUCAUCGUGUC-3' | (SEQ ID NO: 19402) |
| C5-5009 | 19 nt | Target #3: | 5'-CACAACAUGUUCAUCGUGU-3' | (SEQ ID NO: 21712) |
| C5-5010 | 19 nt | Target #1: | 5'-AACAUGUUCAUCGUGUCAA-3' | (SEQ ID NO: 17093) |
| C5-5010 | 19 nt | Target #2: | 5'-CAACAUGUUCAUCGUGUCA-3' | (SEQ ID NO: 19403) |
| C5-5010 | 19 nt | Target #3: | 5'-ACAACAUGUUCAUCGUGUC-3' | (SEQ ID NO: 21713) |
| C5-5011 | 19 nt | Target #1: | 5'-ACAUGUUCAUCGUGUCAAG-3' | (SEQ ID NO: 17094) |
| C5-5011 | 19 nt | Target #2: | 5'-AACAUGUUCAUCGUGUCAA-3' | (SEQ ID NO: 19404) |
| C5-5011 | 19 nt | Target #3: | 5'-CAACAUGUUCAUCGUGUCA-3' | (SEQ ID NO: 21714) |
| C5-5012 | 19 nt | Target #1: | 5'-CAUGUUCAUCGUGUCAAGC-3' | (SEQ ID NO: 17095) |
| C5-5012 | 19 nt | Target #2: | 5'-ACAUGUUCAUCGUGUCAAG-3' | (SEQ ID NO: 19405) |
| C5-5012 | 19 nt | Target #3: | 5'-AACAUGUUCAUCGUGUCAA-3' | (SEQ ID NO: 21715) |
| C5-5014 | 19 nt | Target #1: | 5'-UGUUCAUCGUGUCAAGCAU-3' | (SEQ ID NO: 17096) |
| C5-5014 | 19 nt | Target #2: | 5'-AUGUUCAUCGUGUCAAGCA-3' | (SEQ ID NO: 19406) |
| C5-5014 | 19 nt | Target #3: | 5'-CAUGUUCAUCGUGUCAAGC-3' | (SEQ ID NO: 21716) |
| C5-5015 | 19 nt | Target #1: | 5'-GUUCAUCGUGUCAAGCAUU-3' | (SEQ ID NO: 17097) |
| C5-5015 | 19 nt | Target #2: | 5'-UGUUCAUCGUGUCAAGCAU-3' | (SEQ ID NO: 19407) |
| C5-5015 | 19 nt | Target #3: | 5'-AUGUUCAUCGUGUCAAGCA-3' | (SEQ ID NO: 21717) |
| C5-5016 | 19 nt | Target #1: | 5'-UUCAUCGUGUCAAGCAUUU-3' | (SEQ ID NO: 17098) |
| C5-5016 | 19 nt | Target #2: | 5'-GUUCAUCGUGUCAAGCAUU-3' | (SEQ ID NO: 19408) |
| C5-5016 | 19 nt | Target #3: | 5'-UGUUCAUCGUGUCAAGCAU-3' | (SEQ ID NO: 21718) |
| C5-5017 | 19 nt | Target #1: | 5'-UCAUCGUGUCAAGCAUUUU-3' | (SEQ ID NO: 17099) |
| C5-5017 | 19 nt | Target #2: | 5'-UUCAUCGUGUCAAGCAUUU-3' | (SEQ ID NO: 19409) |
| C5-5017 | 19 nt | Target #3: | 5'-GUUCAUCGUGUCAAGCAUU-3' | (SEQ ID NO: 21719) |
| C5-5019 | 19 nt | Target #1: | 5'-AUCGUGUCAAGCAUUUUUA-3' | (SEQ ID NO: 17100) |
| C5-5019 | 19 nt | Target #2: | 5'-CAUCGUGUCAAGCAUUUUU-3' | (SEQ ID NO: 19410) |
| C5-5019 | 19 nt | Target #3: | 5'-UCAUCGUGUCAAGCAUUUU-3' | (SEQ ID NO: 21720) |
| C5-5020 | 19 nt | Target #1: | 5'-UCGUGUCAAGCAUUUUUAG-3' | (SEQ ID NO: 17101) |
| C5-5020 | 19 nt | Target #2: | 5'-AUCGUGUCAAGCAUUUUUA-3' | (SEQ ID NO: 19411) |
| C5-5020 | 19 nt | Target #3: | 5'-CAUCGUGUCAAGCAUUUUU-3' | (SEQ ID NO: 21721) |
| C5-5021 | 19 nt | Target #1: | 5'-CGUGUCAAGCAUUUUUAGC-3' | (SEQ ID NO: 17102) |
| C5-5021 | 19 nt | Target #2: | 5'-UCGUGUCAAGCAUUUUUAG-3' | (SEQ ID NO: 19412) |
| C5-5021 | 19 nt | Target #3: | 5'-AUCGUGUCAAGCAUUUUUA-3' | (SEQ ID NO: 21722) |
| C5-5023 | 19 nt | Target #1: | 5'-UGUCAAGCAUUUUUAGCUA-3' | (SEQ ID NO: 17103) |
| C5-5023 | 19 nt | Target #2: | 5'-GUGUCAAGCAUUUUUAGCU-3' | (SEQ ID NO: 19413) |
| C5-5023 | 19 nt | Target #3: | 5'-CGUGUCAAGCAUUUUUAGC-3' | (SEQ ID NO: 21723) |
| C5-5024 | 19 nt | Target #1: | 5'-GUCAAGCAUUUUUAGCUAA-3' | (SEQ ID NO: 17104) |
| C5-5024 | 19 nt | Target #2: | 5'-UGUCAAGCAUUUUUAGCUA-3' | (SEQ ID NO: 19414) |
| C5-5024 | 19 nt | Target #3: | 5'-GUGUCAAGCAUUUUUAGCU-3' | (SEQ ID NO: 21724) |
| C5-5025 | 19 nt | Target #1: | 5'-UCAAGCAUUUUUAGCUAAU-3' | (SEQ ID NO: 17105) |
| C5-5025 | 19 nt | Target #2: | 5'-GUCAAGCAUUUUUAGCUAA-3' | (SEQ ID NO: 19415) |
| C5-5025 | 19 nt | Target #3: | 5'-UGUCAAGCAUUUUUAGCUA-3' | (SEQ ID NO: 21725) |
| C5-5026 | 19 nt | Target #1: | 5'-CAAGCAUUUUUAGCUAAUU-3' | (SEQ ID NO: 17106) |
| C5-5026 | 19 nt | Target #2: | 5'-UCAAGCAUUUUUAGCUAAU-3' | (SEQ ID NO: 19416) |
| C5-5026 | 19 nt | Target #3: | 5'-GUCAAGCAUUUUUAGCUAA-3' | (SEQ ID NO: 21726) |
| C5-5028 | 19 nt | Target #1: | 5'-AGCAUUUUUAGCUAAUUUA-3' | (SEQ ID NO: 17107) |
| C5-5028 | 19 nt | Target #2: | 5'-AAGCAUUUUUAGCUAAUUU-3' | (SEQ ID NO: 19417) |
| C5-5028 | 19 nt | Target #3: | 5'-CAAGCAUUUUUAGCUAAUU-3' | (SEQ ID NO: 21727) |
| C5-5029 | 19 nt | Target #1: | 5'-GCAUUUUUAGCUAAUUUAG-3' | (SEQ ID NO: 17108) |
| C5-5029 | 19 nt | Target #2: | 5'-AGCAUUUUUAGCUAAUUUA-3' | (SEQ ID NO: 19418) |
| C5-5029 | 19 nt | Target #3: | 5'-AAGCAUUUUUAGCUAAUUU-3' | (SEQ ID NO: 21728) |
| C5-5030 | 19 nt | Target #1: | 5'-CAUUUUUAGCUAAUUUAGA-3' | (SEQ ID NO: 17109) |
| C5-5030 | 19 nt | Target #2: | 5'-GCAUUUUUAGCUAAUUUAG-3' | (SEQ ID NO: 19419) |
| C5-5030 | 19 nt | Target #3: | 5'-AGCAUUUUUAGCUAAUUUA-3' | (SEQ ID NO: 21729) |
| C5-5031 | 19 nt | Target #1: | 5'-AUUUUUAGCUAAUUUAGAU-3' | (SEQ ID NO: 17110) |
| C5-5031 | 19 nt | Target #2: | 5'-CAUUUUUAGCUAAUUUAGA-3' | (SEQ ID NO: 19420) |

TABLE 10-continued

DsiRNA Component 19 Nucleotide Target Sequences of Human Anti-C5
DsiRNAs Predicted to have >50% Knockdown Efficacy TABLE 10-continued DsiRNA Component 19 Nucleotide Target Sequences of Human Anti-C5
DsiRNAs Predicted to have >50% Knockdown Efficacy

| | | | | |
|---|---|---|---|---|
| C5-5083 | 19 nt | Target #2: | 5'-CUAAAAUUCCUGAAGUUCA-3' | (SEQ ID NO: 19446) |
| C5-5083 | 19 nt | Target #3: | 5'-GCUAAAAUUCCUGAAGUUC-3' | (SEQ ID NO: 21756) |
| C5-5084 | 19 nt | Target #1: | 5'-AAAAUUCCUGAAGUUCAGC-3' | (SEQ ID NO: 17137) |
| C5-5084 | 19 nt | Target #2: | 5'-UAAAAUUCCUGAAGUUCAG-3' | (SEQ ID NO: 19447) |
| C5-5084 | 19 nt | Target #3: | 5'-CUAAAAUUCCUGAAGUUCA-3' | (SEQ ID NO: 21757) |
| C5-5085 | 19 nt | Target #1: | 5'-AAAUUCCUGAAGUUCAGCU-3' | (SEQ ID NO: 17138) |
| C5-5085 | 19 nt | Target #2: | 5'-AAAAUUCCUGAAGUUCAGC-3' | (SEQ ID NO: 19448) |
| C5-5085 | 19 nt | Target #3: | 5'-UAAAAUUCCUGAAGUUCAG-3' | (SEQ ID NO: 21758) |
| C5-5086 | 19 nt | Target #1: | 5'-AAUUCCUGAAGUUCAGCUG-3' | (SEQ ID NO: 17139) |
| C5-5086 | 19 nt | Target #2: | 5'-AAAUUCCUGAAGUUCAGCU-3' | (SEQ ID NO: 19449) |
| C5-5086 | 19 nt | Target #3: | 5'-AAAAUUCCUGAAGUUCAGC-3' | (SEQ ID NO: 21759) |
| C5-5087 | 19 nt | Target #1: | 5'-AUUCCUGAAGUUCAGCUGC-3' | (SEQ ID NO: 17140) |
| C5-5087 | 19 nt | Target #2: | 5'-AAUUCCUGAAGUUCAGCUG-3' | (SEQ ID NO: 19450) |
| C5-5087 | 19 nt | Target #3: | 5'-AAAUUCCUGAAGUUCAGCU-3' | (SEQ ID NO: 21760) |
| C5-5088 | 19 nt | Target #1: | 5'-UUCCUGAAGUUCAGCUGCA-3' | (SEQ ID NO: 17141) |
| C5-5088 | 19 nt | Target #2: | 5'-AUUCCUGAAGUUCAGCUGC-3' | (SEQ ID NO: 19451) |
| C5-5088 | 19 nt | Target #3: | 5'-AAUUCCUGAAGUUCAGCUG-3' | (SEQ ID NO: 21761) |
| C5-5089 | 19 nt | Target #1: | 5'-UCCUGAAGUUCAGCUGCAU-3' | (SEQ ID NO: 17142) |
| C5-5089 | 19 nt | Target #2: | 5'-UUCCUGAAGUUCAGCUGCA-3' | (SEQ ID NO: 19452) |
| C5-5089 | 19 nt | Target #3: | 5'-AUUCCUGAAGUUCAGCUGC-3' | (SEQ ID NO: 21762) |
| C5-5090 | 19 nt | Target #1: | 5'-CCUGAAGUUCAGCUGCAUA-3' | (SEQ ID NO: 17143) |
| C5-5090 | 19 nt | Target #2: | 5'-UCCUGAAGUUCAGCUGCAU-3' | (SEQ ID NO: 19453) |
| C5-5090 | 19 nt | Target #3: | 5'-UUCCUGAAGUUCAGCUGCA-3' | (SEQ ID NO: 21763) |
| C5-5091 | 19 nt | Target #1: | 5'-CUGAAGUUCAGCUGCAUAC-3' | (SEQ ID NO: 17144) |
| C5-5091 | 19 nt | Target #2: | 5'-CCUGAAGUUCAGCUGCAUA-3' | (SEQ ID NO: 19454) |
| C5-5091 | 19 nt | Target #3: | 5'-UCCUGAAGUUCAGCUGCAU-3' | (SEQ ID NO: 21764) |
| C5-5092 | 19 nt | Target #1: | 5'-UGAAGUUCAGCUGCAUACA-3' | (SEQ ID NO: 17145) |
| C5-5092 | 19 nt | Target #2: | 5'-CUGAAGUUCAGCUGCAUAC-3' | (SEQ ID NO: 19455) |
| C5-5092 | 19 nt | Target #3: | 5'-CCUGAAGUUCAGCUGCAUA-3' | (SEQ ID NO: 21765) |
| C5-5093 | 19 nt | Target #1: | 5'-GAAGUUCAGCUGCAUACAG-3' | (SEQ ID NO: 17146) |
| C5-5093 | 19 nt | Target #2: | 5'-UGAAGUUCAGCUGCAUACA-3' | (SEQ ID NO: 19456) |
| C5-5093 | 19 nt | Target #3: | 5'-CUGAAGUUCAGCUGCAUAC-3' | (SEQ ID NO: 21766) |
| C5-5094 | 19 nt | Target #1: | 5'-AAGUUCAGCUGCAUACAGU-3' | (SEQ ID NO: 17147) |
| C5-5094 | 19 nt | Target #2: | 5'-GAAGUUCAGCUGCAUACAG-3' | (SEQ ID NO: 19457) |
| C5-5094 | 19 nt | Target #3: | 5'-UGAAGUUCAGCUGCAUACA-3' | (SEQ ID NO: 21767) |
| C5-5095 | 19 nt | Target #1: | 5'-AGUUCAGCUGCAUACAGUU-3' | (SEQ ID NO: 17148) |
| C5-5095 | 19 nt | Target #2: | 5'-AAGUUCAGCUGCAUACAGU-3' | (SEQ ID NO: 19458) |
| C5-5095 | 19 nt | Target #3: | 5'-GAAGUUCAGCUGCAUACAG-3' | (SEQ ID NO: 21768) |
| C5-5096 | 19 nt | Target #1: | 5'-GUUCAGCUGCAUACAGUUU-3' | (SEQ ID NO: 17149) |
| C5-5096 | 19 nt | Target #2: | 5'-AGUUCAGCUGCAUACAGUU-3' | (SEQ ID NO: 19459) |
| C5-5096 | 19 nt | Target #3: | 5'-AAGUUCAGCUGCAUACAGU-3' | (SEQ ID NO: 21769) |
| C5-5097 | 19 nt | Target #1: | 5'-UUCAGCUGCAUACAGUUUG-3' | (SEQ ID NO: 17150) |
| C5-5097 | 19 nt | Target #2: | 5'-GUUCAGCUGCAUACAGUUU-3' | (SEQ ID NO: 19460) |
| C5-5097 | 19 nt | Target #3: | 5'-AGUUCAGCUGCAUACAGUU-3' | (SEQ ID NO: 21770) |
| C5-5098 | 19 nt | Target #1: | 5'-UCAGCUGCAUACAGUUUGC-3' | (SEQ ID NO: 17151) |
| C5-5098 | 19 nt | Target #2: | 5'-UUCAGCUGCAUACAGUUUG-3' | (SEQ ID NO: 19461) |
| C5-5098 | 19 nt | Target #3: | 5'-GUUCAGCUGCAUACAGUUU-3' | (SEQ ID NO: 21771) |
| C5-5099 | 19 nt | Target #1: | 5'-CAGCUGCAUACAGUUUGCA-3' | (SEQ ID NO: 17152) |
| C5-5099 | 19 nt | Target #2: | 5'-UCAGCUGCAUACAGUUUGC-3' | (SEQ ID NO: 19462) |
| C5-5099 | 19 nt | Target #3: | 5'-UUCAGCUGCAUACAGUUUG-3' | (SEQ ID NO: 21772) |
| C5-5100 | 19 nt | Target #1: | 5'-AGCUGCAUACAGUUUGCAC-3' | (SEQ ID NO: 17153) |
| C5-5100 | 19 nt | Target #2: | 5'-CAGCUGCAUACAGUUUGCA-3' | (SEQ ID NO: 19463) |
| C5-5100 | 19 nt | Target #3: | 5'-UCAGCUGCAUACAGUUUGC-3' | (SEQ ID NO: 21773) |
| C5-5101 | 19 nt | Target #1: | 5'-GCUGCAUACAGUUUGCACU-3' | (SEQ ID NO: 17154) |
| C5-5101 | 19 nt | Target #2: | 5'-AGCUGCAUACAGUUUGCAC-3' | (SEQ ID NO: 19464) |
| C5-5101 | 19 nt | Target #3: | 5'-CAGCUGCAUACAGUUUGCA-3' | (SEQ ID NO: 21774) |
| C5-5102 | 19 nt | Target #1: | 5'-CUGCAUACAGUUUGCACUU-3' | (SEQ ID NO: 17155) |
| C5-5102 | 19 nt | Target #2: | 5'-GCUGCAUACAGUUUGCACU-3' | (SEQ ID NO: 19465) |
| C5-5102 | 19 nt | Target #3: | 5'-AGCUGCAUACAGUUUGCAC-3' | (SEQ ID NO: 21775) |
| C5-5103 | 19 nt | Target #1: | 5'-UGCAUACAGUUUGCACUUA-3' | (SEQ ID NO: 17156) |
| C5-5103 | 19 nt | Target #2: | 5'-CUGCAUACAGUUUGCACUU-3' | (SEQ ID NO: 19466) |
| C5-5103 | 19 nt | Target #3: | 5'-GCUGCAUACAGUUUGCACU-3' | (SEQ ID NO: 21776) |
| C5-5104 | 19 nt | Target #1: | 5'-GCAUACAGUUUGCACUUAU-3' | (SEQ ID NO: 17157) |
| C5-5104 | 19 nt | Target #2: | 5'-UGCAUACAGUUUGCACUUA-3' | (SEQ ID NO: 19467) |
| C5-5104 | 19 nt | Target #3: | 5'-CUGCAUACAGUUUGCACUU-3' | (SEQ ID NO: 21777) |
| C5-5105 | 19 nt | Target #1: | 5'-CAUACAGUUUGCACUUAUG-3' | (SEQ ID NO: 17158) |
| C5-5105 | 19 nt | Target #2: | 5'-GCAUACAGUUUGCACUUAU-3' | (SEQ ID NO: 19468) |
| C5-5105 | 19 nt | Target #3: | 5'-UGCAUACAGUUUGCACUUA-3' | (SEQ ID NO: 21778) |
| C5-5106 | 19 nt | Target #1: | 5'-AUACAGUUUGCACUUAUGG-3' | (SEQ ID NO: 17159) |
| C5-5106 | 19 nt | Target #2: | 5'-CAUACAGUUUGCACUUAUG-3' | (SEQ ID NO: 19469) |
| C5-5106 | 19 nt | Target #3: | 5'-GCAUACAGUUUGCACUUAU-3' | (SEQ ID NO: 21779) |
| C5-5107 | 19 nt | Target #1: | 5'-UACAGUUUGCACUUAUGGA-3' | (SEQ ID NO: 17160) |
| C5-5107 | 19 nt | Target #2: | 5'-AUACAGUUUGCACUUAUGG-3' | (SEQ ID NO: 19470) |
| C5-5107 | 19 nt | Target #3: | 5'-CAUACAGUUUGCACUUAUG-3' | (SEQ ID NO: 21780) |
| C5-5108 | 19 nt | Target #1: | 5'-ACAGUUUGCACUUAUGGAC-3' | (SEQ ID NO: 17161) |
| C5-5108 | 19 nt | Target #2: | 5'-UACAGUUUGCACUUAUGGA-3' | (SEQ ID NO: 19471) |
| C5-5108 | 19 nt | Target #3: | 5'-AUACAGUUUGCACUUAUGG-3' | (SEQ ID NO: 21781) |

TABLE 10-continued

DsiRNA Component 19 Nucleotide Target Sequences of Human Anti-C5
DsiRNAs Predicted to have >50% Knockdown Efficacy

```
C

TABLE 10-continued

DsiRNA Component 19 Nucleotide Target Sequences of Human Anti-C5
DsiRNAs Predicted to have >50% Knockdown Efficacy TABLE 10-continued DsiRNA Component 19 Nucleotide Target Sequences of Human Anti-C5 DsiRNAs Predicted to have >50% Knockdown Efficacy

| | | | | |
|---|---|---|---|---|
| C5-5216 | 19 nt | Target #2: | 5'-UAGUGGCACUUGCUUUUAU-3' | (SEQ ID NO: 19523) |
| C5-5216 | 19 nt | Target #3: | 5'-UUAGUGGCACUUGCUUUUA-3' | (SEQ ID NO: 21833) |
| C5-5217 | 19 nt | Target #1: | 5'-GUGGCACUUGCUUUUAUUA-3' | (SEQ ID NO: 17214) |
| C5-5217 | 19 nt | Target #2: | 5'-AGUGGCACUUGCUUUUAUU-3' | (SEQ ID NO: 19524) |
| C5-5217 | 19 nt | Target #3: | 5'-UAGUGGCACUUGCUUUUAU-3' | (SEQ ID NO: 21834) |
| C5-5218 | 19 nt | Target #1: | 5'-UGGCACUUGCUUUUAUUAG-3' | (SEQ ID NO: 17215) |
| C5-5218 | 19 nt | Target #2: | 5'-GUGGCACUUGCUUUUAUUA-3' | (SEQ ID NO: 19525) |
| C5-5218 | 19 nt | Target #3: | 5'-AGUGGCACUUGCUUUUAUU-3' | (SEQ ID NO: 21835) |
| C5-5219 | 19 nt | Target #1: | 5'-GGCACUUGCUUUUAUUAGA-3' | (SEQ ID NO: 17216) |
| C5-5219 | 19 nt | Target #2: | 5'-UGGCACUUGCUUUUAUUAG-3' | (SEQ ID NO: 19526) |
| C5-5219 | 19 nt | Target #3: | 5'-GUGGCACUUGCUUUUAUUA-3' | (SEQ ID NO: 21836) |
| C5-5220 | 19 nt | Target #1: | 5'-GCACUUGCUUUUAUUAGAG-3' | (SEQ ID NO: 17217) |
| C5-5220 | 19 nt | Target #2: | 5'-GGCACUUGCUUUUAUUAGA-3' | (SEQ ID NO: 19527) |
| C5-5220 | 19 nt | Target #3: | 5'-UGGCACUUGCUUUUAUUAG-3' | (SEQ ID NO: 21837) |
| C5-5221 | 19 nt | Target #1: | 5'-CACUUGCUUUUAUUAGAGA-3' | (SEQ ID NO: 17218) |
| C5-5221 | 19 nt | Target #2: | 5'-GCACUUGCUUUUAUUAGAG-3' | (SEQ ID NO: 19528) |
| C5-5221 | 19 nt | Target #3: | 5'-GGCACUUGCUUUUAUUAGA-3' | (SEQ ID NO: 21838) |
| C5-5222 | 19 nt | Target #1: | 5'-ACUUGCUUUUAUUAGAGAA-3' | (SEQ ID NO: 17219) |
| C5-5222 | 19 nt | Target #2: | 5'-CACUUGCUUUUAUUAGAGA-3' | (SEQ ID NO: 19529) |
| C5-5222 | 19 nt | Target #3: | 5'-GCACUUGCUUUUAUUAGAG-3' | (SEQ ID NO: 21839) |
| C5-5223 | 19 nt | Target #1: | 5'-CUUGCUUUUAUUAGAGAAU-3' | (SEQ ID NO: 17220) |
| C5-5223 | 19 nt | Target #2: | 5'-ACUUGCUUUUAUUAGAGAA-3' | (SEQ ID NO: 19530) |
| C5-5223 | 19 nt | Target #3: | 5'-CACUUGCUUUUAUUAGAGA-3' | (SEQ ID NO: 21840) |
| C5-5228 | 19 nt | Target #1: | 5'-UUUUAUUAGAGAAUGAUUU-3' | (SEQ ID NO: 17221) |
| C5-5228 | 19 nt | Target #2: | 5'-CUUUUAUUAGAGAAUGAUU-3' | (SEQ ID NO: 19531) |
| C5-5228 | 19 nt | Target #3: | 5'-GCUUUUAUUAGAGAAUGAU-3' | (SEQ ID NO: 21841) |
| C5-5252 | 19 nt | Target #1: | 5'-GCUGUAACUUUCUGAAAUA-3' | (SEQ ID NO: 17222) |
| C5-5252 | 19 nt | Target #2: | 5'-UGCUGUAACUUUCUGAAAU-3' | (SEQ ID NO: 19532) |
| C5-5252 | 19 nt | Target #3: | 5'-AUGCUGUAACUUUCUGAAA-3' | (SEQ ID NO: 21842) |
| C5-5253 | 19 nt | Target #1: | 5'-CUGUAACUUUCUGAAAUAA-3' | (SEQ ID NO: 17223) |
| C5-5253 | 19 nt | Target #2: | 5'-GCUGUAACUUUCUGAAAUA-3' | (SEQ ID NO: 19533) |
| C5-5253 | 19 nt | Target #3: | 5'-UGCUGUAACUUUCUGAAAU-3' | (SEQ ID NO: 21843) |
| C5-5254 | 19 nt | Target #1: | 5'-UGUAACUUUCUGAAAUAAC-3' | (SEQ ID NO: 17224) |
| C5-5254 | 19 nt | Target #2: | 5'-CUGUAACUUUCUGAAAUAA-3' | (SEQ ID NO: 19534) |
| C5-5254 | 19 nt | Target #3: | 5'-GCUGUAACUUUCUGAAAUA-3' | (SEQ ID NO: 21844) |
| C5-5255 | 19 nt | Target #1: | 5'-GUAACUUUCUGAAAUAACA-3' | (SEQ ID NO: 17225) |
| C5-5255 | 19 nt | Target #2: | 5'-UGUAACUUUCUGAAAUAAC-3' | (SEQ ID NO: 19535) |
| C5-5255 | 19 nt | Target #3: | 5'-CUGUAACUUUCUGAAAUAA-3' | (SEQ ID NO: 21845) |
| C5-5256 | 19 nt | Target #1: | 5'-UAACUUUCUGAAAUAACAU-3' | (SEQ ID NO: 17226) |
| C5-5256 | 19 nt | Target #2: | 5'-GUAACUUUCUGAAAUAACA-3' | (SEQ ID NO: 19536) |
| C5-5256 | 19 nt | Target #3: | 5'-UGUAACUUUCUGAAAUAAC-3' | (SEQ ID NO: 21846) |
| C5-5257 | 19 nt | Target #1: | 5'-AACUUUCUGAAAUAACAUG-3' | (SEQ ID NO: 17227) |
| C5-5257 | 19 nt | Target #2: | 5'-UAACUUUCUGAAAUAACAU-3' | (SEQ ID NO: 19537) |
| C5-5257 | 19 nt | Target #3: | 5'-GUAACUUUCUGAAAUAACA-3' | (SEQ ID NO: 21847) |
| C5-5258 | 19 nt | Target #1: | 5'-ACUUUCUGAAAUAACAUGG-3' | (SEQ ID NO: 17228) |
| C5-5258 | 19 nt | Target #2: | 5'-AACUUUCUGAAAUAACAUG-3' | (SEQ ID NO: 19538) |
| C5-5258 | 19 nt | Target #3: | 5'-UAACUUUCUGAAAUAACAU-3' | (SEQ ID NO: 21848) |
| C5-5259 | 19 nt | Target #1: | 5'-CUUUCUGAAAUAACAUGGC-3' | (SEQ ID NO: 17229) |
| C5-5259 | 19 nt | Target #2: | 5'-ACUUUCUGAAAUAACAUGG-3' | (SEQ ID NO: 19539) |
| C5-5259 | 19 nt | Target #3: | 5'-AACUUUCUGAAAUAACAUG-3' | (SEQ ID NO: 21849) |
| C5-5260 | 19 nt | Target #1: | 5'-UUUCUGAAAUAACAUGGCC-3' | (SEQ ID NO: 17230) |
| C5-5260 | 19 nt | Target #2: | 5'-CUUUCUGAAAUAACAUGGC-3' | (SEQ ID NO: 19540) |
| C5-5260 | 19 nt | Target #3: | 5'-ACUUUCUGAAAUAACAUGG-3' | (SEQ ID NO: 21850) |
| C5-5261 | 19 nt | Target #1: | 5'-UUCUGAAAUAACAUGGCCU-3' | (SEQ ID NO: 17231) |
| C5-5261 | 19 nt | Target #2: | 5'-UUUCUGAAAUAACAUGGCC-3' | (SEQ ID NO: 19541) |
| C5-5261 | 19 nt | Target #3: | 5'-CUUUCUGAAAUAACAUGGC-3' | (SEQ ID NO: 21851) |
| C5-5262 | 19 nt | Target #1: | 5'-UCUGAAAUAACAUGGCCUU-3' | (SEQ ID NO: 17232) |
| C5-5262 | 19 nt | Target #2: | 5'-UUCUGAAAUAACAUGGCCU-3' | (SEQ ID NO: 19542) |
| C5-5262 | 19 nt | Target #3: | 5'-UUUCUGAAAUAACAUGGCC-3' | (SEQ ID NO: 21852) |
| C5-5263 | 19 nt | Target #1: | 5'-CUGAAAUAACAUGGCCUUG-3' | (SEQ ID NO: 17233) |
| C5-5263 | 19 nt | Target #2: | 5'-UCUGAAAUAACAUGGCCUU-3' | (SEQ ID NO: 19543) |
| C5-5263 | 19 nt | Target #3: | 5'-UUCUGAAAUAACAUGGCCU-3' | (SEQ ID NO: 21853) |
| C5-5264 | 19 nt | Target #1: | 5'-UGAAAUAACAUGGCCUUGG-3' | (SEQ ID NO: 17234) |
| C5-5264 | 19 nt | Target #2: | 5'-CUGAAAUAACAUGGCCUUG-3' | (SEQ ID NO: 19544) |
| C5-5264 | 19 nt | Target #3: | 5'-UCUGAAAUAACAUGGCCUU-3' | (SEQ ID NO: 21854) |
| C5-5265 | 19 nt | Target #1: | 5'-GAAAUAACAUGGCCUUGGA-3' | (SEQ ID NO: 17235) |
| C5-5265 | 19 nt | Target #2: | 5'-UGAAAUAACAUGGCCUUGG-3' | (SEQ ID NO: 19545) |
| C5-5265 | 19 nt | Target #3: | 5'-CUGAAAUAACAUGGCCUUG-3' | (SEQ ID NO: 21855) |
| C5-5266 | 19 nt | Target #1: | 5'-AAAUAACAUGGCCUUGGAG-3' | (SEQ ID NO: 17236) |
| C5-5266 | 19 nt | Target #2: | 5'-GAAAUAACAUGGCCUUGGA-3' | (SEQ ID NO: 19546) |
| C5-5266 | 19 nt | Target #3: | 5'-UGAAAUAACAUGGCCUUGG-3' | (SEQ ID NO: 21856) |
| C5-5267 | 19 nt | Target #1: | 5'-AAUAACAUGGCCUUGGAGG-3' | (SEQ ID NO: 17237) |
| C5-5267 | 19 nt | Target #2: | 5'-AAAUAACAUGGCCUUGGAG-3' | (SEQ ID NO: 19547) |
| C5-5267 | 19 nt | Target #3: | 5'-GAAAUAACAUGGCCUUGGA-3' | (SEQ ID NO: 21857) |
| C5-5268 | 19 nt | Target #1: | 5'-AUAACAUGGCCUUGGAGGG-3' | (SEQ ID NO: 17238) |
| C5-5268 | 19 nt | Target #2: | 5'-AAUAACAUGGCCUUGGAGG-3' | (SEQ ID NO: 19548) |
| C5-5268 | 19 nt | Target #3: | 5'-AAAUAACAUGGCCUUGGAG-3' | (SEQ ID NO: 21858) |

TABLE 10-continued

| DsiRNA Component 19 Nucleotide Target Sequences of Human Anti-C5 DsiRNAs Predicted to have >50% Knockdown Efficacy | | | | |
|---|---|---|---|---|
| C5-5269 | 19 nt | Target #1: | 5'-UAACAUGGCCUUGGAGGGC-3' | (SEQ ID NO: 17239) |
| C5-5269 | 19 nt | Target #2: | 5'-AUAACAUGGCCUUGGAGGG-3' | (SEQ ID NO: 19549) |
| C5-5269 | 19 nt | Target #3: | 5'-AAUAACAUGGCCUUGGAGG-3' | (SEQ ID NO: 21859) |
| C5-5270 | 19 nt | Target #1: | 5'-AACAUGGCCUUGGAGGGCA-3' | (SEQ ID NO: 17240) |
| C5-5270 | 19 nt | Target #2: | 5'-UAACAUGGCCUUGGAGGGC-3' | (SEQ ID NO: 19550) |
| C5-5270 | 19 nt | Target #3: | 5'-AUAACAUGGCCUUGGAGGG-3' | (SEQ ID NO: 21860) |
| C5-5271 | 19 nt | Target #1: | 5'-ACAUGGCCUUGGAGGGCAU-3' | (SEQ ID NO: 17241) |
| C5-5271 | 19 nt | Target #2: | 5'-AACAUGGCCUUGGAGGGCA-3' | (SEQ ID NO: 19551) |
| C5-5271 | 19 nt | Target #3: | 5'-UAACAUGGCCUUGGAGGGC-3' | (SEQ ID NO: 21861) |
| C5-5272 | 19 nt | Target #1: | 5'-CAUGGCCUUGGAGGGCAUG-3' | (SEQ ID NO: 17242) |
| C5-5272 | 19 nt | Target #2: | 5'-ACAUGGCCUUGGAGGGCAU-3' | (SEQ ID NO: 19552) |
| C5-5272 | 19 nt | Target #3: | 5'-AACAUGGCCUUGGAGGGCA-3' | (SEQ ID NO: 21862) |
| C5-5273 | 19 nt | Target #1: | 5'-AUGGCCUUGGAGGGCAUGA-3' | (SEQ ID NO: 17243) |
| C5-5273 | 19 nt | Target #2: | 5'-CAUGGCCUUGGAGGGCAUG-3' | (SEQ ID NO: 19553) |
| C5-5273 | 19 nt | Target #3: | 5'-ACAUGGCCUUGGAGGGCAU-3' | (SEQ ID NO: 21863) |
| C5-5274 | 19 nt | Target #1: | 5'-UGGCCUUGGAGGGCAUGAA-3' | (SEQ ID NO: 17244) |
| C5-5274 | 19 nt | Target #2: | 5'-AUGGCCUUGGAGGGCAUGA-3' | (SEQ ID NO: 19554) |
| C5-5274 | 19 nt | Target #3: | 5'-CAUGGCCUUGGAGGGCAUG-3' | (SEQ ID NO: 21864) |
| C5-5275 | 19 nt | Target #1: | 5'-GGCCUUGGAGGGCAUGAAG-3' | (SEQ ID NO: 17245) |
| C5-5275 | 19 nt | Target #2: | 5'-UGGCCUUGGAGGGCAUGAA-3' | (SEQ ID NO: 19555) |
| C5-5275 | 19 nt | Target #3: | 5'-AUGGCCUUGGAGGGCAUGA-3' | (SEQ ID NO: 21865) |
| C5-5276 | 19 nt | Target #1: | 5'-GCCUUGGAGGGCAUGAAGA-3' | (SEQ ID NO: 17246) |
| C5-5276 | 19 nt | Target #2: | 5'-GGCCUUGGAGGGCAUGAAG-3' | (SEQ ID NO: 19556) |
| C5-5276 | 19 nt | Target #3: | 5'-UGGCCUUGGAGGGCAUGAA-3' | (SEQ ID NO: 21866) |
| C5-5277 | 19 nt | Target #1: | 5'-CCUUGGAGGGCAUGAAGAC-3' | (SEQ ID NO: 17247) |
| C5-5277 | 19 nt | Target #2: | 5'-GCCUUGGAGGGCAUGAAGA-3' | (SEQ ID NO: 19557) |
| C5-5277 | 19 nt | Target #3: | 5'-GGCCUUGGAGGGCAUGAAG-3' | (SEQ ID NO: 21867) |
| C5-5278 | 19 nt | Target #1: | 5'-CUUGGAGGGCAUGAAGACA-3' | (SEQ ID NO: 17248) |
| C5-5278 | 19 nt | Target #2: | 5'-CCUUGGAGGGCAUGAAGAC-3' | (SEQ ID NO: 19558) |
| C5-5278 | 19 nt | Target #3: | 5'-GCCUUGGAGGGCAUGAAGA-3' | (SEQ ID NO: 21868) |
| C5-5279 | 19 nt | Target #1: | 5'-UUGGAGGGCAUGAAGACAG-3' | (SEQ ID NO: 17249) |
| C5-5279 | 19 nt | Target #2: | 5'-CUUGGAGGGCAUGAAGACA-3' | (SEQ ID NO: 19559) |
| C5-5279 | 19 nt | Target #3: | 5'-CCUUGGAGGGCAUGAAGAC-3' | (SEQ ID NO: 21869) |
| C5-5280 | 19 nt | Target #1: | 5'-UGGAGGGCAUGAAGACAGA-3' | (SEQ ID NO: 17250) |
| C5-5280 | 19 nt | Target #2: | 5'-UUGGAGGGCAUGAAGACAG-3' | (SEQ ID NO: 19560) |
| C5-5280 | 19 nt | Target #3: | 5'-CUUGGAGGGCAUGAAGACA-3' | (SEQ ID NO: 21870) |
| C5-5281 | 19 nt | Target #1: | 5'-GGAGGGCAUGAAGACAGAU-3' | (SEQ ID NO: 17251) |
| C5-5281 | 19 nt | Target #2: | 5'-UGGAGGGCAUGAAGACAGA-3' | (SEQ ID NO: 19561) |
| C5-5281 | 19 nt | Target #3: | 5'-UUGGAGGGCAUGAAGACAG-3' | (SEQ ID NO: 21871) |
| C5-5282 | 19 nt | Target #1: | 5'-GAGGGCAUGAAGACAGAUA-3' | (SEQ ID NO: 17252) |
| C5-5282 | 19 nt | Target #2: | 5'-GGAGGGCAUGAAGACAGAU-3' | (SEQ ID NO: 19562) |
| C5-5282 | 19 nt | Target #3: | 5'-UGGAGGGCAUGAAGACAGA-3' | (SEQ ID NO: 21872) |
| C5-5283 | 19 nt | Target #1: | 5'-AGGGCAUGAAGACAGAUAC-3' | (SEQ ID NO: 17253) |
| C5-5283 | 19 nt | Target #2: | 5'-GAGGGCAUGAAGACAGAUA-3' | (SEQ ID NO: 19563) |
| C5-5283 | 19 nt | Target #3: | 5'-GGAGGGCAUGAAGACAGAU-3' | (SEQ ID NO: 21873) |
| C5-5284 | 19 nt | Target #1: | 5'-GGGCAUGAAGACAGAUACU-3' | (SEQ ID NO: 17254) |
| C5-5284 | 19 nt | Target #2: | 5'-AGGGCAUGAAGACAGAUAC-3' | (SEQ ID NO: 19564) |
| C5-5284 | 19 nt | Target #3: | 5'-GAGGGCAUGAAGACAGAUA-3' | (SEQ ID NO: 21874) |
| C5-5285 | 19 nt | Target #1: | 5'-GGCAUGAAGACAGAUACUC-3' | (SEQ ID NO: 17255) |
| C5-5285 | 19 nt | Target #2: | 5'-GGGCAUGAAGACAGAUACU-3' | (SEQ ID NO: 19565) |
| C5-5285 | 19 nt | Target #3: | 5'-AGGGCAUGAAGACAGAUAC-3' | (SEQ ID NO: 21875) |
| C5-5286 | 19 nt | Target #1: | 5'-GCAUGAAGACAGAUACUCC-3' | (SEQ ID NO: 17256) |
| C5-5286 | 19 nt | Target #2: | 5'-GGCAUGAAGACAGAUACUC-3' | (SEQ ID NO: 19566) |
| C5-5286 | 19 nt | Target #3: | 5'-GGGCAUGAAGACAGAUACU-3' | (SEQ ID NO: 21876) |
| C5-5287 | 19 nt | Target #1: | 5'-CAUGAAGACAGAUACUCCU-3' | (SEQ ID NO: 17257) |
| C5-5287 | 19 nt | Target #2: | 5'-GCAUGAAGACAGAUACUCC-3' | (SEQ ID NO: 19567) |
| C5-5287 | 19 nt | Target #3: | 5'-GGCAUGAAGACAGAUACUC-3' | (SEQ ID NO: 21877) |
| C5-5288 | 19 nt | Target #1: | 5'-AUGAAGACAGAUACUCCUC-3' | (SEQ ID NO: 17258) |
| C5-5288 | 19 nt | Target #2: | 5'-CAUGAAGACAGAUACUCCU-3' | (SEQ ID NO: 19568) |
| C5-5288 | 19 nt | Target #3: | 5'-GCAUGAAGACAGAUACUCC-3' | (SEQ ID NO: 21878) |
| C5-5289 | 19 nt | Target #1: | 5'-UGAAGACAGAUACUCCUCC-3' | (SEQ ID NO: 17259) |
| C5-5289 | 19 nt | Target #2: | 5'-AUGAAGACAGAUACUCCUC-3' | (SEQ ID NO: 19569) |
| C5-5289 | 19 nt | Target #3: | 5'-CAUGAAGACAGAUACUCCU-3' | (SEQ ID NO: 21879) |
| C5-5290 | 19 nt | Target #1: | 5'-GAAGACAGAUACUCCUCCA-3' | (SEQ ID NO: 17260) |
| C5-5290 | 19 nt | Target #2: | 5'-UGAAGACAGAUACUCCUCC-3' | (SEQ ID NO: 19570) |
| C5-5290 | 19 nt | Target #3: | 5'-AUGAAGACAGAUACUCCUC-3' | (SEQ ID NO: 21880) |
| C5-5291 | 19 nt | Target #1: | 5'-AAGACAGAUACUCCUCCAA-3' | (SEQ ID NO: 17261) |
| C5-5291 | 19 nt | Target #2: | 5'-GAAGACAGAUACUCCUCCA-3' | (SEQ ID NO: 19571) |
| C5-5291 | 19 nt | Target #3: | 5'-UGAAGACAGAUACUCCUCC-3' | (SEQ ID NO: 21881) |
| C5-5292 | 19 nt | Target #1: | 5'-AGACAGAUACUCCUCCAAG-3' | (SEQ ID NO: 17262) |
| C5-5292 | 19 nt | Target #2: | 5'-AAGACAGAUACUCCUCCAA-3' | (SEQ ID NO: 19572) |
| C5-5292 | 19 nt | Target #3: | 5'-GAAGACAGAUACUCCUCCA-3' | (SEQ ID NO: 21882) |
| C5-5293 | 19 nt | Target #1: | 5'-GACAGAUACUCCUCCAAGG-3' | (SEQ ID NO: 17263) |
| C5-5293 | 19 nt | Target #2: | 5'-AGACAGAUACUCCUCCAAG-3' | (SEQ ID NO: 19573) |
| C5-5293 | 19 nt | Target #3: | 5'-AAGACAGAUACUCCUCCAA-3' | (SEQ ID NO: 21883) |
| C5-5294 | 19 nt | Target #1: | 5'-ACAGAUACUCCUCCAAGGU-3' | (SEQ ID NO: 17264) |
| C5-5294 | 19 nt | Target #2: | 5'-GACAGAUACUCCUCCAAGG-3' | (SEQ ID NO: 19574) |

TABLE 10-continued

DsiRNA Component 19 Nucleotide Target Sequences of Human Anti-C5 DsiRNAs Predicted to have >50% Knockdown Efficacy

| | | | | |
|---|---|---|---|---|
| C5-5294 | 19 nt | Target #3: | 5'-AGACAGAUACUCCUCCAAG-3' | (SEQ ID NO: 21884) |
| C5-5296 | 19 nt | Target #1: | 5'-AGAUACUCCUCCAAGGUUA-3' | (SEQ ID NO: 17265) |
| C5-5296 | 19 nt | Target #2: | 5'-CAGAUACUCCUCCAAGGUU-3' | (SEQ ID NO: 19575) |
| C5-5296 | 19 nt | Target #3: | 5'-ACAGAUACUCCUCCAAGGU-3' | (SEQ ID NO: 21885) |
| C5-5297 | 19 nt | Target #1: | 5'-GAUACUCCUCCAAGGUUAU-3' | (SEQ ID NO: 17266) |
| C5-5297 | 19 nt | Target #2: | 5'-AGAUACUCCUCCAAGGUUA-3' | (SEQ ID NO: 19576) |
| C5-5297 | 19 nt | Target #3: | 5'-CAGAUACUCCUCCAAGGUU-3' | (SEQ ID NO: 21886) |
| C5-5298 | 19 nt | Target #1: | 5'-AUACUCCUCCAAGGUUAUU-3' | (SEQ ID NO: 17267) |
| C5-5298 | 19 nt | Target #2: | 5'-GAUACUCCUCCAAGGUUAU-3' | (SEQ ID NO: 19577) |
| C5-5298 | 19 nt | Target #3: | 5'-AGAUACUCCUCCAAGGUUA-3' | (SEQ ID NO: 21887) |
| C5-5299 | 19 nt | Target #1: | 5'-UACUCCUCCAAGGUUAUUG-3' | (SEQ ID NO: 17268) |
| C5-5299 | 19 nt | Target #2: | 5'-AUACUCCUCCAAGGUUAUU-3' | (SEQ ID NO: 19578) |
| C5-5299 | 19 nt | Target #3: | 5'-GAUACUCCUCCAAGGUUAU-3' | (SEQ ID NO: 21888) |
| C5-5300 | 19 nt | Target #1: | 5'-ACUCCUCCAAGGUUAUUGG-3' | (SEQ ID NO: 17269) |
| C5-5300 | 19 nt | Target #2: | 5'-UACUCCUCCAAGGUUAUUG-3' | (SEQ ID NO: 19579) |
| C5-5300 | 19 nt | Target #3: | 5'-AUACUCCUCCAAGGUUAUU-3' | (SEQ ID NO: 21889) |
| C5-5301 | 19 nt | Target #1: | 5'-CUCCUCCAAGGUUAUUGGA-3' | (SEQ ID NO: 17270) |
| C5-5301 | 19 nt | Target #2: | 5'-ACUCCUCCAAGGUUAUUGG-3' | (SEQ ID NO: 19580) |
| C5-5301 | 19 nt | Target #3: | 5'-UACUCCUCCAAGGUUAUUG-3' | (SEQ ID NO: 21890) |
| C5-5302 | 19 nt | Target #1: | 5'-UCCUCCAAGGUUAUUGGAC-3' | (SEQ ID NO: 17271) |
| C5-5302 | 19 nt | Target #2: | 5'-CUCCUCCAAGGUUAUUGGA-3' | (SEQ ID NO: 19581) |
| C5-5302 | 19 nt | Target #3: | 5'-ACUCCUCCAAGGUUAUUGG-3' | (SEQ ID NO: 21891) |
| C5-5303 | 19 nt | Target #1: | 5'-CCUCCAAGGUUAUUGGACA-3' | (SEQ ID NO: 17272) |
| C5-5303 | 19 nt | Target #2: | 5'-UCCUCCAAGGUUAUUGGAC-3' | (SEQ ID NO: 19582) |
| C5-5303 | 19 nt | Target #3: | 5'-CUCCUCCAAGGUUAUUGGA-3' | (SEQ ID NO: 21892) |
| C5-5304 | 19 nt | Target #1: | 5'-CUCCAAGGUUAUUGGACAC-3' | (SEQ ID NO: 17273) |
| C5-5304 | 19 nt | Target #2: | 5'-CCUCCAAGGUUAUUGGACA-3' | (SEQ ID NO: 19583) |
| C5-5304 | 19 nt | Target #3: | 5'-UCCUCCAAGGUUAUUGGAC-3' | (SEQ ID NO: 21893) |
| C5-5305 | 19 nt | Target #1: | 5'-UCCAAGGUUAUUGGACACC-3' | (SEQ ID NO: 17274) |
| C5-5305 | 19 nt | Target #2: | 5'-CUCCAAGGUUAUUGGACAC-3' | (SEQ ID NO: 19584) |
| C5-5305 | 19 nt | Target #3: | 5'-CCUCCAAGGUUAUUGGACA-3' | (SEQ ID NO: 21894) |
| C5-5306 | 19 nt | Target #1: | 5'-CCAAGGUUAUUGGACACCG-3' | (SEQ ID NO: 17275) |
| C5-5306 | 19 nt | Target #2: | 5'-UCCAAGGUUAUUGGACACC-3' | (SEQ ID NO: 19585) |
| C5-5306 | 19 nt | Target #3: | 5'-CUCCAAGGUUAUUGGACAC-3' | (SEQ ID NO: 21895) |
| C5-5307 | 19 nt | Target #1: | 5'-CAAGGUUAUUGGACACCGG-3' | (SEQ ID NO: 17276) |
| C5-5307 | 19 nt | Target #2: | 5'-CCAAGGUUAUUGGACACCG-3' | (SEQ ID NO: 19586) |
| C5-5307 | 19 nt | Target #3: | 5'-UCCAAGGUUAUUGGACACC-3' | (SEQ ID NO: 21896) |
| C5-5308 | 19 nt | Target #1: | 5'-AAGGUUAUUGGACACCGGA-3' | (SEQ ID NO: 17277) |
| C5-5308 | 19 nt | Target #2: | 5'-CAAGGUUAUUGGACACCGG-3' | (SEQ ID NO: 19587) |
| C5-5308 | 19 nt | Target #3: | 5'-CCAAGGUUAUUGGACACCG-3' | (SEQ ID NO: 21897) |
| C5-5309 | 19 nt | Target #1: | 5'-AGGUUAUUGGACACCGGAA-3' | (SEQ ID NO: 17278) |
| C5-5309 | 19 nt | Target #2: | 5'-AAGGUUAUUGGACACCGGA-3' | (SEQ ID NO: 19588) |
| C5-5309 | 19 nt | Target #3: | 5'-CAAGGUUAUUGGACACCGG-3' | (SEQ ID NO: 21898) |
| C5-5310 | 19 nt | Target #1: | 5'-GGUUAUUGGACACCGGAAA-3' | (SEQ ID NO: 17279) |
| C5-5310 | 19 nt | Target #2: | 5'-AGGUUAUUGGACACCGGAA-3' | (SEQ ID NO: 19589) |
| C5-5310 | 19 nt | Target #3: | 5'-AAGGUUAUUGGACACCGGA-3' | (SEQ ID NO: 21899) |
| C5-5311 | 19 nt | Target #1: | 5'-GUUAUUGGACACCGGAAAC-3' | (SEQ ID NO: 17280) |
| C5-5311 | 19 nt | Target #2: | 5'-GGUUAUUGGACACCGGAAA-3' | (SEQ ID NO: 19590) |
| C5-5311 | 19 nt | Target #3: | 5'-AGGUUAUUGGACACCGGAA-3' | (SEQ ID NO: 21900) |
| C5-5312 | 19 nt | Target #1: | 5'-UUAUUGGACACCGGAAACA-3' | (SEQ ID NO: 17281) |
| C5-5312 | 19 nt | Target #2: | 5'-GUUAUUGGACACCGGAAAC-3' | (SEQ ID NO: 19591) |
| C5-5312 | 19 nt | Target #3: | 5'-GGUUAUUGGACACCGGAAA-3' | (SEQ ID NO: 21901) |
| C5-5313 | 19 nt | Target #1: | 5'-UAUUGGACACCGGAAACAA-3' | (SEQ ID NO: 17282) |
| C5-5313 | 19 nt | Target #2: | 5'-UUAUUGGACACCGGAAACA-3' | (SEQ ID NO: 19592) |
| C5-5313 | 19 nt | Target #3: | 5'-GUUAUUGGACACCGGAAAC-3' | (SEQ ID NO: 21902) |
| C5-5314 | 19 nt | Target #1: | 5'-AUUGGACACCGGAAACAAU-3' | (SEQ ID NO: 17283) |
| C5-5314 | 19 nt | Target #2: | 5'-UAUUGGACACCGGAAACAA-3' | (SEQ ID NO: 19593) |
| C5-5314 | 19 nt | Target #3: | 5'-UUAUUGGACACCGGAAACA-3' | (SEQ ID NO: 21903) |
| C5-5315 | 19 nt | Target #1: | 5'-UUGGACACCGGAAACAAUA-3' | (SEQ ID NO: 17284) |
| C5-5315 | 19 nt | Target #2: | 5'-AUUGGACACCGGAAACAAU-3' | (SEQ ID NO: 19594) |
| C5-5315 | 19 nt | Target #3: | 5'-UAUUGGACACCGGAAACAA-3' | (SEQ ID NO: 21904) |
| C5-5316 | 19 nt | Target #1: | 5'-UGGACACCGGAAACAAUAA-3' | (SEQ ID NO: 17285) |
| C5-5316 | 19 nt | Target #2: | 5'-UUGGACACCGGAAACAAUA-3' | (SEQ ID NO: 19595) |
| C5-5316 | 19 nt | Target #3: | 5'-AUUGGACACCGGAAACAAU-3' | (SEQ ID NO: 21905) |
| C5-5317 | 19 nt | Target #1: | 5'-GGACACCGGAAACAAUAAA-3' | (SEQ ID NO: 17286) |
| C5-5317 | 19 nt | Target #2: | 5'-UGGACACCGGAAACAAUAA-3' | (SEQ ID NO: 19596) |
| C5-5317 | 19 nt | Target #3: | 5'-UUGGACACCGGAAACAAUA-3' | (SEQ ID NO: 21906) |
| C5-5318 | 19 nt | Target #1: | 5'-GACACCGGAAACAAUAAAU-3' | (SEQ ID NO: 17287) |
| C5-5318 | 19 nt | Target #2: | 5'-GGACACCGGAAACAAUAAA-3' | (SEQ ID NO: 19597) |
| C5-5318 | 19 nt | Target #3: | 5'-UGGACACCGGAAACAAUAA-3' | (SEQ ID NO: 21907) |
| C5-5319 | 19 nt | Target #1: | 5'-ACACCGGAAACAAUAAAUU-3' | (SEQ ID NO: 17288) |
| C5-5319 | 19 nt | Target #2: | 5'-GACACCGGAAACAAUAAAU-3' | (SEQ ID NO: 19598) |
| C5-5319 | 19 nt | Target #3: | 5'-GGACACCGGAAACAAUAAA-3' | (SEQ ID NO: 21908) |
| C5-5339 | 19 nt | Target #1: | 5'-GAACACCUCCUCAAACCUA-3' | (SEQ ID NO: 17289) |
| C5-5339 | 19 nt | Target #2: | 5'-GGAACACCUCCUCAAACCU-3' | (SEQ ID NO: 19599) |
| C5-5339 | 19 nt | Target #3: | 5'-UGGAACACCUCCUCAAACC-3' | (SEQ ID NO: 21909) |
| C5-5340 | 19 nt | Target #1: | 5'-AACACCUCCUCAAACCUAC-3' | (SEQ ID NO: 17290) |

TABLE 10-continued

DsiRNA Component 19 Nucleotide Target Sequences of Human Anti-C5
DsiRNAs Predicted to have >50% Knockdown Efficacy

| | | | | |
|---|---|---|---|---|
| C5-5340 | 19 nt | Target #2: | 5'-GAACACCUCCUCAAACCUA-3' | (SEQ ID NO: 19600) |
| C5-5340 | 19 nt | Target #3: | 5'-GGAACACCUCCUCAAACCU-3' | (SEQ ID NO: 21910) |
| C5-5341 | 19 nt | Target #1: | 5'-ACACCUCCUCAAACCUACC-3' | (SEQ ID NO: 17291) |
| C5-5341 | 19 nt | Target #2: | 5'-AACACCUCCUCAAACCUAC-3' | (SEQ ID NO: 19601) |
| C5-5341 | 19 nt | Target #3: | 5'-GAACACCUCCUCAAACCUA-3' | (SEQ ID NO: 21911) |
| C5-5342 | 19 nt | Target #1: | 5'-CACCUCCUCAAACCUACCA-3' | (SEQ ID NO: 17292) |
| C5-5342 | 19 nt | Target #2: | 5'-ACACCUCCUCAAACCUACC-3' | (SEQ ID NO: 19602) |
| C5-5342 | 19 nt | Target #3: | 5'-AACACCUCCUCAAACCUAC-3' | (SEQ ID NO: 21912) |
| C5-5343 | 19 nt | Target #1: | 5'-ACCUCCUCAAACCUACCAC-3' | (SEQ ID NO: 17293) |
| C5-5343 | 19 nt | Target #2: | 5'-CACCUCCUCAAACCUACCA-3' | (SEQ ID NO: 19603) |
| C5-5343 | 19 nt | Target #3: | 5'-ACACCUCCUCAAACCUACC-3' | (SEQ ID NO: 21913) |
| C5-5344 | 19 nt | Target #1: | 5'-CCUCCUCAAACCUACCACU-3' | (SEQ ID NO: 17294) |
| C5-5344 | 19 nt | Target #2: | 5'-ACCUCCUCAAACCUACCAC-3' | (SEQ ID NO: 19604) |
| C5-5344 | 19 nt | Target #3: | 5'-CACCUCCUCAAACCUACCA-3' | (SEQ ID NO: 21914) |
| C5-5380 | 19 nt | Target #1: | 5'-GCCGAAAGAACAGUCCAUU-3' | (SEQ ID NO: 17295) |
| C5-5380 | 19 nt | Target #2: | 5'-GGCCGAAAGAACAGUCCAU-3' | (SEQ ID NO: 19605) |
| C5-5380 | 19 nt | Target #3: | 5'-GGGCCGAAAGAACAGUCCA-3' | (SEQ ID NO: 21915) |
| C5-5381 | 19 nt | Target #1: | 5'-CCGAAAGAACAGUCCAUUG-3' | (SEQ ID NO: 17296) |
| C5-5381 | 19 nt | Target #2: | 5'-GCCGAAAGAACAGUCCAUU-3' | (SEQ ID NO: 19606) |
| C5-5381 | 19 nt | Target #3: | 5'-GGCCGAAAGAACAGUCCAU-3' | (SEQ ID NO: 21916) |
| C5-5382 | 19 nt | Target #1: | 5'-CGAAAGAACAGUCCAUUGA-3' | (SEQ ID NO: 17297) |
| C5-5382 | 19 nt | Target #2: | 5'-CCGAAAGAACAGUCCAUUG-3' | (SEQ ID NO: 19607) |
| C5-5382 | 19 nt | Target #3: | 5'-GCCGAAAGAACAGUCCAUU-3' | (SEQ ID NO: 21917) |
| C5-5383 | 19 nt | Target #1: | 5'-GAAAGAACAGUCCAUUGAA-3' | (SEQ ID NO: 17298) |
| C5-5383 | 19 nt | Target #2: | 5'-CGAAAGAACAGUCCAUUGA-3' | (SEQ ID NO: 19608) |
| C5-5383 | 19 nt | Target #3: | 5'-CCGAAAGAACAGUCCAUUG-3' | (SEQ ID NO: 21918) |
| C5-5384 | 19 nt | Target #1: | 5'-AAAGAACAGUCCAUUGAAA-3' | (SEQ ID NO: 17299) |
| C5-5384 | 19 nt | Target #2: | 5'-GAAAGAACAGUCCAUUGAA-3' | (SEQ ID NO: 19609) |
| C5-5384 | 19 nt | Target #3: | 5'-CGAAAGAACAGUCCAUUGA-3' | (SEQ ID NO: 21919) |
| C5-5404 | 19 nt | Target #1: | 5'-GGAGUAUUACAAAAACAUG-3' | (SEQ ID NO: 17300) |
| C5-5404 | 19 nt | Target #2: | 5'-GGGAGUAUUACAAAAACAU-3' | (SEQ ID NO: 19610) |
| C5-5404 | 19 nt | Target #3: | 5'-AGGGAGUAUUACAAAAACA-3' | (SEQ ID NO: 21920) |
| C5-5405 | 19 nt | Target #1: | 5'-GAGUAUUACAAAAACAUGG-3' | (SEQ ID NO: 17301) |
| C5-5405 | 19 nt | Target #2: | 5'-GGAGUAUUACAAAAACAUG-3' | (SEQ ID NO: 19611) |
| C5-5405 | 19 nt | Target #3: | 5'-GGGAGUAUUACAAAAACAU-3' | (SEQ ID NO: 21921) |
| C5-5406 | 19 nt | Target #1: | 5'-AGUAUUACAAAAACAUGGC-3' | (SEQ ID NO: 17302) |
| C5-5406 | 19 nt | Target #2: | 5'-GAGUAUUACAAAAACAUGG-3' | (SEQ ID NO: 19612) |
| C5-5406 | 19 nt | Target #3: | 5'-GGAGUAUUACAAAAACAUG-3' | (SEQ ID NO: 21922) |
| C5-5407 | 19 nt | Target #1: | 5'-GUAUUACAAAAACAUGGCC-3' | (SEQ ID NO: 17303) |
| C5-5407 | 19 nt | Target #2: | 5'-AGUAUUACAAAAACAUGGC-3' | (SEQ ID NO: 19613) |
| C5-5407 | 19 nt | Target #3: | 5'-GAGUAUUACAAAAACAUGG-3' | (SEQ ID NO: 21923) |
| C5-5408 | 19 nt | Target #1: | 5'-UAUUACAAAAACAUGGCCU-3' | (SEQ ID NO: 17304) |
| C5-5408 | 19 nt | Target #2: | 5'-GUAUUACAAAAACAUGGCC-3' | (SEQ ID NO: 19614) |
| C5-5408 | 19 nt | Target #3: | 5'-AGUAUUACAAAAACAUGGC-3' | (SEQ ID NO: 21924) |
| C5-5409 | 19 nt | Target #1: | 5'-AUUACAAAAACAUGGCCUU-3' | (SEQ ID NO: 17305) |
| C5-5409 | 19 nt | Target #2: | 5'-UAUUACAAAAACAUGGCCU-3' | (SEQ ID NO: 19615) |
| C5-5409 | 19 nt | Target #3: | 5'-GUAUUACAAAAACAUGGCC-3' | (SEQ ID NO: 21925) |
| C5-5410 | 19 nt | Target #1: | 5'-UUACAAAAACAUGGCCUUU-3' | (SEQ ID NO: 17306) |
| C5-5410 | 19 nt | Target #2: | 5'-AUUACAAAAACAUGGCCUU-3' | (SEQ ID NO: 19616) |
| C5-5410 | 19 nt | Target #3: | 5'-UAUUACAAAAACAUGGCCU-3' | (SEQ ID NO: 21926) |
| C5-5411 | 19 nt | Target #1: | 5'-UACAAAAACAUGGCCUUUG-3' | (SEQ ID NO: 17307) |
| C5-5411 | 19 nt | Target #2: | 5'-UUACAAAAACAUGGCCUUU-3' | (SEQ ID NO: 19617) |
| C5-5411 | 19 nt | Target #3: | 5'-AUUACAAAAACAUGGCCUU-3' | (SEQ ID NO: 21927) |
| C5-5412 | 19 nt | Target #1: | 5'-ACAAAAACAUGGCCUUUGC-3' | (SEQ ID NO: 17308) |
| C5-5412 | 19 nt | Target #2: | 5'-UACAAAAACAUGGCCUUUG-3' | (SEQ ID NO: 19618) |
| C5-5412 | 19 nt | Target #3: | 5'-UUACAAAAACAUGGCCUUU-3' | (SEQ ID NO: 21928) |
| C5-5413 | 19 nt | Target #1: | 5'-CAAAAACAUGGCCUUUGCU-3' | (SEQ ID NO: 17309) |
| C5-5413 | 19 nt | Target #2: | 5'-ACAAAAACAUGGCCUUUGC-3' | (SEQ ID NO: 19619) |
| C5-5413 | 19 nt | Target #3: | 5'-UACAAAAACAUGGCCUUUG-3' | (SEQ ID NO: 21929) |
| C5-5414 | 19 nt | Target #1: | 5'-AAAAACAUGGCCUUUGCUU-3' | (SEQ ID NO: 17310) |
| C5-5414 | 19 nt | Target #2: | 5'-CAAAAACAUGGCCUUUGCU-3' | (SEQ ID NO: 19620) |
| C5-5414 | 19 nt | Target #3: | 5'-ACAAAAACAUGGCCUUUGC-3' | (SEQ ID NO: 21930) |
| C5-5415 | 19 nt | Target #1: | 5'-AAAACAUGGCCUUUGCUUG-3' | (SEQ ID NO: 17311) |
| C5-5415 | 19 nt | Target #2: | 5'-AAAAACAUGGCCUUUGCUU-3' | (SEQ ID NO: 19621) |
| C5-5415 | 19 nt | Target #3: | 5'-CAAAAACAUGGCCUUUGCU-3' | (SEQ ID NO: 21931) |
| C5-5416 | 19 nt | Target #1: | 5'-AAACAUGGCCUUUGCUUGA-3' | (SEQ ID NO: 17312) |
| C5-5416 | 19 nt | Target #2: | 5'-AAAACAUGGCCUUUGCUUG-3' | (SEQ ID NO: 19622) |
| C5-5416 | 19 nt | Target #3: | 5'-AAAAACAUGGCCUUUGCUU-3' | (SEQ ID NO: 21932) |
| C5-5417 | 19 nt | Target #1: | 5'-AACAUGGCCUUUGCUUGAA-3' | (SEQ ID NO: 17313) |
| C5-5417 | 19 nt | Target #2: | 5'-AAACAUGGCCUUUGCUUGA-3' | (SEQ ID NO: 19623) |
| C5-5417 | 19 nt | Target #3: | 5'-AAAACAUGGCCUUUGCUUG-3' | (SEQ ID NO: 21933) |
| C5-5418 | 19 nt | Target #1: | 5'-ACAUGGCCUUUGCUUGAAA-3' | (SEQ ID NO: 17314) |
| C5-5418 | 19 nt | Target #2: | 5'-AACAUGGCCUUUGCUUGAA-3' | (SEQ ID NO: 19624) |
| C5-5418 | 19 nt | Target #3: | 5'-AAACAUGGCCUUUGCUUGA-3' | (SEQ ID NO: 21934) |
| C5-5419 | 19 nt | Target #1: | 5'-CAUGGCCUUUGCUUGAAAG-3' | (SEQ ID NO: 17315) |
| C5-5419 | 19 nt | Target #2: | 5'-ACAUGGCCUUUGCUUGAAA-3' | (SEQ ID NO: 19625) |
| C5-5419 | 19 nt | Target #3: | 5'-AACAUGGCCUUUGCUUGAA-3' | (SEQ ID NO: 21935) |

TABLE 10-continued

DsiRNA Component 19 Nucleotide Target Sequences of Human Anti-C5 DsiRNAs Predicted to have >50% Knockdown Efficacy

| | | | | |
|---|---|---|---|---|
| C5-5420 | 19 nt | Target #1: | 5'-AUGGCCUUUGCUUGAAAGA-3' | (SEQ ID NO: 17316) |
| C5-5420 | 19 nt | Target #2: | 5'-CAUGGCCUUUGCUUGAAAG-3' | (SEQ ID NO: 19626) |
| C5-5420 | 19 nt | Target #3: | 5'-ACAUGGCCUUUGCUUGAAA-3' | (SEQ ID NO: 21936) |
| C5-5421 | 19 nt | Target #1: | 5'-UGGCCUUUGCUUGAAAGAA-3' | (SEQ ID NO: 17317) |
| C5-5421 | 19 nt | Target #2: | 5'-AUGGCCUUUGCUUGAAAGA-3' | (SEQ ID NO: 19627) |
| C5-5421 | 19 nt | Target #3: | 5'-CAUGGCCUUUGCUUGAAAG-3' | (SEQ ID NO: 21937) |
| C5-5422 | 19 nt | Target #1: | 5'-GGCCUUUGCUUGAAAGAAA-3' | (SEQ ID NO: 17318) |
| C5-5422 | 19 nt | Target #2: | 5'-UGGCCUUUGCUUGAAAGAA-3' | (SEQ ID NO: 19628) |
| C5-5422 | 19 nt | Target #3: | 5'-AUGGCCUUUGCUUGAAAGA-3' | (SEQ ID NO: 21938) |
| C5-5423 | 19 nt | Target #1: | 5'-GCCUUUGCUUGAAAGAAAA-3' | (SEQ ID NO: 17319) |
| C5-5423 | 19 nt | Target #2: | 5'-GGCCUUUGCUUGAAAGAAA-3' | (SEQ ID NO: 19629) |
| C5-5423 | 19 nt | Target #3: | 5'-UGGCCUUUGCUUGAAAGAA-3' | (SEQ ID NO: 21939) |
| C5-5424 | 19 nt | Target #1: | 5'-CCUUUGCUUGAAAGAAAAU-3' | (SEQ ID NO: 17320) |
| C5-5424 | 19 nt | Target #2: | 5'-GCCUUUGCUUGAAAGAAAA-3' | (SEQ ID NO: 19630) |
| C5-5424 | 19 nt | Target #3: | 5'-GGCCUUUGCUUGAAAGAAA-3' | (SEQ ID NO: 21940) |
| C5-5425 | 19 nt | Target #1: | 5'-CUUUGCUUGAAAGAAAAUA-3' | (SEQ ID NO: 17321) |
| C5-5425 | 19 nt | Target #2: | 5'-CCUUUGCUUGAAAGAAAAU-3' | (SEQ ID NO: 19631) |
| C5-5425 | 19 nt | Target #3: | 5'-GCCUUUGCUUGAAAGAAAA-3' | (SEQ ID NO: 21941) |
| C5-5426 | 19 nt | Target #1: | 5'-UUUGCUUGAAAGAAAAUAC-3' | (SEQ ID NO: 17322) |
| C5-5426 | 19 nt | Target #2: | 5'-CUUUGCUUGAAAGAAAAUA-3' | (SEQ ID NO: 19632) |
| C5-5426 | 19 nt | Target #3: | 5'-CCUUUGCUUGAAAGAAAAU-3' | (SEQ ID NO: 21942) |
| C5-5427 | 19 nt | Target #1: | 5'-UUGCUUGAAAGAAAAUACC-3' | (SEQ ID NO: 17323) |
| C5-5427 | 19 nt | Target #2: | 5'-UUUGCUUGAAAGAAAAUAC-3' | (SEQ ID NO: 19633) |
| C5-5427 | 19 nt | Target #3: | 5'-CUUUGCUUGAAAGAAAAUA-3' | (SEQ ID NO: 21943) |
| C5-5428 | 19 nt | Target #1: | 5'-UGCUUGAAAGAAAAUACCA-3' | (SEQ ID NO: 17324) |
| C5-5428 | 19 nt | Target #2: | 5'-UUGCUUGAAAGAAAAUACC-3' | (SEQ ID NO: 19634) |
| C5-5428 | 19 nt | Target #3: | 5'-UUUGCUUGAAAGAAAAUAC-3' | (SEQ ID NO: 21944) |
| C5-5451 | 19 nt | Target #1: | 5'-ACAGGAAACUGAUCAUUAA-3' | (SEQ ID NO: 17325) |
| C5-5451 | 19 nt | Target #2: | 5'-AACAGGAAACUGAUCAUUA-3' | (SEQ ID NO: 19635) |
| C5-5451 | 19 nt | Target #3: | 5'-GAACAGGAAACUGAUCAUU-3' | (SEQ ID NO: 21945) |
| C5-5452 | 19 nt | Target #1: | 5'-CAGGAAACUGAUCAUUAAA-3' | (SEQ ID NO: 17326) |
| C5-5452 | 19 nt | Target #2: | 5'-ACAGGAAACUGAUCAUUAA-3' | (SEQ ID NO: 19636) |
| C5-5452 | 19 nt | Target #3: | 5'-AACAGGAAACUGAUCAUUA-3' | (SEQ ID NO: 21946) |
| C5-5453 | 19 nt | Target #1: | 5'-AGGAAACUGAUCAUUAAAG-3' | (SEQ ID NO: 17327) |
| C5-5453 | 19 nt | Target #2: | 5'-CAGGAAACUGAUCAUUAAA-3' | (SEQ ID NO: 19637) |
| C5-5453 | 19 nt | Target #3: | 5'-ACAGGAAACUGAUCAUUAA-3' | (SEQ ID NO: 21947) |
| C5-5454 | 19 nt | Target #1: | 5'-GGAAACUGAUCAUUAAAGC-3' | (SEQ ID NO: 17328) |
| C5-5454 | 19 nt | Target #2: | 5'-AGGAAACUGAUCAUUAAAG-3' | (SEQ ID NO: 19638) |
| C5-5454 | 19 nt | Target #3: | 5'-CAGGAAACUGAUCAUUAAA-3' | (SEQ ID NO: 21948) |
| C5-5455 | 19 nt | Target #1: | 5'-GAAACUGAUCAUUAAAGCC-3' | (SEQ ID NO: 17329) |
| C5-5455 | 19 nt | Target #2: | 5'-GGAAACUGAUCAUUAAAGC-3' | (SEQ ID NO: 19639) |
| C5-5455 | 19 nt | Target #3: | 5'-AGGAAACUGAUCAUUAAAG-3' | (SEQ ID NO: 21949) |
| C5-5456 | 19 nt | Target #1: | 5'-AAACUGAUCAUUAAAGCCU-3' | (SEQ ID NO: 17330) |
| C5-5456 | 19 nt | Target #2: | 5'-GAAACUGAUCAUUAAAGCC-3' | (SEQ ID NO: 19640) |
| C5-5456 | 19 nt | Target #3: | 5'-GGAAACUGAUCAUUAAAGC-3' | (SEQ ID NO: 21950) |
| C5-5457 | 19 nt | Target #1: | 5'-AACUGAUCAUUAAAGCCUG-3' | (SEQ ID NO: 17331) |
| C5-5457 | 19 nt | Target #2: | 5'-AAACUGAUCAUUAAAGCCU-3' | (SEQ ID NO: 19641) |
| C5-5457 | 19 nt | Target #3: | 5'-GAAACUGAUCAUUAAAGCC-3' | (SEQ ID NO: 21951) |
| C5-5458 | 19 nt | Target #1: | 5'-ACUGAUCAUUAAAGCCUGA-3' | (SEQ ID NO: 17332) |
| C5-5458 | 19 nt | Target #2: | 5'-AACUGAUCAUUAAAGCCUG-3' | (SEQ ID NO: 19642) |
| C5-5458 | 19 nt | Target #3: | 5'-AAACUGAUCAUUAAAGCCU-3' | (SEQ ID NO: 21952) |
| C5-5459 | 19 nt | Target #1: | 5'-CUGAUCAUUAAAGCCUGAG-3' | (SEQ ID NO: 17333) |
| C5-5459 | 19 nt | Target #2: | 5'-ACUGAUCAUUAAAGCCUGA-3' | (SEQ ID NO: 19643) |
| C5-5459 | 19 nt | Target #3: | 5'-AACUGAUCAUUAAAGCCUG-3' | (SEQ ID NO: 21953) |
| C5-5460 | 19 nt | Target #1: | 5'-UGAUCAUUAAAGCCUGAGU-3' | (SEQ ID NO: 17334) |
| C5-5460 | 19 nt | Target #2: | 5'-CUGAUCAUUAAAGCCUGAG-3' | (SEQ ID NO: 19644) |
| C5-5460 | 19 nt | Target #3: | 5'-ACUGAUCAUUAAAGCCUGA-3' | (SEQ ID NO: 21954) |
| C5-5461 | 19 nt | Target #1: | 5'-GAUCAUUAAAGCCUGAGUU-3' | (SEQ ID NO: 17335) |
| C5-5461 | 19 nt | Target #2: | 5'-UGAUCAUUAAAGCCUGAGU-3' | (SEQ ID NO: 19645) |
| C5-5461 | 19 nt | Target #3: | 5'-CUGAUCAUUAAAGCCUGAG-3' | (SEQ ID NO: 21955) |
| C5-5462 | 19 nt | Target #1: | 5'-AUCAUUAAAGCCUGAGUUU-3' | (SEQ ID NO: 17336) |
| C5-5462 | 19 nt | Target #2: | 5'-GAUCAUUAAAGCCUGAGUU-3' | (SEQ ID NO: 19646) |
| C5-5462 | 19 nt | Target #3: | 5'-UGAUCAUUAAAGCCUGAGU-3' | (SEQ ID NO: 21956) |
| C5-5463 | 19 nt | Target #1: | 5'-UCAUUAAAGCCUGAGUUUG-3' | (SEQ ID NO: 17337) |
| C5-5463 | 19 nt | Target #2: | 5'-AUCAUUAAAGCCUGAGUUU-3' | (SEQ ID NO: 19647) |
| C5-5463 | 19 nt | Target #3: | 5'-GAUCAUUAAAGCCUGAGUU-3' | (SEQ ID NO: 21957) |
| C5-5466 | 19 nt | Target #1: | 5'-UUAAAGCCUGAGUUUGCUU-3' | (SEQ ID NO: 17338) |
| C5-5466 | 19 nt | Target #2: | 5'-AUUAAAGCCUGAGUUUGCU-3' | (SEQ ID NO: 19648) |
| C5-5466 | 19 nt | Target #3: | 5'-AUUAAAGCCUGAGUUUGCU-3' | (SEQ ID NO: 21958) |
| C5-5467 | 19 nt | Target #1: | 5'-UAAAGCCUGAGUUUGCUUU-3' | (SEQ ID NO: 17339) |
| C5-5467 | 19 nt | Target #2: | 5'-UUAAAGCCUGAGUUUGCUU-3' | (SEQ ID NO: 19649) |
| C5-5467 | 19 nt | Target #3: | 5'-AUUAAAGCCUGAGUUUGCU-3' | (SEQ ID NO: 21959) |

Within Tables 2, 3, 5, 7 and 9 above, underlined residues indicate 2'-O-methyl residues, UPPER CASE indicates ribonucleotides, and lower case denotes deoxyribonucleotides. The DsiRNA agents of Tables 2, 3 and 7 above are 25/27mer agents possessing a blunt end. The structures and/or modification patterning of the agents of Tables 2, 3 and 7 above can be readily adapted to the above generic sequence structures, e.g., the 3' overhang of the second strand can be extended or contracted, 2'-O-methylation of the second strand can be expanded towards the 5' end of the second strand, optionally at alternating sites, etc. Such further modifications are optional, as 25/27mer DsiRNAs with such modifications can also be readily designed from the above DsiRNA agents and are also expected to be functional inhibitors of C5 expression. Similarly, the 27mer "blunt/blunt" DsiRNA structures and/or modification patterns of the agents of Tables 5 and 9 above can also be readily adapted to the above generic sequence structures, e.g., for application of modification patterning of the antisense strand to such structures and/or adaptation of such sequences to the above generic structures.

In certain embodiments, 27mer DsiRNAs possessing independent strand lengths each of 27 nucleotides are designed and synthesized for targeting of the same sites within the C5 transcript as the asymmetric "25/27" structures shown in Tables 2, 3 and 7 herein. Exemplary "27/27" DsiRNAs are optionally designed with a "blunt/blunt" structure as shown for the DsiRNAs of Tables 5 and 9 above.

In certain embodiments, the dsRNA agents of the invention require, e.g., at least 15, at least 16, at least 17, at least 18, at least 19, at least 20, at least 21, at least 22, at least 23, at least 24, at least 25 or at least 26 residues of the first strand to be complementary to corresponding residues of the second strand. In certain related embodiments, these first strand residues complementary to corresponding residues of the second strand are optionally consecutive residues.

By definition, "sufficiently complementary" (contrasted with, e.g., "100% complementary") allows for one or more mismatches to exist between a dsRNA of the invention and the target RNA or cDNA sequence (e.g., C5 mRNA), provided that the dsRNA possesses complementarity sufficient to trigger the destruction of the target RNA by the RNAi machinery (e.g., the RISC complex) or process. In certain embodiments, a "sufficiently complementary" dsRNA of the invention can harbor one, two, three or even four or more mismatches between the dsRNA sequence and the target RNA or cDNA sequence (e.g., in certain such embodiments, the antisense strand of the dsRNA harbors one, two, three, four, five or even six or more mismatches when aligned with the target RNA or cDNA sequence). Additional consideration of the preferred location of such mismatches within certain dsRNAs of the instant invention is considered in greater detail below.

As used herein "DsiRNAmm" refers to a DisRNA having a "mismatch tolerant region" containing one, two, three or four mismatched base pairs of the duplex formed by the sense and antisense strands of the DsiRNA, where such mismatches are positioned within the DsiRNA at a location(s) lying between (and thus not including) the two terminal base pairs of either end of the DsiRNA. The mismatched base pairs are located within a "mismatch-tolerant region" which is defined herein with respect to the location of the projected Ago2 cut site of the corresponding target nucleic acid. The mismatch tolerant region is located "upstream of" the projected Ago2 cut site of the target strand. "Upstream" in this context will be understood as the 5'-most portion of the DsiRNAmm duplex, where 5' refers to the orientation of the sense strand of the DsiRNA duplex. Therefore, the mismatch tolerant region is upstream of the base on the sense (passenger) strand that corresponds to the projected Ago2 cut site of the target nucleic acid (see FIG. 1); alternatively, when referring to the antisense (guide) strand of the DsiRNAmm, the mismatch tolerant region can also be described as positioned downstream of the base that is complementary to the projected Ago2 cut site of the target nucleic acid, that is, the 3'-most portion of the antisense strand of the DsiRNAmm (where position 1 of the antisense strand is the 5' terminal nucleotide of the antisense strand, see FIG. 1).

In one embodiment, for example with numbering as depicted in FIG. 1, the mismatch tolerant region is positioned between and including base pairs 3-9 when numbered from the nucleotide starting at the 5' end of the sense strand of the duplex. Therefore, a DsiRNAmm of the invention possesses a single mismatched base pair at any one of positions 3, 4, 5, 6, 7, 8 or 9 of the sense strand of a right-hand extended DsiRNA (where position 1 is the 5' terminal nucleotide of the sense strand and position 9 is the nucleotide residue of the sense strand that is immediately 5' of the projected Ago2 cut site of the target C5 RNA sequence corresponding to the sense strand sequence). In certain embodiments, for a DsiRNAmm that possesses a mismatched base pair nucleotide at any of positions 3, 4, 5, 6, 7, 8 or 9 of the sense strand, the corresponding mismatched base pair nucleotide of the antisense strand not only forms a mismatched base pair with the DsiRNAmm sense strand sequence, but also forms a mismatched base pair with a DsiRNAmm target C5 RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target C5 RNA sequence). In alternative embodiments, the mismatch base pair nucleotide of the antisense strand of a DsiRNAmm only form a mismatched base pair with a corresponding nucleotide of the sense strand sequence of the DsiRNAmm, yet base pairs with its corresponding target C5 RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target C5 RNA sequence).

A DsiRNAmm of the invention that possesses a single mismatched base pair within the mismatch-tolerant region (mismatch region) as described above (e.g., a DsiRNAmm harboring a mismatched nucleotide residue at any one of positions 3, 4, 5, 6, 7, 8 or 9 of the sense strand) can further include one, two or even three additional mismatched base pairs. In preferred embodiments, these one, two or three additional mismatched base pairs of the DsiRNAmm occur at position(s) 3, 4, 5, 6, 7, 8 and/or 9 of the sense strand (and at corresponding residues of the antisense strand). In one embodiment where one additional mismatched base pair is present within a DsiRNAmm, the two mismatched base pairs of the sense strand can occur, e.g., at nucleotides of both position 4 and position 6 of the sense strand (with mismatch also occurring at corresponding nucleotide residues of the antisense strand).

In DsiRNAmm agents possessing two mismatched base pairs, mismatches can occur consecutively (e.g., at consecutive positions along the sense strand nucleotide sequence). Alternatively, nucleotides of the sense strand that form mismatched base pairs with the antisense strand sequence can be interspersed by nucleotides that base pair with the antisense strand sequence (e.g., for a DsiRNAmm possessing mismatched nucleotides at positions 3 and 6, but not at positions 4 and 5, the mismatched residues of sense strand positions 3 and 6 are interspersed by two nucleotides that form matched base pairs with corresponding residues of the antisense strand). For example, two residues of the sense strand (located within the mismatch-tolerant region of the sense strand) that form mismatched base pairs with the corresponding antisense strand sequence can occur with zero, one, two, three, four or five matched base pairs located between these mismatched base pairs.

For certain DsiRNAmm agents possessing three mismatched base pairs, mismatches can occur consecutively (e.g., in a triplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 4 and 8, but not at positions 5, 6 and 7, the mismatched residues of sense strand positions 3 and 4 are adjacent to one another, while the mismatched residues of sense strand positions 4 and 8 are interspersed by three nucleotides that form matched base pairs with corresponding residues of the antisense strand). For example, three residues of the sense strand (located within the mismatch-tolerant region of the sense strand) that form mismatched base pairs with the corresponding antisense strand sequence can occur with zero, one, two, three or four matched base pairs located between any two of these mismatched base pairs.

For certain DsiRNAmm agents possessing four mismatched base pairs, mismatches can occur consecutively (e.g., in a quadruplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 5, 7 and 8, but not at positions 4 and 6, the mismatched residues of sense strand positions 7 and 8 are adjacent to one another, while the mismatched residues of sense strand positions 3 and 5 are interspersed by one nucleotide that forms a matched base pair with the corresponding residue of the antisense strand—similarly, the mismatched residues of sense strand positions 5 and 7 are also interspersed by one nucleotide that forms a matched base pair with the corresponding residue of the antisense strand). For example, four residues of the sense strand (located within the mismatch-tolerant region of the sense strand) that form mismatched base pairs with the corresponding antisense strand sequence can occur with zero, one, two or three matched base pairs located between any two of these mismatched base pairs.

In another embodiment, for example with numbering also as depicted in FIG. 1, a DsiRNAmm of the invention comprises a mismatch tolerant region which possesses a single mismatched base pair nucleotide at any one of positions 17, 18, 19, 20, 21, 22 or 23 of the antisense strand of the DsiRNA (where position 1 is the 5' terminal nucleotide of the antisense strand and position 17 is the nucleotide residue of the antisense strand that is immediately 3' (downstream) in the antisense strand of the projected Ago2 cut site of the target C5 RNA sequence sufficiently complementary to the antisense strand sequence). In certain embodiments, for a DsiRNAmm that possesses a mismatched base pair nucleotide at any of positions 17, 18, 19, 20, 21, 22 or 23 of the antisense strand with respect to the sense strand of the DsiRNAmm, the mismatched base pair nucleotide of the antisense strand not only forms a mismatched base pair with the DsiRNAmm sense strand sequence, but also forms a mismatched base pair with a DsiRNAmm target C5 RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target C5 RNA sequence). In alternative embodiments, the mismatch base pair nucleotide of the antisense strand of a DsiRNAmm only forms a mismatched base pair with a corresponding nucleotide of the sense strand sequence of the DsiRNAmm, yet base pairs with its corresponding target C5 RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target C5 RNA sequence).

A DsiRNAmm of the invention that possesses a single mismatched base pair within the mismatch-tolerant region as described above (e.g., a DsiRNAmm harboring a mismatched nucleotide residue at positions 17, 18, 19, 20, 21, 22 or 23 of the antisense strand) can further include one, two or even three additional mismatched base pairs. In preferred embodiments, these one, two or three additional mismatched base pairs of the DsiRNAmm occur at position(s) 17, 18, 19, 20, 21, 22 and/or 23 of the antisense strand (and at corresponding residues of the sense strand). In one embodiment where one additional mismatched base pair is present within a DsiRNAmm, the two mismatched base pairs of the antisense strand can occur, e.g., at nucleotides of both position 18 and position 20 of the antisense strand (with mismatch also occurring at corresponding nucleotide residues of the sense strand).

In DsiRNAmm agents possessing two mismatched base pairs, mismatches can occur consecutively (e.g., at consecutive positions along the antisense strand nucleotide sequence). Alternatively, nucleotides of the antisense strand that form mismatched base pairs with the sense strand sequence can be interspersed by nucleotides that base pair with the sense strand sequence (e.g., for a DsiRNAmm possessing mismatched nucleotides at positions 17 and 20, but not at positions 18 and 19, the mismatched residues of antisense strand positions 17 and 20 are interspersed by two nucleotides that form matched base pairs with corresponding residues of the sense strand). For example, two residues of the antisense strand (located within the mismatch-tolerant region of the sense strand) that form mismatched base pairs with the corresponding sense strand sequence can occur with zero, one, two, three, four, five, six or seven matched base pairs located between these mismatched base pairs.

For certain DsiRNAmm agents possessing three mismatched base pairs, mismatches can occur consecutively (e.g., in a triplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 17, 18 and 22, but not at positions 19, 20 and 21, the mismatched residues of antisense strand positions 17 and 18 are adjacent to one another, while the mismatched residues of antisense strand positions 18 and 122 are interspersed by three nucleotides that form matched base pairs with corresponding residues of the sense strand). For example, three residues of the antisense strand (located within the mismatch-tolerant region of the antisense strand) that form mismatched base pairs with the corresponding sense strand sequence can occur with zero, one, two, three, four, five or six matched base pairs located between any two of these mismatched base pairs.

For certain DsiRNAmm agents possessing four mismatched base pairs, mismatches can occur consecutively (e.g., in a quadruplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 18, 20, 22 and 23, but not at positions 19 and 21, the mismatched residues of antisense strand positions 22 and 23 are adjacent to one another, while the mismatched residues of antisense strand positions 18 and 20 are interspersed by one nucleotide that forms a matched base pair with the corresponding residue of the sense strand—similarly, the mismatched residues of antisense strand positions 20 and 22 are also interspersed by one nucleotide that forms a matched base pair with the corresponding residue of the sense strand). For example, four residues of the antisense strand (located within the mismatch-tolerant region of the antisense strand) that form mismatched base pairs with the corresponding sense strand sequence can occur with zero, one, two, three, four or five matched base pairs located between any two of these mismatched base pairs.

For reasons of clarity, the location(s) of mismatched nucleotide residues within the above DsiRNAmm agents are numbered in reference to the 5' terminal residue of either sense or antisense strands of the DsiRNAmm. The numbering of positions located within the mismatch-tolerant region (mismatch region) of the antisense strand can shift with variations in the proximity of the 5' terminus of the sense or antisense strand to the projected Ago2 cleavage site. Thus, the location(s) of preferred mismatch sites within either antisense strand or sense strand can also be identified as the permissible proximity of such mismatches to the projected Ago2 cut site. Accordingly, in one preferred embodiment, the position of a mismatch nucleotide of the sense strand of a DsiRNAmm is the nucleotide residue of the sense strand that is located immediately 5' (upstream) of the projected Ago2 cleavage site of the corresponding target C5 RNA sequence. In other preferred embodiments, a mismatch nucleotide of the sense strand of a DsiRNAmm is positioned at the nucleotide residue of the sense strand that is located two nucleotides 5' (upstream) of the projected Ago2 cleavage site, three nucleotides 5' (upstream) of the projected Ago2 cleavage site, four nucleotides 5' (upstream) of the projected Ago2 cleavage site, five nucleotides 5' (upstream) of the projected Ago2 cleavage site, six nucleotides 5' (upstream) of the projected Ago2 cleavage site, seven nucleotides 5' (upstream) of the projected Ago2 cleavage site, eight nucleotides 5' (upstream) of the projected Ago2 cleavage site, or nine nucleotides 5' (upstream) of the projected Ago2 cleavage site.

Exemplary single mismatch-containing 25/27mer DsiRNAs (DsiRNAmm) include the following structures (such mismatch-containing structures may also be incorporated into other exemplary DsiRNA structures shown herein).

```
5'-XX^M XXXXXXXXXXXXXXXXXXXXXDD-3'
3'-XXXX_M XXXXXXXXXXXXXXXXXXXXXXX-5'
5'-XXX^M XXXXXXXXXXXXXXXXXXXXDD-3'
3'-XXXXX_M XXXXXXXXXXXXXXXXXXXXXX-5'
5'-XXXX^M XXXXXXXXXXXXXXXXXXXDD-3'
3'-XXXXXX_M XXXXXXXXXXXXXXXXXXXXX-5'
5'-XXXXX^M XXXXXXXXXXXXXXXXXXDD-3'
3'-XXXXXXX_M XXXXXXXXXXXXXXXXXXXX-5'
5'-XXXXXX^M XXXXXXXXXXXXXXXXXDD-3'
3'-XXXXXXXX_M XXXXXXXXXXXXXXXXXXX-5'
5'-XXXXXXX^M XXXXXXXXXXXXXXXXDD-3'
3'-XXXXXXXXX_M XXXXXXXXXXXXXXXXXX-5'
5'-XXXXXXXX^M XXXXXXXXXXXXXXXDD-3'
3'-XXXXXXXXXX_M XXXXXXXXXXXXXXXXX-5'
``` wherein "X"=RNA, "D"=DNA and "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown above, can also be used in the above DsiRNAmm agents. For the above mismatch structures, the top strand is the sense strand, and the bottom strand is the antisense strand.

In certain embodiments, a DsiRNA of the invention can contain mismatches that exist in reference to the target C5 RNA sequence yet do not necessarily exist as mismatched base pairs within the two strands of the DsiRNA—thus, a DsiRNA can possess perfect complementarity between first and second strands of a DsiRNA, yet still possess mismatched residues in reference to a target C5 RNA (which, in certain embodiments, may be advantageous in promoting efficacy and/or potency and/or duration of effect). In certain embodiments, where mismatches occur between antisense strand and target C5 RNA sequence, the position of a mismatch is located within the antisense strand at a position(s) that corresponds to a sequence of the sense strand located 5' of the projected Ago2 cut site of the target region—e.g., antisense strand residue(s) positioned within the antisense strand to the 3' of the antisense residue which is complementary to the projected Ago2 cut site of the target sequence.

Exemplary 25/27mer DsiRNAs that harbor a single mismatched residue in reference to target sequences include the following structures.

```
Target RNA Sequence:
5'- . . . AXXXXXXXXXXXXXXXXXXX . . . -3'

DsiRNAmm Sense Strand:
5'-XXXXXXXXXXXXXXXXXXXXXXXDD-3'

DsiRNAmm Antisense Strand:
3'-EXXXXXXXXXXXXXXXXXXXXXXXXX-5'

Target RNA Sequence:
5'- . . . XAXXXXXXXXXXXXXXXXXX . . . -3'

DsiRNAmm Sense Strand:
5'-XXXXXXXXXXXXXXXXXXXXXXXDD-3'
```

```
-continued
DsiRNAmm Antisense Strand:
3'-XEXXXXXXXXXXXXXXXXXXXXXXXX-5'

Target RNA Sequence:
5'- . . . AXXXXXXXXXXXXXXXXX . . . -3'

DsiRNAmm Sense Strand:
5'-BXXXXXXXXXXXXXXXXXXXXXXDD-3'

DsiRNAmm Antisense Strand:
3'-XXEXXXXXXXXXXXXXXXXXXXXXXX-5'

Target RNA Sequence:
5'- . . . XAXXXXXXXXXXXXXXXX . . . -3'

DsiRNAmm Sense Strand:
5'-XBXXXXXXXXXXXXXXXXXXXXXDD-3'

DsiRNAmm Antisense Strand:
3'-XXXEXXXXXXXXXXXXXXXXXXXXXX-5'

Target RNA Sequence:
5'- . . . XXAXXXXXXXXXXXXXXX . . . -3'

DsiRNAmm Sense Strand:
5'-XXBXXXXXXXXXXXXXXXXXXXXDD-3'

DsiRNAmm Antisense Strand:
3'-XXXXEXXXXXXXXXXXXXXXXXXXXX-5'

Target RNA Sequence:
5'- . . . XXXAXXXXXXXXXXXXXX . . . -3'

DsiRNAmm Sense Strand:
5'-XXXBXXXXXXXXXXXXXXXXXXXDD-3'

DsiRNAmm Antisense Strand:
3'-XXXXXEXXXXXXXXXXXXXXXXXXXX-5'

Target RNA Sequence:
5'- . . . XXXXAXXXXXXXXXXXXX . . . -3'

DsiRNAmm Sense Strand:
5'-XXXXBXXXXXXXXXXXXXXXXXXDD-3'

DsiRNAmm Antisense Strand:
3'-XXXXXXEXXXXXXXXXXXXXXXXXXX-5'

Target RNA Sequence:
5'- . . . XXXXXAXXXXXXXXXXXX . . . -3'

DsiRNAmm Sense Strand:
5'-XXXXXBXXXXXXXXXXXXXXXXXDD-3'

DsiRNAmm Antisense Strand:
3'-XXXXXXXEXXXXXXXXXXXXXXXXXX-5'

Target RNA Sequence:
5'- . . . XXXXXXAXXXXXXXXXXX . . . -3'

DsiRNAmm Sense Strand:
5'-XXXXXXBXXXXXXXXXXXXXXXXDD-3'

DsiRNAmm Antisense Strand:
3'-XXXXXXXXEXXXXXXXXXXXXXXXXX-5'

Target RNA Sequence:
5'- . . . XXXXXXXAXXXXXXXXXX . . . -3'

DsiRNAmm Sense Strand:
5'-XXXXXXXBXXXXXXXXXXXXXXXDD-3'

DsiRNAmm Antisense Strand:
3'-XXXXXXXXXEXXXXXXXXXXXXXXXX-5'
```

```
-continued
DsiRNAmm Antisense Strand:
3'-XXXXXXXXXEXXXXXXXXXXXXXXXX-5'
``` wherein "X"=RNA, "D"=DNA and "E"=Nucleic acid residues (RNA, DNA or non-natural or modified nucleic acids) that do not base pair (hydrogen bond) with corresponding "A" RNA residues of otherwise complementary (target) strand when strands are annealed, yet optionally do base pair with corresponding "B" residues ("B" residues are also RNA, DNA or non-natural or modified nucleic acids). Any of the residues of such agents can optionally be 2'-O-methyl RNA monomers—alternating positioning of 2'-O-methyl RNA monomers that commences from the 3'-terminal residue of the bottom (second) strand, as shown above, can also be used in the above DsiRNA agents.

In certain embodiments, the guide strand of a dsRNA of the invention that is sufficiently complementary to a target RNA (e.g., mRNA) along at least 19 nucleotides of the target gene sequence to reduce target gene expression is not perfectly complementary to the at least 19 nucleotide long target gene sequence. Rather, it is appreciated that the guide strand of a dsRNA of the invention that is sufficiently complementary to a target mRNA along at least 19 nucleotides of a target RNA sequence to reduce target gene expression can have one, two, three, or even four or more nucleotides that are mismatched with the 19 nucleotide or longer target strand sequence. Thus, for a 19 nucleotide target RNA sequence, the guide strand of a dsRNA of the invention can be sufficiently complementary to the target RNA sequence to reduce target gene levels while possessing, e.g., only 15/19, 16/19, 17/19 or 18/19 matched nucleotide residues between guide strand and target RNA sequence.

In addition to the above-exemplified structures, dsRNAs of the invention can also possess one, two or three additional residues that form further mismatches with the target C5 RNA sequence. Such mismatches can be consecutive, or can be interspersed by nucleotides that form matched base pairs with the target C5 RNA sequence. Where interspersed by nucleotides that form matched base pairs, mismatched residues can be spaced apart from each other within a single strand at an interval of one, two, three, four, five, six, seven or even eight base paired nucleotides between such mismatch-forming residues.

As for the above-described DsiRNAmm agents, a preferred location within dsRNAs (e.g., DsiRNAs) for antisense strand nucleotides that form mismatched base pairs with target C5 RNA sequence (yet may or may not form mismatches with corresponding sense strand nucleotides) is within the antisense strand region that is located 3' (downstream) of the antisense strand sequence which is complementary to the projected Ago2 cut site of the DsiRNA (e.g., in FIG. 1, the region of the antisense strand which is 3' of the projected Ago2 cut site is preferred for mismatch-forming residues and happens to be located at positions 17-23 of the antisense strand for the 25/27mer agent shown in FIG. 1). Thus, in one embodiment, the position of a mismatch nucleotide (in relation to the target C5 RNA sequence) of the antisense strand of a DsiRNAmm is the nucleotide residue of the antisense strand that is located immediately 3' (downstream) within the antisense strand sequence of the projected Ago2 cleavage site of the corresponding target C5 RNA sequence. In other preferred embodiments, a mismatch nucleotide of the antisense strand of a DsiRNAmm (in relation to the target C5 RNA sequence) is positioned at the nucleotide residue of the antisense strand that is located two nucleotides 3' (downstream) of the corresponding projected Ago2 cleavage site, three nucleotides 3' (downstream) of the corresponding projected Ago2 cleavage site, four nucleotides 3' (downstream) of the corresponding projected Ago2 cleavage site, five nucleotides 3' (downstream) of the corresponding projected Ago2 cleavage site, six nucleotides 3' (downstream) of the projected Ago2 cleavage site, seven nucleotides 3' (downstream) of the projected Ago2 cleavage site, eight nucleotides 3' (downstream) of the projected Ago2 cleavage site, or nine nucleotides 3' (downstream) of the projected Ago2 cleavage site.

In dsRNA agents possessing two mismatch-forming nucleotides of the antisense strand (where mismatch-forming nucleotides are mismatch forming in relation to target C5 RNA sequence), mismatches can occur consecutively (e.g., at consecutive positions along the antisense strand nucleotide sequence). Alternatively, nucleotides of the antisense strand that form mismatched base pairs with the target C5 RNA sequence can be interspersed by nucleotides that base pair with the target C5 RNA sequence (e.g., for a DsiRNA possessing mismatch-forming nucleotides at positions 17 and 20 (starting from the 5' terminus (position 1) of the antisense strand of the 25/27mer agent shown in FIG. 1), but not at positions 18 and 19, the mismatched residues of sense strand positions 17 and 20 are interspersed by two nucleotides that form matched base pairs with corresponding residues of the target C5 RNA sequence). For example, two residues of the antisense strand (located within the mismatch-tolerant region of the antisense strand) that form mismatched base pairs with the corresponding target C5 RNA sequence can occur with zero, one, two, three, four or five matched base pairs (with respect to target C5 RNA sequence) located between these mismatch-forming base pairs.

For certain dsRNAs possessing three mismatch-forming base pairs (mismatch-forming with respect to target C5 RNA sequence), mismatch-forming nucleotides can occur consecutively (e.g., in a triplet along the antisense strand nucleotide sequence). Alternatively, nucleotides of the antisense strand that form mismatched base pairs with the target C5 RNA sequence can be interspersed by nucleotides that form matched base pairs with the target C5 RNA sequence (e.g., for a DsiRNA possessing mismatched nucleotides at positions 17, 18 and 22, but not at positions 19, 20 and 21, the mismatch-forming residues of antisense strand positions 17 and 18 are adjacent to one another, while the mismatch-forming residues of antisense strand positions 18 and 22 are interspersed by three nucleotides that form matched base pairs with corresponding residues of the target C5 RNA). For example, three residues of the antisense strand (located within the mismatch-tolerant region of the antisense strand) that form mismatched base pairs with the corresponding target C5 RNA sequence can occur with zero, one, two, three or four matched base pairs located between any two of these mismatch-forming base pairs.

For certain dsRNAs possessing four mismatch-forming base pairs (mismatch-forming with respect to target C5 RNA sequence), mismatch-forming nucleotides can occur consecutively (e.g., in a quadruplet along the sense strand nucleotide sequence). Alternatively, nucleotides of the antisense strand that form mismatched base pairs with the target C5 RNA sequence can be interspersed by nucleotides that form matched base pairs with the target C5 RNA sequence (e.g., for a DsiRNA possessing mismatch-forming nucleotides at positions 17, 19, 21 and 22, but not at positions 18 and 20, the mismatch-forming residues of antisense strand positions 21 and 22 are adjacent to one another, while the mismatch-forming residues of antisense strand positions 17 and 19 are interspersed by one nucleotide that forms a matched base pair with the corresponding residue of the target C5 RNA sequence—similarly, the mismatch-forming residues of antisense strand positions 19 and 21 are also interspersed by one nucleotide that forms a matched base pair with the corresponding residue of the target C5 RNA sequence). For example, four residues of the antisense strand (located within the mismatch-tolerant region of the antisense strand) that form mismatched base pairs with the corresponding target C5 RNA sequence can occur with zero, one, two or three matched base pairs located between any two of these mismatch-forming base pairs.

The above DsiRNAmm and other dsRNA structures are described in order to exemplify certain structures of DsiRNAmm and dsRNA agents. Design of the above DsiRNAmm and dsRNA structures can be adapted to generate, e.g., DsiRNAmm forms of other DsiRNA structures shown infra. As exemplified above, dsRNAs can also be designed that possess single mismatches (or two, three or four mismatches) between the antisense strand of the dsRNA and a target sequence, yet optionally can retain perfect complementarity between sense and antisense strand sequences of a dsRNA.

It is further noted that the dsRNA agents exemplified infra can also possess insertion/deletion (in/del) structures within their double-stranded and/or target C5 RNA-aligned structures. Accordingly, the dsRNAs of the invention can be designed to possess in/del variations in, e.g., antisense strand sequence as compared to target C5 RNA sequence and/or antisense strand sequence as compared to sense strand sequence, with preferred location(s) for placement of such in/del nucleotides corresponding to those locations described above for positioning of mismatched and/or mismatch-forming base pairs.

It is also noted that the DsiRNAs of the instant invention can tolerate mismatches within the 3'-terminal region of the sense strand/5'-terminal region of the antisense strand, as this region is modeled to be processed by Dicer and liberated from the guide strand sequence that loads into RISC. Exemplary DsiRNA structures of the invention that harbor such mismatches include the following:

```
Target RNA Sequence:
5'- . . . XXXXXXXXXXXXXXXXXXXXHXXX . . . . -3'

DsiRNA Sense Strand:
5'-XXXXXXXXXXXXXXXXXXXXXIXDD-3'

DsiRNA Antisense Strand:
3'-XXXXXXXXXXXXXXXXXXXXXXXJXXX-5'

Target RNA Sequence:
5'- . . . XXXXXXXXXXXXXXXXXXXXHXX . . . . -3'

DsiRNA Sense Strand:
5'-XXXXXXXXXXXXXXXXXXXXXIDD-3'

DsiRNA Antisense Strand:
3'-XXXXXXXXXXXXXXXXXXXXXXXJXX-5'

Target RNA Sequence:
5'- . . . XXXXXXXXXXXXXXXXXXXXHX . . . . -3'

DsiRNA Sense Strand:
5'-XXXXXXXXXXXXXXXXXXXXXID-3'

DsiRNA Antisense Strand:
3'-XXXXXXXXXXXXXXXXXXXXXXXJX-5'
```

```
Target RNA Sequence:
5'- . . . XXXXXXXXXXXXXXXXXXXXXXXXXH . . . -3'

DsiRNA Sense Strand:
5'-XXXXXXXXXXXXXXXXXXXXXXXXXDI-3'

DsiRNA Antisense Strand:
3'-XXXXXXXXXXXXXXXXXXXXXXXXXXXJ-5'
``` wherein "X"=RNA, "D"=DNA and "I" and "J"=Nucleic acid residues (RNA, DNA or non-natural or modified nucleic acids) that do not base pair (hydrogen bond) with one another, yet optionally "J" is complementary to target RNA sequence nucleotide "H". Any of the residues of such agents can optionally be 2'-O-methyl RNA monomers—alternating positioning of 2'-O-methyl RNA monomers that commences from the 3'-terminal residue of the bottom (second) strand, as shown above—or any of the above-described methylation patterns—can also be used in the above DsiRNA agents. The above mismatches can also be combined within the DsiRNAs of the instant invention.

In the below structures, such mismatches are introduced within the asymmetric C5-1250 DsiRNA (newly-introduced mismatch residues are italicized): C5-1250 25/27mer DsiRNA, mismatch position=19 of sense strand (from 5'-terminus)

```
                              (SEQ ID NO: 3461)
5'-AAGAGACAUCUGACUUGG"UCCAag-3'
                              (SEQ ID NO: 540)
3'-GGUUCUCUGUAGACUGAACCUAGGUUC-5'
```

Optionally, the mismatched 'U' residue of position 19 of the sense strand is alternatively 'C' or 'G'.
C5-1250 25/27mer DsiRNA, mismatch position=20 of sense strand (from 5'-terminus)

```
                              (SEQ ID NO: 3462)
5'-AAGAGACAUCUGACUUGA^ACCAag-3'
                              (SEQ ID NO: 540)
3'-GGUUCUCUGUAGACUGAACCU_AGGUUC-5'
```

Optionally, the mismatched 'A' residue of position 20 of the sense strand is alternatively 'C' or 'G'.
C5-1250 25/27mer DsiRNA, mismatch position=21 of sense strand (from 5'-terminus)

```
                              (SEQ ID NO: 3463)
5'-AAGAGACAUCUGACUUGAU^ACAag-3'
                              (SEQ ID NO: 540)
3'-GGUUCUCUGUAGACUGAACCUA_GGUUC-5'
```

Optionally, the mismatched 'A' residue of position 21 of the sense strand is alternatively 'U' or 'G'.
C5-1250 25/27mer DsiRNA, mismatch position=22 of sense strand (from 5'-terminus)

```
                              (SEQ ID NO: 3464)
5'-AAGAGACAUCUGACUUGGAUC^CAag-3'
                              (SEQ ID NO: 540)
3'-GGUUCUCUGUAGACUGAACCUAG_GUUC-5'
```

Optionally, the mismatched 'U' residue of position 22 of the sense strand is alternatively 'A' or 'G'.
C5-1250 25/27mer DsiRNA, mismatch position=23 of sense strand (from 5'-terminus)

```
                              (SEQ ID NO: 3465)
5'-AAGAGACAUCUGACUUGGAUCC"ag-3'
                              (SEQ ID NO: 540)
3'-GGUUCUCUGUAGACUGAACCUAGG_UUC-5'
```

Optionally, the mismatched 'U' residue of position 23 of the sense strand is alternatively 'C' or 'G'.
C5-1250 25/27mer DsiRNA, mismatch position=24 of sense strand (from 5'-terminus)

```
                              (SEQ ID NO: 3466)
5'-AAGAGACAUCUGACUUGGAUCCA^gg-3'
                              (SEQ ID NO: 540)
3'-GGUUCUCUGUAGACUGAACCUAGGU_UC-5'
```

Optionally, the mismatched 'g' residue of position 24 of the sense strand is alternatively 't' or 'c'.
C5-1250 25/27mer DsiRNA, mismatch position=25 of sense strand (from 5'-terminus)

```
                              (SEQ ID NO: 3467)
5'-AAGAGACAUCUGACUUGGAUCCAa^a-3'
                              (SEQ ID NO: 540)
3'-GGUUCUCUGUAGACUGAACCUAGGUU_C-5'
```

Optionally, the mismatched 'a' residue of position 25 of the sense strand is alternatively 't' or 'c'.
C5-1250 25/27mer DsiRNA, mismatch position=1 of antisense strand (from 5'-terminus)

```
                              (SEQ ID NO: 156)
5'-AAGAGACAUCUGACUUGGAUCCAa^g-3'
                              (SEQ ID NO: 3468)
3'-GGUUCUCUGUAGACUGAACCUAGGUU_U-5'
```

Optionally, the mismatched 'U' residue of position 1 of the antisense strand is alternatively 'A' or 'G'.
C5-1250 25/27mer DsiRNA, mismatch position=2 of antisense strand (from 5'-terminus)

```
                              (SEQ ID NO: 156)
5'-AAGAGACAUCUGACUUGGAUCCA^gg-3'
                              (SEQ ID NO: 3469)
3'-GGUUCUCUGUAGACUGAACCUAGGU_C-5'
```

Optionally, the mismatched 'C' residue of position 2 of the antisense strand is alternatively 'A' or 'G'.
C5-1250 25/27mer DsiRNA, mismatch position=3 of antisense strand (from 5'-terminus)

```
                              (SEQ ID NO: 156)
5'-AAGAGACAUCUGACUUGGAUCC^ag-3'
                              (SEQ ID NO: 3470)
3'-GGUUCUCUGUAGACUGAACCUAG_UC-5'
```

Optionally, the mismatched 'A' residue of position 3 of the antisense strand is alternatively 'C' or 'G'.
C5-1250 25/27mer DsiRNA, mismatch position=4 of antisense strand (from 5'-terminus)

```
                                          (SEQ ID NO: 156)
      5'-AAGAGACAUCUGACUUGGAUC^CAag-3'

(SEQ ID NO: 3471)
      3'-GGUUCUCUGUAGACUGAACCUAG_sUUC-5'
```

Optionally, the mismatched 'A' residue of position 4 of the antisense strand is alternatively 'U' or 'C'.

C5-1250 25/27mer DsiRNA, mismatch position=5 of antisense strand (from 5'-terminus)

```
                                          (SEQ ID NO: 156)
      5'-AAGAGACAUCUGACUUGGAU^CCAag-3'

(SEQ ID NO: 3472)
      3'-GGUUCUCUGUAGACUGAACCU^A_sGUUC-5'
```

Optionally, the mismatched 'U' residue of position 5 of the antisense strand is alternatively 'A' or 'C'.

C5-1250 25/27mer DsiRNA, mismatch position=6 of antisense strand (from 5'-terminus)

```
                                          (SEQ ID NO: 156)
      5'-AAGAGACAUCUGACUUGGA^UCCAag-3'

(SEQ ID NO: 3473)
      3'-GGUUCUCUGUAGACUGAACCU_sGGUUC-5'
```

Optionally, the mismatched 'U' residue of position 6 of the antisense strand is alternatively 'C' or 'G'.

C5-1250 25/27mer DsiRNA, mismatch position=7 of antisense strand (from 5'-terminus)

```
                                          (SEQ ID NO: 156)
      5'-AAGAGACAUCUGACUUGG^AUCCAag-3'

(SEQ ID NO: 3474)
      3'-GGUUCUCUGUAGACUGAACC_sAGGUUC-5'
```

Optionally, the mismatched 'A' residue of position 7 of the antisense strand is alternatively 'C' or 'G'.

For the above oligonucleotide strand sequences, it is contemplated that the sense strand sequence of one depicted duplex can be combined with an antisense strand of another depicted duplex, thereby forming a distinct duplex—in certain instances, such duplexes contain a mismatched residue with respect to the C5 target transcript sequence, while such sense and antisense strand sequences do not present a mismatch at this residue with respect to one another (e.g., duplexes comprising SEQ ID NOs: 3467 and 3468; SEQ ID NOs: 3466 and 3469; SEQ ID NOs: 3465 and 3470, etc., are contemplated as exemplary of such duplexes).

As noted above, introduction of mismatches can be performed upon any of the DsiRNAs described herein.

The mismatches of such DsiRNA structures can be combined to produce a DsiRNA possessing, e.g., two, three or even four mismatches within the 3'-terminal four to seven nucleotides of the sense strand/5'-terminal four to seven nucleotides of the antisense strand.

Indeed, in view of the flexibility of sequences which can be incorporated into DsiRNAs at the 3'-terminal residues of the sense strand/5'-terminal residues of the antisense strand, in certain embodiments, the sequence requirements of an asymmetric DsiRNA of the instant invention can be represented as the following (minimalist) structure (shown for an exemplary C5-1250 DsiRNA sequence):

```
                                          (SEQ ID NO: 3475)
      5'-AAGAGACAUCUGACUUGGXXXXXX[X]_n-3'

(SEQ ID NO: 3476)
      3'-GGUUCUCUGUAGACUGAACCXXXXXX[X]_n-5'
``` where n=1 to 5, 1 to 10, 1 to 20, 1 to 30, 1 to 50, or 1 to 80 or more.

C5-1250 mRNA Target:
```
                                          (SEQ ID NO: 3477)
      5'-CCAAGAGACATCTGACTTGGXXXXXXX-3'.
```

The C5 target site may also be a site which is targeted by one or more of several oligonucleotides whose complementary target sites overlap with a stated target site. For example, for an exemplary C5-420 DsiRNA, it is noted that certain DsiRNAs targeting overlapping and only slightly offset C5 sequences could exhibit activity levels similar to that of C5-420 (e.g., C5-418, 419, 420, 422 and 423 of Table 2 above). Thus, in certain embodiments, a designated target sequence region might be effectively targeted by a series of DsiRNAs possessing largely overlapping sequences. (E.g., if considering DsiRNAs of the C5-418 to C5-423 target site(s), a more encompassing C5 transcript target sequence might be recited as, e.g., 5'-ATGACAATGGATTTCTCT-TCATTCATACAGAC-3' (SEQ ID NO: 3478), wherein any given DsiRNA (e.g., a DsiRNA selected from C5-418 to C5-423) only targets a sub-sequence within such a sequence region, yet the entire sequence can be considered a viable target for such a series of DsiRNAs).

Additionally and/or alternatively, mismatches within the 3'-terminal seven nucleotides of the sense strand/5'-terminal seven nucleotides of the antisense strand can be combined with mismatches positioned at other mismatch-tolerant positions, as described above.

In view of the present identification of the above-described Dicer substrate agents (DsiRNAs) as inhibitors of C5 levels via targeting of specific C5 sequences, it is also recognized that dsRNAs having structures similar to those described herein can also be synthesized which target other sequences within the C5 sequence of GenBank Accession No. NM_001735.2 (human C5), or within variants thereof (e.g., target sequences possessing 80% identity, 90% identity, 95% identity, 96% identity, 97% identity, 98% identity, 99% or more identity to a sequence of NM_001735.2).

Anti-C5 DsiRNA Design/Synthesis

It has been found empirically that longer dsRNA species of from 25 to 35 nucleotides (DsiRNAs) and especially from 25 to 30 nucleotides give unexpectedly effective results in terms of potency and duration of action, as compared to 19-23mer siRNA agents. Without wishing to be bound by the underlying theory of the dsRNA processing mechanism, it is thought that the longer dsRNA species serve as a substrate for the Dicer enzyme in the cytoplasm of a cell. In addition to cleaving the dsRNA of the invention into shorter segments, Dicer is thought to facilitate the incorporation of a single-stranded cleavage product derived from the cleaved dsRNA into the RISC complex that is responsible for the destruction of the cytoplasmic RNA (e.g., C5 RNA) of or derived from the target gene, C5 (or other gene associated with a C5-associated disease or disorder). Prior studies (Rossi et al., U.S. Patent Application No. 2007/0265220) have shown that the cleavability of a dsRNA species (specifically, a DsiRNA agent) by Dicer corresponds with increased potency and duration of action of the dsRNA species.

Certain anti-C5 DsiRNA agents were selected from a pre-screened population. Design of DsiRNAs can optionally involve use of predictive scoring algorithms that perform in silico assessments of the projected activity/efficacy of a number of possible DsiRNA agents spanning a region of sequence. Information regarding the design of such scoring algorithms can be found, e.g., in Gong et al. (*BMC Bioinformatics* 2006, 7:516), though a more recent "v4.3" algorithm represents a theoretically improved algorithm relative to siRNA scoring algorithms previously available in the art. (E.g., "v3" and "v4" scoring algorithms are machine learning algorithms that are not reliant upon any biases in human sequence. In addition, the "v3" and "v4" algorithms derive from data sets that are many-fold larger than that from which an older "v2" algorithm such as that described in Gong et al. derives.)

The first and second oligonucleotides of the DsiRNA agents of the instant invention are not required to be completely complementary. In fact, in one embodiment, the 3'-terminus of the sense strand contains one or more mismatches. In one aspect, two mismatches are incorporated at the 3' terminus of the sense strand. In another embodiment, the DsiRNA of the invention is a double stranded RNA molecule containing two RNA oligonucleotides each of which is 27 nucleotides in length and, when annealed to each other, have blunt ends and a two nucleotide mismatch on the 3'-terminus of the sense strand (the 5'-terminus of the antisense strand). The use of mismatches or decreased thermodynamic stability (specifically at the 3'-sense/5'-antisense position) has been proposed to facilitate or favor entry of the antisense strand into RISC (Schwarz et al., 2003, *Cell* 115: 199-208; Khvorova et al., 2003, *Cell* 115: 209-216), presumably by affecting some rate-limiting unwinding steps that occur with entry of the siRNA into RISC. Thus, terminal base composition has been included in design algorithms for selecting active 21mer siRNA duplexes (Ui-Tei et al., 2004, *Nucleic Acids Res* 32: 936-948; Reynolds et al., 2004, *Nat Biotechnol* 22: 326-330). With Dicer cleavage of the dsRNA of this embodiment, the small end-terminal sequence which contains the mismatches will either be left unpaired with the antisense strand (become part of a 3'-overhang) or be cleaved entirely off the final 21-mer siRNA. These "mismatches", therefore, do not persist as mismatches in the final RNA component of RISC. The finding that base mismatches or destabilization of segments at the 3'-end of the sense strand of Dicer substrate improved the potency of synthetic duplexes in RNAi, presumably by facilitating processing by Dicer, was a surprising finding of past works describing the design and use of 25-30mer dsRNAs (also termed "DsiRNAs" herein; Rossi et al., U.S. Patent Application Nos. 2005/0277610, 2005/0244858 and 2007/0265220).

Modification of Anti-C5 dsRNAs

One major factor that inhibits the effect of double stranded RNAs ("dsRNAs") is the degradation of dsRNAs (e.g., siRNAs and DsiRNAs) by nucleases. A 3'-exonuclease is the primary nuclease activity present in serum and modification of the 3'-ends of antisense DNA oligonucleotides is crucial to prevent degradation (Eder et al., 1991, *Antisense Res Dev,* 1: 141-151). An RNase-T family nuclease has been identified called ERI-1 which has 3' to 5' exonuclease activity that is involved in regulation and degradation of siRNAs (Kennedy et al., 2004, *Nature* 427: 645-649; Hong et al., 2005, *Biochem J*, 390: 675-679). This gene is also known as Thex1 (NM_026067) in mice or THEX1 (NM_153332) in humans and is involved in degradation of histone mRNA; it also mediates degradation of 3'-overhangs in siRNAs, but does not degrade duplex RNA (Yang et al., 2006, *J Biol Chem,* 281: 30447-30454). It is therefore reasonable to expect that 3'-end-stabilization of dsRNAs, including the DsiRNAs of the instant invention, will improve stability.

XRN1 (NM_019001) is a 5' to 3' exonuclease that resides in P-bodies and has been implicated in degradation of mRNA targeted by miRNA (Rehwinkel et al., 2005, *RNA* 11: 1640-1647) and may also be responsible for completing degradation initiated by internal cleavage as directed by a siRNA. XRN2 (NM_012255) is a distinct 5' to 3' exonuclease that is involved in nuclear RNA processing.

RNase A is a major endonuclease activity in mammals that degrades RNAs. It is specific for ssRNA and cleaves at the 3'-end of pyrimidine bases. SiRNA degradation products consistent with RNase A cleavage can be detected by mass spectrometry after incubation in serum (Turner et al., 2007, *Mol Biosyst* 3: 43-50). The 3'-overhangs enhance the susceptibility of siRNAs to RNase degradation. Depletion of RNase A from serum reduces degradation of siRNAs; this degradation does show some sequence preference and is worse for sequences having poly A/U sequence on the ends (Haupenthal et al., 2006 *Biochem Pharmacol* 71: 702-710). This suggests the possibility that lower stability regions of the duplex may "breathe" and offer transient single-stranded species available for degradation by RNase A. RNase A inhibitors can be added to serum and improve siRNA longevity and potency (Haupenthal et al., 2007, *Int J. Cancer* 121: 206-210).

In 21mers, phosphorothioate or boranophosphate modifications directly stabilize the internucleoside phosphate linkage. Boranophosphate modified RNAs are highly nuclease resistant, potent as silencing agents, and are relatively non-toxic. Boranophosphate modified RNAs cannot be manufactured using standard chemical synthesis methods and instead are made by in vitro transcription (IVT) (Hall et al., 2004, *Nucleic Acids Res* 32: 5991-6000; Hall et al., 2006, *Nucleic Acids Res* 34: 2773-2781). Phosphorothioate (PS) modifications can be easily placed in the RNA duplex at any desired position and can be made using standard chemical synthesis methods. The PS modification shows dose-dependent toxicity, so most investigators have recommended limited incorporation in siRNAs, favoring the 3'-ends where protection from nucleases is most important (Harborth et al., 2003, *Antisense Nucleic Acid Drug Dev* 13: 83-105; Chiu and Rana, 2003, *Mol Cell* 10: 549-561; Braasch et al., 2003, *Biochemistry* 42: 7967-7975; Amarzguioui et al., 2003, *Nucleic Acids Research* 31: 589-595). More extensive PS modification can be compatible with potent RNAi activity; however, use of sugar modifications (such as 2'-O-methyl RNA) may be superior (Choung et al., 2006, *Biochem Biophys Res Commun* 342: 919-927).

A variety of substitutions can be placed at the 2'-position of the ribose which generally increases duplex stability ($T_m$) and can greatly improve nuclease resistance. 2'-O-methyl RNA is a naturally occurring modification found in mammalian ribosomal RNAs and transfer RNAs. 2'-O-methyl modification in siRNAs is known, but the precise position of modified bases within the duplex is important to retain potency and complete substitution of 2'-O-methyl RNA for RNA will inactivate the siRNA. For example, a pattern that employs alternating 2'-O-methyl bases can have potency equivalent to unmodified RNA and is quite stable in serum (Choung et al., 2006, *Biochem Biophys Res Commun* 342: 919-927; Czauderna et al., 2003, *Nucleic Acids Research* 31: 2705-2716).

The 2'-fluoro (2'-F) modification is also compatible with dsRNA (e.g., siRNA and DsiRNA) function; it is most commonly placed at pyrimidine sites (due to reagent cost and availability) and can be combined with 2'-O-methyl modification at purine positions; 2'-F purines are available and can also be used. Heavily modified duplexes of this kind can be potent triggers of RNAi in vitro (Allerson et al., 2005, *J Med Chem* 48: 901-904; Prakash et al., 2005, *J Med Chem* 48: 4247-4253; Kraynack and Baker, 2006, *RNA* 12: 163-176) and can improve performance and extend duration of action when used in vivo (Morrissey et al., 2005, *Hepatology* 41: 1349-1356; Morrissey et al., 2005, *Nat Biotechnol* 23: 1002-1007). A highly potent, nuclease stable, blunt 19mer duplex containing alternative 2'-F and 2'-O-Me bases is taught by Allerson. In this design, alternating 2'-O-Me residues are positioned in an identical pattern to that employed by Czauderna, however the remaining RNA residues are converted to 2'-F modified bases. A highly potent, nuclease resistant siRNA employed by Morrissey employed a highly potent, nuclease resistant siRNA in vivo. In addition to 2'-O-Me RNA and 2'-F RNA, this duplex includes DNA, RNA, inverted abasic residues, and a 3'-terminal PS internucleoside linkage. While extensive modification has certain benefits, more limited modification of the duplex can also improve in vivo performance and is both simpler and less costly to manufacture. Soutschek et al. (2004, *Nature* 432: 173-178) employed a duplex in vivo and was mostly RNA with two 2'-O-Me RNA bases and limited 3'-terminal PS internucleoside linkages.

Locked nucleic acids (LNAs) are a different class of 2'-modification that can be used to stabilize dsRNA (e.g., siRNA and DsiRNA). Patterns of LNA incorporation that retain potency are more restricted than 2'-O-methyl or 2'-F bases, so limited modification is preferred (Braasch et al., 2003, *Biochemistry* 42: 7967-7975; Grunweller et al., 2003, *Nucleic Acids Res* 31: 3185-3193; Elmen et al., 2005, *Nucleic Acids Res* 33: 439-447). Even with limited incorporation, the use of LNA modifications can improve dsRNA performance in vivo and may also alter or improve off target effect profiles (Mook et al., 2007, *Mol Cancer Ther* 6: 833-843).

Synthetic nucleic acids introduced into cells or live animals can be recognized as "foreign" and trigger an immune response. Immune stimulation constitutes a major class of off-target effects which can dramatically change experimental results and even lead to cell death. The innate immune system includes a collection of receptor molecules that specifically interact with DNA and RNA that mediate these responses, some of which are located in the cytoplasm and some of which reside in endosomes (Marques and Williams, 2005, *Nat Biotechnol* 23: 1399-1405; Schlee et al., 2006, *Mol Ther* 14: 463-470). Delivery of siRNAs by cationic lipids or liposomes exposes the siRNA to both cytoplasmic and endosomal compartments, maximizing the risk for triggering a type 1 interferon (IFN) response both in vitro and in vivo (Morrissey et al., 2005, *Nat Biotechnol* 23: 1002-1007; Sioud and Sorensen, 2003, *Biochem Biophys Res Commun* 312: 1220-1225; Sioud, 2005, *J Mol Biol* 348: 1079-1090; Ma et al., 2005, *Biochem Biophys Res Commun* 330: 755-759). RNAs transcribed within the cell are less immunogenic (Robbins et al., 2006, *Nat Biotechnol* 24: 566-571) and synthetic RNAs that are immunogenic when delivered using lipid-based methods can evade immune stimulation when introduced unto cells by mechanical means, even in vivo (Heidel et al., 2004, *Nat Biotechnol* 22: 1579-1582). However, lipid based delivery methods are convenient, effective, and widely used. Some general strategy to prevent immune responses is needed, especially for in vivo application where all cell types are present and the risk of generating an immune response is highest. Use of chemically modified RNAs may solve most or even all of these problems.

In certain embodiments, modifications can be included in the anti-C5 dsRNA agents of the present invention so long as the modification does not prevent the dsRNA agent from possessing C5 inhibitory activity. In one embodiment, one or more modifications are made that enhance Dicer processing of the DsiRNA agent (an assay for determining Dicer processing of a DsiRNA is described elsewhere herein). In a second embodiment, one or more modifications are made that result in more effective C5 inhibition (as described herein, C5 inhibition/C5 inhibitory activity of a dsRNA can be assayed via art-recognized methods for determining RNA levels, or for determining C5 polypeptide levels, should such levels be assessed in lieu of or in addition to assessment of, e.g., C5 mRNA levels). In a third embodiment, one or more modifications are made that support greater C5 inhibitory activity (means of determining C5 inhibitory activity are described supra). In a fourth embodiment, one or more modifications are made that result in greater potency of C5 inhibitory activity per each dsRNA agent molecule to be delivered to the cell (potency of C5 inhibitory activity is described supra). Modifications can be incorporated in the 3'-terminal region, the 5'-terminal region, in both the 3'-terminal and 5'-terminal region or in some instances in various positions within the sequence. With the restrictions noted above in mind, numbers and combinations of modifications can be incorporated into the dsRNA agent. Where multiple modifications are present, they may be the same or different. Modifications to bases, sugar moieties, the phosphate backbone, and their combinations are contemplated. Either 5'-terminus can be phosphorylated.

Examples of modifications contemplated for the phosphate backbone include phosphonates, including methylphosphonate, phosphorothioate, and phosphotriester modifications such as alkylphosphotriesters, and the like. Examples of modifications contemplated for the sugar moiety include 2'-alkyl pyrimidine, such as 2'-O-methyl, 2'-fluoro, amino, and deoxy modifications and the like (see, e.g., Amarzguioui et al., 2003, *Nucleic Acids Research* 31: 589-595). Examples of modifications contemplated for the base groups include abasic sugars, 2-O-alkyl modified pyrimidines, 4-thiouracil, 5-bromouracil, 5-iodouracil, and 5-(3-aminoallyl)-uracil and the like. Locked nucleic acids, or LNA's, could also be incorporated. Many other modifications are known and can be used so long as the above criteria are satisfied. Examples of modifications are also disclosed in U.S. Pat. Nos. 5,684,143, 5,858,988 and 6,291,438 and in U.S. published patent application No. 2004/0203145 A1. Other modifications are disclosed in Herdewijn (2000, *Antisense Nucleic Acid Drug Dev* 10: 297-310), Eckstein (2000, *Antisense Nucleic Acid Drug Dev* 10: 117-21), Rusckowski et al. (2000, *Antisense Nucleic Acid Drug Dev* 10: 333-345), Stein et al. (2001, *Antisense Nucleic Acid Drug Dev* 11: 317-25); Vorobjev et al. (2001, *Antisense Nucleic Acid Drug Dev* 11: 77-85).

One or more modifications contemplated can be incorporated into either strand. The placement of the modifications in the dsRNA agent can greatly affect the characteristics of the dsRNA agent, including conferring greater potency and stability, reducing toxicity, enhance Dicer processing, and minimizing an immune response. In one embodiment, the antisense strand or the sense strand or both strands have one or more 2'-O-methyl modified nucleotides. In another embodiment, the antisense strand contains 2'-O-methyl modified nucleotides. In another embodiment, the antisense stand contains a 3' overhang that is comprised of 2'-O-methyl modified nucleotides. The antisense strand could also include additional 2'-O-methyl modified nucleotides.

In certain embodiments, the anti-C5 DsiRNA agent of the invention has several properties which enhance its processing by Dicer. According to such embodiments, the DsiRNA agent has a length sufficient such that it is processed by Dicer to produce an siRNA and at least one of the following properties: (i) the DsiRNA agent is asymmetric, e.g., has a 3' overhang on the sense strand and (ii) the DsiRNA agent has a modified 3' end on the antisense strand to direct orientation of Dicer binding and processing of the dsRNA to an active siRNA. According to these embodiments, the longest strand in the DsiRNA agent comprises 25-30 nucleotides. In one embodiment, the sense strand comprises 25-30 nucleotides and the antisense strand comprises 25-28 nucleotides. Thus, the resulting dsRNA has an overhang on the 3' end of the sense strand. The overhang is 1-4 nucleotides, such as 2 nucleotides. The antisense strand may also have a 5' phosphate.

In certain embodiments, the sense strand of a DsiRNA agent is modified for Dicer processing by suitable modifiers located at the 3' end of the sense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the sense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the sense strand in place of two ribonucleotides forming a blunt end of the duplex on the 5' end of the antisense strand and the 3' end of the sense strand, and a two-nucleotide RNA overhang is located on the 3'-end of the antisense strand. This is an asymmetric composition with DNA on the blunt end and RNA bases on the overhanging end.

In certain other embodiments, the antisense strand of a DsiRNA agent is modified for Dicer processing by suitable modifiers located at the 3' end of the antisense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the antisense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the antisense strand in place of two ribonucleotides forming a blunt end of the duplex on the 5' end of the sense strand and the 3' end of the antisense strand, and a two-nucleotide RNA overhang is located on the 3'-end of the sense strand. This is also an asymmetric composition with DNA on the blunt end and RNA bases on the overhanging end.

The sense and antisense strands anneal under biological conditions, such as the conditions found in the cytoplasm of a cell. In addition, a region of one of the sequences, particularly of the antisense strand, of the dsRNA has a sequence length of at least 19 nucleotides, wherein these nucleotides are adjacent to the 3' end of antisense strand and are sufficiently complementary to a nucleotide sequence of the target C5 RNA.

Additionally, the DsiRNA agent structure can be optimized to ensure that the oligonucleotide segment generated from Dicer's cleavage will be the portion of the oligonucleotide that is most effective in inhibiting gene expression. For example, in one embodiment of the invention, a 27-bp oligonucleotide of the DsiRNA agent structure is synthesized wherein the anticipated 21 to 22-bp segment that will inhibit gene expression is located on the 3'-end of the antisense strand. The remaining bases located on the 5'-end of the antisense strand will be cleaved by Dicer and will be discarded. This cleaved portion can be homologous (i.e., based on the sequence of the target sequence) or non-homologous and added to extend the nucleic acid strand.

US 2007/0265220 discloses that 27mer DsiRNAs showed improved stability in serum over comparable 21mer siRNA compositions, even absent chemical modification. Modifications of DsiRNA agents, such as inclusion of 2'-O-methyl RNA in the antisense strand, in patterns such as detailed above, when coupled with addition of a 5' Phosphate, can improve stability of DsiRNA agents. Addition of 5'-phosphate to all strands in synthetic RNA duplexes may be an inexpensive and physiological method to confer some limited degree of nuclease stability.

The chemical modification patterns of the dsRNA agents of the instant invention are designed to enhance the efficacy of such agents. Accordingly, such modifications are designed to avoid reducing potency of dsRNA agents; to avoid interfering with Dicer processing of DsiRNA agents; to improve stability in biological fluids (reduce nuclease sensitivity) of dsRNA agents; or to block or evade detection by the innate immune system. Such modifications are also designed to avoid being toxic and to avoid increasing the cost or impact the ease of manufacturing the instant dsRNA agents of the invention.

In certain embodiments of the present invention, an anti-C5 DsiRNA agent has one or more of the following properties: (i) the DsiRNA agent is asymmetric, e.g., has a 3' overhang on the antisense strand and (ii) the DsiRNA agent has a modified 3' end on the sense strand to direct orientation of Dicer binding and processing of the dsRNA to an active siRNA. In one such contemplated embodiment, the longest strand in the dsRNA comprises 25-35 nucleotides (e.g., 25, 26, 27, 28, 29, 30, 31, 32, 33, 34 or 35 nucleotides). In certain such embodiments, the DsiRNA agent is asymmetric such that the sense strand comprises 25-34 nucleotides and the 3' end of the sense strand forms a blunt end with the 5' end of the antisense strand while the antisense strand comprises 26-35 nucleotides and forms an overhang on the 3' end of the antisense strand. In one embodiment, the DsiRNA agent is asymmetric such that the sense strand comprises 25-28 nucleotides and the antisense strand comprises 25-30 nucleotides. Thus, the resulting dsRNA has an overhang on the 3' end of the antisense strand. The overhang is 1-4 nucleotides, for example 2 nucleotides. The sense strand may also have a 5' phosphate.

The DsiRNA agent can also have one or more of the following additional properties: (a) the antisense strand has a right shift from the typical 21mer (e.g., the DsiRNA comprises a length of antisense strand nucleotides that extends to the 5' of a projected Dicer cleavage site within the DsiRNA, with such antisense strand nucleotides base paired with corresponding nucleotides of the sense strand extending 3' of a projected Dicer cleavage site in the sense strand), (b) the strands may not be completely complementary, i.e., the strands may contain simple mismatched base pairs (in certain embodiments, the DsiRNAs of the invention possess 1, 2, 3, 4 or even 5 or more mismatched base pairs, provided that C5 inhibitory activity of the DsiRNA possessing mismatched base pairs is retained at sufficient levels (e.g., retains at least 50% C5 inhibitory activity or more, at least 60% C5 inhibitory activity or more, at least 70% C5 inhibitory activity or more, at least 80% C5 inhibitory activity or more, at least 90% C5 inhibitory activity or more or at least 95% C5 inhibitory activity or more as compared to a corresponding DsiRNA not possessing mismatched base pairs. In certain embodiments, mismatched base pairs exist between the antisense and sense strands of a DsiRNA. In some embodiments, mismatched base pairs exist (or are predicted to exist) between the antisense strand and the target RNA. In certain embodiments, the presence of a mismatched base pair(s) between an antisense strand residue and a corresponding residue within the target RNA that is located 3' in the target RNA sequence of a projected Ago2 cleavage site retains and may even enhance C5 inhibitory activity of a DsiRNA of the invention) and (c) base modifications such as locked nucleic acid(s) may be included in the 5' end of the sense strand. A "typical" 21mer siRNA is designed using conventional techniques. In one technique, a variety of sites are commonly tested in parallel or pools containing several distinct siRNA duplexes specific to the same target with the hope that one of the reagents will be effective (Ji et al., 2003, *FEBS Lett* 552: 247-252). Other techniques use design rules and algorithms to increase the likelihood of obtaining active RNAi effector molecules (Schwarz et al., 2003, *Cell* 115: 199-208; Khvorova et al., 2003, *Cell* 115: 209-216; Ui-Tei et al., 2004, *Nucleic Acids Res* 32: 936-948; Reynolds et al., 2004, *Nat Biotechnol* 22: 326-330; Krol et al., 2004, *J Biol Chem* 279: 42230-42239; Yuan et al., 2004, *Nucl Acids Res* 32 (Webserver issue): W130-134; Boese et al., 2005, *Methods Enzymol* 392: 73-96). High throughput selection of siRNA has also been developed (U.S. published patent application No. 2005/0042641 A1). Potential target sites can also be analyzed by secondary structure predictions (Heale et al., 2005, *Nucleic Acids Res* 33(3): e30). This 21mer is then used to design a right shift to include 3-9 additional nucleotides on the 5' end of the 21mer. The sequence of these additional nucleotides is not restricted. In one embodiment, the added ribonucleotides are based on the sequence of the target gene. Even in this embodiment, full complementarity between the target sequence and the antisense siRNA is not required.

The first and second oligonucleotides of a DsiRNA agent of the instant invention are not required to be completely complementary. They only need to be sufficiently complementary to anneal under biological conditions and to provide a substrate for Dicer that produces a siRNA sufficiently complementary to the target sequence. Locked nucleic acids, or LNA's, are well known to a skilled artisan (Elmen et al., 2005, *Nucleic Acids Res* 33: 439-447; Kurreck et al., 2002, *Nucleic Acids Res* 30: 1911-1918; Crinelli et al., 2002, *Nucleic Acids Res* 30: 2435-2443; Braasch and Corey, 2001, *Chem Biol* 8: 1-7; Bondensgaard et al., 2000, *Chemistry* 6: 2687-2695; Wahlestedt et al., 2000, *Proc Natl Acad Sci USA* 97: 5633-5638). In one embodiment, an LNA is incorporated at the 5' terminus of the sense strand. In another embodiment, an LNA is incorporated at the 5' terminus of the sense strand in duplexes designed to include a 3' overhang on the antisense strand.

In certain embodiments, the DsiRNA agent of the instant invention has an asymmetric structure, with the sense strand having a 25-base pair length, and the antisense strand having a 27-base pair length with a 2 base 3'-overhang. In other embodiments, this DsiRNA agent having an asymmetric structure further contains 2 deoxynucleotides at the 3' end of the sense strand in place of two of the ribonucleotides.

Certain DsiRNA agent compositions containing two separate oligonucleotides can be linked by a third structure. The third structure will not block Dicer activity on the DsiRNA agent and will not interfere with the directed destruction of the RNA transcribed from the target gene. In one embodiment, the third structure may be a chemical linking group. Many suitable chemical linking groups are known in the art and can be used. Alternatively, the third structure may be an oligonucleotide that links the two oligonucleotides of the DsiRNA agent in a manner such that a hairpin structure is produced upon annealing of the two oligonucleotides making up the dsRNA composition. The hairpin structure will not block Dicer activity on the DsiRNA agent and will not interfere with the directed destruction of the C5 RNA.

C5 cDNA and Polypeptide Sequences

Known human and mouse C5 cDNA and polypeptide sequences include the following: human C5 GenBank Accession No. NM_001735.2 and corresponding human C5 polypeptide sequence GenBank Accession No. NP_001726.2; and mouse wild-type Hemolytic Complement (Hc, though also referred to as C5 herein) sequence GenBank Accession No. NM_010406.2 (*Mus musculus* C57BL/6 Hc) and corresponding mouse Hc sequence GenBank Accession No. NP_034536.1.

In Vitro Assay to Assess dsRNA C5 Inhibitory Activity

An in vitro assay that recapitulates RNAi in a cell-free system can be used to evaluate dsRNA constructs targeting C5 RNA sequence(s), and thus to assess C5-specific gene inhibitory activity (also referred to herein as C5 inhibitory activity) of a dsRNA. The assay comprises the system described by Tuschl et al., 1999, *Genes and Development*, 13, 3191-3197 and Zamore et al., 2000, *Cell*, 101, 25-33 adapted for use with dsRNA (e.g., DsiRNA) agents directed against C5 RNA. A *Drosophila* extract derived from syncytial blastoderm is used to reconstitute RNAi activity in vitro. Target RNA is generated via in vitro transcription from a selected C5 expressing plasmid using T7 RNA polymerase or via chemical synthesis. Sense and antisense dsRNA strands (for example, 20 uM each) are annealed by incubation in buffer (such as 100 mM potassium acetate, 30 mM HEPES-KOH, pH 7.4, 2 mM magnesium acetate) for 1 minute at 90° C. followed by 1 hour at 37° C., then diluted in lysis buffer (for example 100 mM potassium acetate, 30 mM HEPES-KOH at pH 7.4, 2 mM magnesium acetate). Annealing can be monitored by gel electrophoresis on an agarose gel in TBE buffer and stained with ethidium bromide. The *Drosophila* lysate is prepared using zero to two-hour-old embryos from Oregon R flies collected on yeasted molasses agar that are dechorionated and lysed. The lysate is centrifuged and the supernatant isolated. The assay comprises a reaction mixture containing 50% lysate [vol/vol], RNA (10-50 pM final concentration), and 10% [vol/vol] lysis buffer containing dsRNA (10 nM final concentration). The reaction mixture also contains 10 mM creatine phosphate, 10 ug/ml creatine phosphokinase, 100 um GTP, 100 uM UTP, 100 uM CTP, 500 uM ATP, 5 mM DTT, 0.1 U/uL RNasin (Promega), and 100 uM of each amino acid. The final concentration of potassium acetate is adjusted to 100 mM. The reactions are pre-assembled on ice and pre-incubated at 25° C. for 10 minutes before adding RNA, then incubated at 25° C. for an additional 60 minutes. Reactions are quenched with 4 volumes of 1.25×Passive Lysis Buffer (Promega). Target RNA cleavage is assayed by RT-PCR analysis or other methods known in the art and are compared to control reactions in which dsRNA is omitted from the reaction.

Alternately, internally-labeled target RNA for the assay is prepared by in vitro transcription in the presence of $[\alpha-^{32}P]$ CTP, passed over a G50 Sephadex column by spin chromatography and used as target RNA without further purification. Optionally, target RNA is 5'-$^{32}$P-end labeled using T4 polynucleotide kinase enzyme. Assays are performed as described above and target RNA and the specific RNA cleavage products generated by RNAi are visualized on an autoradiograph of a gel. The percentage of cleavage is determined by PHOSPHOR IMAGER® (autoradiography) quantitation of bands representing intact control RNA or RNA from control reactions without dsRNA and the cleavage products generated by the assay.

In one embodiment, this assay is used to determine target sites in the C5 RNA target for dsRNA mediated RNAi cleavage, wherein a plurality of dsRNA constructs are screened for RNAi mediated cleavage of the C5 RNA target, for example, by analyzing the assay reaction by electrophoresis of labeled target RNA, or by northern blotting, as well as by other methodology well known in the art.

In certain embodiments, a dsRNA of the invention is deemed to possess C5 inhibitory activity if, e.g., a 50% reduction in C5 RNA levels is observed in a system, cell, tissue or organism, relative to a suitable control. Additional metes and bounds for determination of C5 inhibitory activity of a dsRNA of the invention are described supra.

Conjugation and Delivery of Anti-C5 dsRNA Agents

In certain embodiments, the present invention relates to a method for treating a subject having or at risk of developing a disease or disorder for which inhibition of C5 is predicted to or has been demonstrated to have therapeutic value (e.g., a blood disease such as paroxysmal nocturnal hemoglobinuria (PNH)). In such embodiments, the dsRNA can act as novel therapeutic agents for controlling the disease or disorder for which inhibition of C5 is predicted to or has been demonstrated to have therapeutic value. The method comprises administering a pharmaceutical composition of the invention to the patient (e.g., human), such that the expression, level and/or activity of a C5 RNA is reduced. The expression, level and/or activity of a polypeptide encoded by a C5 RNA might also be reduced by a dsRNA of the instant invention, even where said dsRNA is directed against a non-coding region of the C5 transcript (e.g., a targeted 5' UTR or 3' UTR sequence). Because of their high specificity, the dsRNAs of the present invention can specifically target C5 sequences of cells and tissues, optionally even in an allele-specific manner where polymorphic alleles exist within an individual and/or population.

In the treatment of a disease or disorder for which inhibition of C5 is predicted to or has been demonstrated to have therapeutic value, the dsRNA can be brought into contact with the cells or tissue of a subject, e.g., the cells or tissue of a subject exhibiting disregulation of C5 and/or otherwise targeted for reduction of C5 levels. For example, dsRNA substantially identical to all or part of a C5 RNA sequence may be brought into contact with or introduced into such a cell, either in vivo or in vitro. Similarly, dsRNA substantially identical to all or part of a C5 RNA sequence may be administered directly to a subject having or at risk of developing a disease or disorder for which inhibition of C5 is predicted to or has been demonstrated to have therapeutic value.

Therapeutic use of the dsRNA agents of the instant invention can involve use of formulations of dsRNA agents comprising multiple different dsRNA agent sequences. For example, two or more, three or more, four or more, five or more, etc. of the presently described agents can be combined to produce a formulation that, e.g., targets multiple different regions of the C5 RNA, or that not only target C5 RNA but also target, e.g., cellular target genes associated with a disease or disorder for which inhibition of C5 is predicted to or has been demonstrated to have therapeutic value. A dsRNA agent of the instant invention may also be constructed such that either strand of the dsRNA agent independently targets two or more regions of C5 RNA, or such that one of the strands of the dsRNA agent targets a cellular target gene of C5 known in the art.

Use of multifunctional dsRNA molecules that target more then one region of a target nucleic acid molecule can also provide potent inhibition of C5 RNA levels and expression. For example, a single multifunctional dsRNA construct of the invention can target both the C5-809 and C5-1250 sites simultaneously; additionally and/or alternatively, single or multifunctional agents of the invention can be designed to selectively target one splice variant of C5 over another.

Thus, the dsRNA agents of the instant invention, individually, or in combination or in conjunction with other drugs, can be used to treat, inhibit, reduce, or prevent a disease or disorder for which inhibition of C5 is predicted to or has been demonstrated to have therapeutic value. For example, the dsRNA molecules can be administered to a subject or can be administered to other appropriate cells evident to those skilled in the art, individually or in combination with one or more drugs under conditions suitable for the treatment.

The dsRNA molecules also can be used in combination with other known treatments to treat, inhibit, reduce, or prevent a disease or disorder for which inhibition of C5 is predicted to or has been demonstrated to have therapeutic value in a subject or organism. For example, the described molecules could be used in combination with one or more known compounds, treatments, or procedures to treat, inhibit, reduce, or prevent a disease or disorder for which inhibition of C5 is predicted to or has been demonstrated to have therapeutic value in a subject or organism as are known in the art.

A dsRNA agent of the invention can be conjugated (e.g., at its 5' or 3' terminus of its sense or antisense strand) or unconjugated to another moiety (e.g. a non-nucleic acid moiety such as a peptide), or to an organic compound (e.g., a dye, cholesterol, or the like). Modifying dsRNA agents in this way may improve cellular uptake or enhance cellular targeting activities of the resulting dsRNA agent derivative as compared to the corresponding unconjugated dsRNA agent, are useful for tracing the dsRNA agent derivative in the cell, or improve the stability of the dsRNA agent derivative compared to the corresponding unconjugated dsRNA agent.

In certain embodiments, specific exemplary forms of dsRNA conjugates are contemplated. Notably, RNAi therapies, such as the dsRNAs that are specifically exemplified herein, have demonstrated particularly good ability to be delivered to the cells of the liver in vivo (via, e.g., lipid nanoparticles and/or conjugates such as dynamic polyconjugates or GalNAc conjugates—in certain exemplary embodiments, one or more GalNAc moieties can be conjugated to a 3'- and/or 5'-overhang region of a dsNA, optionally to an "extended" overhang region of a dsNA (e.g., to a 5 or more nucleotide, 8 or more nucleotide, etc. example of such an overhang); additionally and/or alternatively, one or more GalNAc moieties can be conjugated to ds extended regions of a dsNA, e.g., to the duplex region formed by the 5'-end region of the guide/antisense strand of a dsNA and the corresponding 3'-end region of the passenger/sense strand of a dsNA and/or to the duplex region formed by the 3'-end region of the guide/antisense strand of a dsNA and the corresponding 5'-end region of the passenger/sense strand of a dsNA). Thus, formulated RNAi therapies, such as those described herein, are attractive modalities for treating or preventing diseases or disorders that are present in, originate in or otherwise involve the liver.

Methods of Introducing Nucleic Acids, Vectors, and Host Cells dsRNA agents of the invention may be directly introduced into a cell (i.e., intracellularly); or introduced extracellularly into a cavity, interstitial space, into the circulation of an organism, introduced orally, or may be introduced by bathing a cell or organism in a solution containing the nucleic acid. Vascular or extravascular circulation, the blood or lymph system, and the cerebrospinal fluid are sites where the nucleic acid may be introduced.

The dsRNA agents of the invention can be introduced using nucleic acid delivery methods known in art including injection of a solution containing the nucleic acid, bombardment by particles covered by the nucleic acid, soaking the cell or organism in a solution of the nucleic acid, or electroporation of cell membranes in the presence of the nucleic acid. Other methods known in the art for introducing nucleic acids to cells may be used, such as lipid-mediated carrier transport, chemical-mediated transport, and cationic liposome transfection such as calcium phosphate, and the like. The nucleic acid may be introduced along with other components that perform one or more of the following activities: enhance nucleic acid uptake by the cell or otherwise increase inhibition of the target C5 RNA.

A cell having a target C5 RNA may be from the germ line or somatic, totipotent or pluripotent, dividing or non-dividing, parenchyma or epithelium, immortalized or transformed, or the like. The cell may be a stem cell or a differentiated cell. Cell types that are differentiated include adipocytes, fibroblasts, myocytes, cardiomyocytes, endothelium, neurons, glia, blood cells, megakaryocytes, lymphocytes, macrophages, neutrophils, eosinophils, basophils, mast cells, leukocytes, granulocytes, keratinocytes, chondrocytes, osteoblasts, osteoclasts, hepatocytes, and cells of the endocrine or exocrine glands.

Depending on the particular target C5 RNA sequence and the dose of dsRNA agent material delivered, this process may provide partial or complete loss of function for the C5 RNA. A reduction or loss of RNA levels or expression (either C5 RNA expression or encoded polypeptide expression) in at least 50%, 60%, 70%, 80%, 90%, 95% or 99% or more of targeted cells is exemplary. Inhibition of C5 RNA levels or expression refers to the absence (or observable decrease) in the level of C5 RNA or C5 RNA-encoded protein. Specificity refers to the ability to inhibit the C5 RNA without manifest effects on other genes of the cell. The consequences of inhibition can be confirmed by examination of the outward properties of the cell or organism or by biochemical techniques such as RNA solution hybridization, nuclease protection, Northern hybridization, reverse transcription, gene expression monitoring with a microarray, antibody binding, enzyme linked immunosorbent assay (ELISA), Western blotting, radioimmunoassay (RIA), other immunoassays, and fluorescence activated cell analysis (FACS). Inhibition of target C5 RNA sequence(s) by the dsRNA agents of the invention also can be measured based upon the effect of administration of such dsRNA agents upon development/progression of a disease or disorder for which inhibition of C5 is predicted to or has been demonstrated to have therapeutic value, e.g., paroxysmal nocturnal hemoglobinuria (PNH) or other rare disease, either in vivo or in vitro. Treatment and/or reductions in PNH and/or other rare disease can include halting or reduction of organ damage (e.g., blood, bone marrow and/or thrombosis-associated damage) associated with PNH or other rare disease (e.g., reduction of blood damage, bone marrow damage or thrombosis e.g., 10%, 20%, 30%, 40%, 50%, 60%, 70%, 80%, 90%, 95% or 99% or more, and can also be measured in logarithmic terms, e.g., 10-fold, 100-fold, 1000-fold, $10^5$-fold, $10^6$-fold, $10^7$-fold reduction in blood damage, bone marrow damage or thrombolytic damage could be achieved via administration of the dsRNA agents of the invention to cells, a tissue, or a subject).

For RNA-mediated inhibition in a cell line or whole organism, expression of a reporter or drug resistance gene whose protein product is easily assayed can be measured. Such reporter genes include acetohydroxyacid synthase (AHAS), alkaline phosphatase (AP), beta galactosidase (LacZ), beta glucoronidase (GUS), chloramphenicol acetyltransferase (CAT), green fluorescent protein (GFP), horseradish peroxidase (HRP), luciferase (Luc), nopaline synthase (NOS), octopine synthase (OCS), and derivatives thereof. Multiple selectable markers are available that confer resistance to ampicillin, bleomycin, chloramphenicol, gentamycin, hygromycin, kanamycin, lincomycin, methotrexate, phosphinothricin, puromycin, and tetracyclin. Depending on the assay, quantitation of the amount of gene expression allows one to determine a degree of inhibition which is greater than 10%, 33%, 50%, 90%, 95% or 99% as compared to a cell not treated according to the present invention.

Lower doses of injected material and longer times after administration of RNA silencing agent may result in inhibition in a smaller fraction of cells (e.g., at least 10%, 20%, 50%, 75%, 90%, or 95% of targeted cells). Quantitation of gene expression in a cell may show similar amounts of inhibition at the level of accumulation of target C5 RNA or translation of target protein. As an example, the efficiency of inhibition may be determined by assessing the amount of gene product in the cell; RNA may be detected with a hybridization probe having a nucleotide sequence outside the region used for the inhibitory dsRNA, or translated polypeptide may be detected with an antibody raised against the polypeptide sequence of that region.

The dsRNA agent may be introduced in an amount which allows delivery of at least one copy per cell. Higher doses (e.g., at least 5, 10, 100, 500 or 1000 copies per cell) of material may yield more effective inhibition; lower doses may also be useful for specific applications.

C5 Biology

Complement component 5 is the fifth component of complement, which plays an important role in inflammatory and cell killing processes. This protein is composed of alpha and beta polypeptide chains that are linked by a disulfide bridge. An activation peptide, C5a, which is an anaphylatoxin that possesses potent spasmogenic and chemotactic activity, is derived from the alpha polypeptide via cleavage with a convertase. The C5b macromolecular cleavage product can form a complex with the C6 complement component, and this complex is the basis for formation of the membrane attack complex, which includes additional complement components (Entrez Gene: Complement component 5).

An acquired genetic mutation in patients with PNH leads to the generation from bone marrow of abnormal cell lines (known as PNH cells) that are deficient in protective complement inhibitors on the cell surface. PNH red blood cells undergo lysis due to constant attack by the body's complement (immune) system. Eculizumab inhibits terminal complement-mediated chronic hemolysis in people with PNH (Brodsky et al. (2009) Hematology: Basic Principles and Practice (Philadelphia, Pa.: Churchill Livingstone): 385-395).

Eculizumab specifically binds to the terminal Complement component 5, or C5, which acts at a late stage in the complement cascade. When activated, C5 is involved in activating host cells, thereby attracting pro-inflammatory immune cells, while also destroying cells by triggering pore formation. By inhibiting the complement cascade at this point, the normal, disease-preventing functions of proximal complement system are largely preserved, while the properties of C5 that promote inflammation and cell destruction are impeded (Brodsky et al. (2009) Hematology: Basic Principles and Practice (Philadelphia, Pa.: Churchill Livingstone): 385-395).

Eculizumab inhibits the cleavage of C5 to C5a (a potent anaphylatoxin with prothrombotic and proinflammatory properties) and C5b by the C5 convertase, which prevents the generation of the terminal complement complex C5b-9 (which also has prothrombotic and proinflammatory effects). Both C5a and C5b-9 cause the terminal complement-mediated events that are characteristic of PNH and atypical hemolytic uremic syndrome (aHUS; Brodsky et al. (2009) Hematology: Basic Principles and Practice (Philadelphia, Pa.: Churchill Livingstone): 385-395).

The classic sign of PNH is red discoloration of the urine due to the presence of hemoglobin and hemosiderin from the breakdown of red blood cells. As the urine is more concentrated in the morning, this is when the color is most pronounced. This phenomenon mainly occurs in those who have the primary form of PNH, who will notice this at some point in their disease course. The remainder mainly experience the symptoms of anemia, such as tiredness, shortness of breath and palpitations (Parker et al. *Blood* 106 (12): 3699-709).

A small proportion of patients report attacks of abdominal pain, difficulty swallowing and pain during swallowing, as well as erectile dysfunction in men; this occurs mainly when the breakdown of red blood cells is rapid, and is attributable to spasm of smooth muscle due to red cell breakdown products (Parker et al. *Blood* 106 (12): 3699-709).

Forty percent of people with PNH develop thrombosis (a blood clot) at some point in their illness. This is the main cause of severe complications and death in PNH. These may develop in common sites (deep vein thrombosis of the leg and resultant pulmonary embolism when these clots break off and enter the lungs), but in PNH, blood clots may also form in more unusual sites: the hepatic vein (causing Budd-Chiari syndrome), the portal vein of the liver (causing portal vein thrombosis), the superior or inferior mesenteric vein (causing mesenteric ischemia) and veins of the skin. Cerebral venous thrombosis, an uncommon form of stroke, is more common in PNH (Parker et al. Blood 106 (12): 3699-709).

PNH Diagnosis

Blood tests in PNH show changes consistent with intravascular hemolytic anemia: low hemoglobin, raised lactate dehydrogenase, raised bilirubin (a breakdown product of hemoglobin), and decreased levels of haptoglobin; there can be raised reticulocytes (immature red cells released by the bone marrow to replace the destroyed cells) if there is no iron deficiency present. The direct antiglobulin test (DAT, or direct Coombs' test) is negative, as the hemolysis of PNH is not caused by antibodies (Parker et al. Blood 106 (12): 3699-709). If the PNH occurs in the setting of known (or suspected) aplastic anemia, abnormal white blood cell counts and decreased platelet counts may also occur. In this case, anemia may be caused by insufficient red blood cell production in addition to the hemolysis (Parker et al. Blood 106 (12): 3699-709).

Historically, the sucrose lysis test, in which a patient's red blood cells are placed in low-ionic-strength solution and observed for hemolysis, was used for screening. If this was positive, the Ham's acid hemolysis test (after Dr Thomas Ham, who described the test in 1937) was performed for confirmation (Brodsky, R A Blood 113 (26): 6522-7; Ham T H N Engl J Med 217 (23): 915-918).

At present, diagnosis is most accurately performed via performance of flow cytometry for CD55 and CD59 on white and red blood cells. Based on the levels of these cell proteins, erythrocytes may be classified as type I, II, or III PNH cells. Type I cells have normal levels of CD55 and CD59; type II have reduced levels; and type III have absent levels (Parker et al. Blood 106 (12): 3699-709). The fluorescein-labeled proaerolysin (FLAER) test is being used more frequently to diagnose PNH. FLAER binds selectively to the glycophosphatidylinositol anchor and is more accurate in demonstrating a deficit than simply for CD59 or CD55 (Brodsky, R A Blood 113 (26): 6522-7).

PNH Classification

PNH is classified by the context under which it is diagnosed (Parker et al. Blood 106 (12): 3699-709). Classic PNH shows evidence of PNH in the absence of another bone marrow disorder, or is PNH in the setting of another specified bone marrow disorder such as aplastic anemia and mylodyastic syndrome (MDS). In contrast, subclinical PNH is PNH that shows abnormalities in flow cytometry without signs of hemolysis.

PNH Pathophysiology

All cells have proteins attached to their membranes that are responsible for performing a vast array of functions. There are several ways for proteins to be attached to a cell membrane. PNH occurs as a result of a defect in one of these mechanisms (Parker et al. Blood 106 (12): 3699-709).

There are several enzymes that are needed to make glycosylphosphatidylinositol (GPI), a molecule that anchors proteins to the cell membrane. The most common enzyme that is defective in PNH is phosphatidylinositol glycan A (PIGA). The gene that codes for PIGA is located on the X chromosome, which means that only one active copy of the gene for PIGA is present in each cell (initially, females have two copies, but one is silenced through X-inactivation; Luzzatto, L. *Blood* 122 (7): 1099-1100). If a mutation occurs in this gene then PIGA may be defective, which leads to the GPI anchor not being expressed on the cell membrane. When this mutation occurs in a hematopoietic stem cell in the bone marrow (which are used to make red blood cells as well as white blood cells and platelets), all of the cells it produces will also have the defect (Parker et al. *Blood* 106 (12): 3699-709).

Several of the proteins that anchor to GPI on the cell membrane are used to protect the cell from destruction by the complement system, and, without these anchors, the cells are more easily targeted by the complement proteins (Kumar Vinay et al. Robbins Basic Pathology (8th ed.). Saunders Elsevier. p. 432). Although red blood cells, white blood cells and platelets are targeted by complement, red blood cells are particularly vulnerable to lysis. The complement system is part of the innate immune system and has a variety of functions, from destroying invading microorganisms by opsonisation to direct destabilization by the membrane attack complex. The main proteins that protect blood cells from destruction are decay-accelerating factor (DAF/CD55), which disrupts formation of C3 convertase, and protectin (CD59/MIRL/MAC-IP), which binds the membrane attack complex and prevents C9 from binding to the cell (Parker et al. *Blood* 106 (12): 3699-709).

The symptoms of esophageal spasm, erectile dysfunction, and abdominal pain are attributed to the fact that hemoglobin released during hemolysis binds with circulating nitric oxide, a substance that is needed to relax smooth muscle. This theory is supported by the fact that these symptoms improve on administration of nitrates or sildenafil (Viagra), which improves the effect of nitric oxide on muscle cells (Parker et al. *Blood* 106 (12): 3699-709). There is a suspicion that chronic hemolysis causing chronically depleted nitric oxide may lead to the development of pulmonary hypertension (increased pressure in the blood vessels supplying the lung), which in turn puts strain on the heart and causes heart failure (Rother R P et al. *JAMA* 293 (13): 1653-62).

PNH Treatment
Long-Term

PNH is a chronic condition. In patients with only a small clone and few problems, monitoring of the flow cytometry every six months gives information on the severity and risk of potential complications. Given the high risk of thrombosis in PNH, preventative treatment with warfarin decreases the risk of thrombosis in those with a large clone (50% of white blood cells type III; Parker et al. *Blood* 106 (12): 3699-709; Hall C et al. *Blood* 102 (10): 3587-91).

Episodes of thrombosis are treated as they would in other patients, but, given that PNH is a persisting underlying cause, it is likely that treatment with warfarin or similar drugs needs to be continued long-term after an episode of thrombosis (Parker et al. Blood 106 (12): 3699-709).

A monoclonal antibody, eculizumab, protects blood cells against immune destruction by inhibiting the complement system. It has been shown to reduce the need for blood transfusion in patients with significant hemolysis (Hillmen et al. *N. Engl. J. Med.* 350 (6): 552-9).

Acute Attacks

There is disagreement as to whether steroids (such as prednisolone) can decrease the severity of hemolytic crises. Transfusion therapy may be needed; in addition to correcting significant anemia, this suppresses the production of PNH cells by the bone marrow, and indirectly the severity of the hemolysis. Iron deficiency develops with time, due to losses in urine, and may have to be treated if present. Iron therapy can result in more hemolysis as more PNH cells are produced (Parker et al. *Blood* 106 (12): 3699-709).

PNH Screening

There are several groups where screening for PNH should be undertaken. These include patients with unexplained thrombosis who are young, have thrombosis in an unusual site (e.g. intra-abdominal veins, cerebral veins, dermal veins), have any evidence of hemolysis (i.e. a raised LDH), or have cytopenia of any kind (Hill A et al. *Blood* 121 (25): 4985-4996).

Those who have a diagnosis of aplastic anemia should be screened annually (Parker et al. *Blood* 106 (12): 3699-709). It is also recommended in anyone with myelodysplastic syndrome, unexplained hemolysis or unexplained cytopenias.

PNH Epidemiology

PNH is rare, with an annual rate of 1-2 cases per million (Parker et al. Blood 106 (12): 3699-709). The prognosis without disease-modifying treatment is 10-20 years (Pu and Brodsky. Clinical and translational science 4 (3): 219-24). Many cases develop in people who have previously been diagnosed with aplastic anemia or myelodysplastic syndrome. The fact that PNH develops in MDS also explains why there appears to be a higher rate of leukemia in PNH, as MDS can sometimes transform into leukemia (Parker et al. *Blood* 106 (12): 3699-709).

25% of female cases of PNH are discovered during pregnancy. This group has a high rate of thrombosis, and the risk of death of both mother and child are significantly increased (20% and 8% respectively; Parker et al. *Blood* 106 (12): 3699-709).

Pharmaceutical Compositions

In certain embodiments, the present invention provides for a pharmaceutical composition comprising the dsRNA agent of the present invention. The dsRNA agent sample can be suitably formulated and introduced into the environment of the cell by any means that allows for a sufficient portion of the sample to enter the cell to induce gene silencing, if it is to occur. Many formulations for dsRNA are known in the art and can be used so long as the dsRNA gains entry to the target cells so that it can act. See, e.g., U.S. published patent application Nos. 2004/0203145 A1 and 2005/0054598 A1. For example, the dsRNA agent of the instant invention can be formulated in buffer solutions such as phosphate buffered saline solutions, liposomes, micellar structures, and capsids. Formulations of dsRNA agent with cationic lipids can be used to facilitate transfection of the dsRNA agent into cells. For example, cationic lipids, such as lipofectin (U.S. Pat. No. 5,705,188), cationic glycerol derivatives, and polycationic molecules, such as polylysine (published PCT International Application WO 97/30731), can be used. Suitable lipids include Oligofectamine, Lipofectamine (Life Technologies), NC388 (Ribozyme Pharmaceuticals, Inc., Boulder, Colo.), or FuGene 6 (Roche) all of which can be used according to the manufacturer's instructions.

Such compositions typically include the nucleic acid molecule and a pharmaceutically acceptable carrier. As used herein the language "pharmaceutically acceptable carrier" includes saline, solvents, dispersion media, coatings, antibacterial and antifungal agents, isotonic and absorption delaying agents, and the like, compatible with pharmaceutical administration. Supplementary active compounds can also be incorporated into the compositions.

A pharmaceutical composition is formulated to be compatible with its intended route of administration. Examples of routes of administration include parenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; cHuh7ting agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringability exists. It should be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyetheylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in a selected solvent with one or a combination of ingredients enumerated above, as required, followed by filtered sterilization. Generally, dispersions are prepared by incorporating the active compound into a sterile vehicle, which contains a basic dispersion medium and the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof.

Oral compositions generally include an inert diluent or an edible carrier. For the purpose of oral therapeutic administration, the active compound can be incorporated with excipients and used in the form of tablets, troches, or capsules, e.g., gelatin capsules. Oral compositions can also be prepared using a fluid carrier for use as a mouthwash. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer. Such methods include those described in U.S. Pat. No. 6,468,798.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

The compounds can also be administered by transfection or infection using methods known in the art, including but not limited to the methods described in McCaffrey et al. (2002), Nature, 418(6893), 38-9 (hydrodynamic transfection); Xia et al. (2002), Nature Biotechnol., 20(10), 1006-10 (viral-mediated delivery); or Putnam (1996), Am. J. Health Syst. Pharm. 53(2), 151-160, erratum at Am. J. Health Syst. Pharm. 53(3), 325 (1996).

The compounds can also be administered by a method suitable for administration of nucleic acid agents, such as a DNA vaccine. These methods include gene guns, bio injectors, and skin patches as well as needle-free methods such as the micro-particle DNA vaccine technology disclosed in U.S. Pat. No. 6,194,389, and the mammalian transdermal needle-free vaccination with powder-form vaccine as disclosed in U.S. Pat. No. 6,168,587. Additionally, intranasal delivery is possible, as described in, inter alia, Hamajima et al. (1998), Clin. Immunol. Immunopathol., 88(2), 205-10. Liposomes (e.g., as described in U.S. Pat. No. 6,472,375) and microencapsulation can also be used. Biodegradable targetable microparticle delivery systems can also be used (e.g., as described in U.S. Pat. No. 6,471,996).

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Such formulations can be prepared using standard techniques. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds which exhibit high therapeutic indices are preferred. While compounds that exhibit toxic side effects may be used, care should be taken to design a delivery system that targets such compounds to the site of affected tissue in order to minimize potential damage to uninfected cells and, thereby, reduce side effects.

The data obtained from the cell culture assays and animal studies can be used in formulating a range of dosage for use in humans. The dosage of such compounds lies preferably within a range of circulating concentrations that include the $ED_{50}$ with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range that includes the $IC_{50}$ (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

As defined herein, a therapeutically effective amount of a nucleic acid molecule (i.e., an effective dosage) depends on the nucleic acid selected. For instance, single dose amounts of a dsRNA (or, e.g., a construct(s) encoding for such dsRNA) in the range of approximately 1 pg to 1000 mg may be administered; in some embodiments, 10, 30, 100, or 1000 pg, or 10, 30, 100, or 1000 ng, or 10, 30, 100, or 1000 µg, or 10, 30, 100, or 1000 mg may be administered. In some embodiments, 1-5 g of the compositions can be administered. The compositions can be administered one from one or more times per day to one or more times per week; including once every other day. The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a nucleic acid (e.g., dsRNA), protein, polypeptide, or antibody can include a single treatment or, preferably, can include a series of treatments.

The nucleic acid molecules of the invention can be inserted into expression constructs, e.g., viral vectors, retroviral vectors, expression cassettes, or plasmid viral vectors, e.g., using methods known in the art, including but not limited to those described in Xia et al., (2002), supra. Expression constructs can be delivered to a subject by, for example, inhalation, orally, intravenous injection, local administration (see U.S. Pat. No. 5,328,470) or by stereotactic injection (see e.g., Chen et al. (1994), Proc. Natl. Acad. Sci. USA, 91, 3054-3057). The pharmaceutical preparation of the delivery vector can include the vector in an acceptable diluent, or can comprise a slow release matrix in which the delivery vehicle is imbedded. Alternatively, where the complete delivery vector can be produced intact from recombinant cells, e.g., retroviral vectors, the pharmaceutical preparation can include one or more cells which produce the gene delivery system.

The expression constructs may be constructs suitable for use in the appropriate expression system and include, but are not limited to retroviral vectors, linear expression cassettes, plasmids and viral or virally-derived vectors, as known in the art. Such expression constructs may include one or more inducible promoters, RNA Pol III promoter systems such as U6 snRNA promoters or H1 RNA polymerase III promoters, or other promoters known in the art. The constructs can include one or both strands of the siRNA. Expression constructs expressing both strands can also include loop structures linking both strands, or each strand can be separately transcribed from separate promoters within the same construct. Each strand can also be transcribed from a separate expression construct, e.g., Tuschl (2002, *Nature Biotechnol* 20: 500-505).

It can be appreciated that the method of introducing dsRNA agents into the environment of the cell will depend on the type of cell and the make up of its environment. For example, when the cells are found within a liquid, one preferable formulation is with a lipid formulation such as in lipofectamine and the dsRNA agents can be added directly to the liquid environment of the cells. Lipid formulations can also be administered to animals such as by intravenous, intramuscular, or intraperitoneal injection, or orally or by inhalation or other methods as are known in the art. When the formulation is suitable for administration into animals such as mammals and more specifically humans, the formulation is also pharmaceutically acceptable. Pharmaceutically acceptable formulations for administering oligonucleotides are known and can be used. In some instances, it may be preferable to formulate dsRNA agents in a buffer or saline solution and directly inject the formulated dsRNA agents into cells, as in studies with oocytes. The direct injection of dsRNA agent duplexes may also be done. For suitable methods of introducing dsRNA (e.g., DsiRNA agents), see U.S. published patent application No. 2004/0203145 A1.

Suitable amounts of a dsRNA agent must be introduced and these amounts can be empirically determined using standard methods. Typically, effective concentrations of individual dsRNA agent species in the environment of a cell will be 50 nanomolar or less, 10 nanomolar or less, or compositions in which concentrations of 1 nanomolar or less can be used. In another embodiment, methods utilizing a concentration of 200 picomolar or less, 100 picomolar or less, 50 picomolar or less, 20 picomolar or less, and even a concentration of 10 picomolar or less, 5 picomolar or less, 2 picomolar or less or 1 picomolar or less can be used in many circumstances.

The method can be carried out by addition of the dsRNA agent compositions to an extracellular matrix in which cells can live provided that the dsRNA agent composition is formulated so that a sufficient amount of the dsRNA agent can enter the cell to exert its effect. For example, the method is amenable for use with cells present in a liquid such as a liquid culture or cell growth media, in tissue explants, or in whole organisms, including animals, such as mammals and especially humans.

The level or activity of a C5 RNA can be determined by a suitable method now known in the art or that is later developed. It can be appreciated that the method used to measure a target RNA and/or the expression of a target RNA can depend upon the nature of the target RNA. For example, where the target C5 RNA sequence encodes a protein, the term "expression" can refer to a protein or the C5 RNA/transcript derived from the C5 gene (either genomic or of exogenous origin). In such instances the expression of the target C5 RNA can be determined by measuring the amount of C5 RNA/transcript directly or by measuring the amount of C5 protein. Protein can be measured in protein assays such as by staining or immunoblotting or, if the protein catalyzes a reaction that can be measured, by measuring reaction rates. All such methods are known in the art and can be used. Where target C5 RNA levels are to be measured, art-recognized methods for detecting RNA levels can be used (e.g., RT-PCR, Northern Blotting, etc.). In targeting C5 RNAs with the dsRNA agents of the instant invention, it is also anticipated that measurement of the efficacy of a dsRNA agent in reducing levels of C5 RNA or protein in a subject, tissue, in cells, either in vitro or in vivo, or in cell extracts can also be used to determine the extent of reduction of C5-associated phenotypes (e.g., disease or disorders, e.g., PNH, PNH-associated biomarkers and/or phenotypes, other rare diseases and associated biomarkers and/or phenotypes, etc.). The above measurements can be made on cells, cell extracts, tissues, tissue extracts or other suitable source material.

The determination of whether the expression of a C5 RNA has been reduced can be by a suitable method that can reliably detect changes in RNA levels. Typically, the determination is made by introducing into the environment of a cell undigested dsRNA such that at least a portion of that dsRNA agent enters the cytoplasm, and then measuring the level of the target RNA. The same measurement is made on identical untreated cells and the results obtained from each measurement are compared.

The dsRNA agent can be formulated as a pharmaceutical composition which comprises a pharmacologically effective amount of a dsRNA agent and pharmaceutically acceptable carrier. A pharmacologically or therapeutically effective amount refers to that amount of a dsRNA agent effective to produce the intended pharmacological, therapeutic or preventive result. The phrases "pharmacologically effective amount" and "therapeutically effective amount" or simply "effective amount" refer to that amount of an RNA effective to produce the intended pharmacological, therapeutic or preventive result. For example, if a given clinical treatment is considered effective when there is at least a 20% reduction in a measurable parameter associated with a disease or disorder, a therapeutically effective amount of a drug for the treatment of that disease or disorder is the amount necessary to effect at least a 20% reduction in that parameter.

Suitably formulated pharmaceutical compositions of this invention can be administered by means known in the art such as by parenteral routes, including intravenous, intramuscular, intraperitoneal, subcutaneous, transdermal, airway (aerosol), rectal, vaginal and topical (including buccal and sublingual) administration. In some embodiments, the pharmaceutical compositions are administered by intravenous or intraparenteral infusion or injection.

In general, a suitable dosage unit of dsRNA will be in the range of 0.001 to 0.25 milligrams per kilogram body weight of the recipient per day, or in the range of 0.01 to 20 micrograms per kilogram body weight per day, or in the range of 0.001 to 5 micrograms per kilogram of body weight per day, or in the range of 1 to 500 nanograms per kilogram of body weight per day, or in the range of 0.01 to 10 micrograms per kilogram body weight per day, or in the range of 0.10 to 5 micrograms per kilogram body weight per day, or in the range of 0.1 to 2.5 micrograms per kilogram body weight per day. A pharmaceutical composition comprising the dsRNA can be administered once daily. However, the therapeutic agent may also be dosed in dosage units containing two, three, four, five, six or more sub-doses administered at appropriate intervals throughout the day. In that case, the dsRNA contained in each sub-dose must be correspondingly smaller in order to achieve the total daily dosage unit. The dosage unit can also be compounded for a single dose over several days, e.g., using a conventional sustained release formulation which provides sustained and consistent release of the dsRNA over a several day period. Sustained release formulations are well known in the art. In this embodiment, the dosage unit contains a corresponding multiple of the daily dose. Regardless of the formulation, the pharmaceutical composition must contain dsRNA in a quantity sufficient to inhibit expression of the target gene in the animal or human being treated. The composition can be compounded in such a way that the sum of the multiple units of dsRNA together contain a sufficient dose.

Data can be obtained from cell culture assays and animal studies to formulate a suitable dosage range for humans. The dosage of compositions of the invention lies within a range of circulating concentrations that include the $ED_{50}$ (as determined by known methods) with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range of the compound that includes the $IC_{50}$ (i.e., the concentration of the test compound which achieves a half-maximal inhibition of symptoms) as determined in cell culture. Such information can be used to more accurately determine useful doses in humans. Levels of dsRNA in plasma may be measured by standard methods, for example, by high performance liquid chromatography.

The pharmaceutical compositions can be included in a kit, container, pack, or dispenser together with instructions for administration.

Methods of Treatment

The present invention provides for both prophylactic and therapeutic methods of treating a subject at risk of (or susceptible to) a disease or disorder caused, in whole or in part, by C5 (e.g., normal functioning or misregulation and/or elevation of C5 transcript and/or C5 protein levels), or treatable via selective targeting of C5.

"Treatment", or "treating" as used herein, is defined as the application or administration of a therapeutic agent (e.g., a dsRNA agent or vector or transgene encoding same) to a patient, or application or administration of a therapeutic agent to an isolated tissue or cell line from a patient, who has the disease or disorder, a symptom of disease or disorder or a predisposition toward a disease or disorder, with the purpose to cure, heal, alleviate, relieve, alter, remedy, ameliorate, improve or affect the disease or disorder, the symptoms of the disease or disorder, or the predisposition toward disease.

In one aspect, the invention provides a method for preventing in a subject, a disease or disorder as described above (including, e.g., prevention of the commencement of, e.g., PNH-forming events within a subject via inhibition of C5 expression), by administering to the subject a therapeutic agent (e.g., a dsRNA agent or vector or transgene encoding same). Subjects at risk for the disease can be identified by, for example, one or a combination of diagnostic or prognostic assays as described herein. Administration of a prophylactic agent can occur prior to the detection of, e.g., PNH in a subject, or the manifestation of symptoms characteristic of the disease or disorder, such that the disease or disorder is prevented or, alternatively, delayed in its progression.

Another aspect of the invention pertains to methods of treating subjects therapeutically, i.e., altering the onset of symptoms of the disease or disorder. These methods can be performed in vitro (e.g., by culturing the cell with the dsRNA agent) or, alternatively, in vivo (e.g., by administering the dsRNA agent to a subject).

With regards to both prophylactic and therapeutic methods of treatment, such treatments may be specifically tailored or modified, based on knowledge obtained from the field of pharmacogenomics. "Pharmacogenomics", as used herein, refers to the application of genomics technologies such as gene sequencing, statistical genetics, and gene expression analysis to drugs in clinical development and on the market. More specifically, the term refers the study of how a patient's genes determine his or her response to a drug (e.g., a patient's "drug response phenotype", or "drug response genotype"). Thus, another aspect of the invention provides methods for tailoring an individual's prophylactic or therapeutic treatment with either the target C5 RNA molecules of the present invention or target C5 RNA modulators according to that individual's drug response genotype. Pharmacogenomics allows a clinician or physician to target prophylactic or therapeutic treatments to patients who will most benefit from the treatment and to avoid treatment of patients who will experience toxic drug-related side effects.

Therapeutic agents can be tested in a selected animal model. For example, a dsRNA agent (or expression vector or transgene encoding same) as described herein can be used in an animal model to determine the efficacy, toxicity, or side effects of treatment with said agent. Alternatively, an agent (e.g., a therapeutic agent) can be used in an animal model to determine the mechanism of action of such an agent.

Models Useful to Evaluate the Down-Regulation of C5 mRNA Levels and Expression

Cell Culture

The dsRNA agents of the invention can be tested for cleavage activity in vivo, for example, using the following procedure. The nucleotide sequences within the C5 cDNA targeted by the dsRNA agents of the invention are shown in the above C5 sequences.

The dsRNA reagents of the invention can be tested in cell culture using HepG2 or other mammalian cells (e.g., human cell lines Hep3B, HeLa, DU145, Calu3, SW480, T84, PL45, etc., and mouse cell lines LMTK−, Hepa1-6, AML12, Neuro2a, etc.) to determine the extent of C5 RNA and/or C5 protein inhibition. In certain embodiments, DsiRNA reagents (e.g., see FIG. 1, and above-recited structures) are selected against the C5 target as described herein. C5 RNA inhibition is measured after delivery of these reagents by a suitable transfection agent to, for example, cultured HepG2 cells or other transformed or non-transformed mammalian cells in culture. Relative amounts of target C5 RNA are measured by reporter assay (e.g., as exemplified below) and/or versus HPRT1, actin or other appropriate control using real-time PCR monitoring of amplification (e.g., ABI 7700 TAQMAN®). A comparison is made to the activity of oligonucleotide sequences made to unrelated targets or to a randomized DsiRNA control with the same overall length and chemistry, or simply to appropriate vehicle-treated or untreated controls. Primary and secondary lead reagents are chosen for the target and optimization performed.

TAQMAN® (Real-Time PCR Monitoring of Amplification) and Lightcycler Quantification of mRNA For RT-qPCR assays, total RNA is prepared from cells following DsiRNA delivery, for example, using Ambion Rnaqueous 4-PCR purification kit for large scale extractions, or Promega SV96 for 96-well assays. For Taqman analysis, dual-labeled probes are synthesized with, for example, the reporter dyes FAM or VIC covalently linked at the 5'-end and the quencher dye TAMRA conjugated to the 3'-end. PCR amplifications are performed on, for example, an ABI PRISM 7700 Sequence detector using 50 uL reactions consisting of 10 uL total RNA, 100 nM forward primer, 100 mM reverse primer, 100 nM probe, 1×TaqMan PCR reaction buffer (PE-Applied Biosystems), 5.5 mM MgCl2, 100 uM each dATP, dCTP, dGTP and dTTP, 0.2 U RNase Inhibitor (Promega), 0.025 U AmpliTaq Gold (PE-Applied Biosystems) and 0.2 U M-MLV Reverse Transcriptase (Promega). The thermal cycling conditions can consist of 30 minutes at 48° C., 10 minutes at 95° C., followed by 40 cycles of 15 seconds at 95° C. and 1 minute at 60° C. Quantitation of target C5 mRNA level is determined relative to standards generated from serially diluted total cellular RNA (300, 100, 30, 10 ng/rxn) and normalizing to, for example, HPRT1 mRNA in either parallel or same tube TaqMan reactions.

Western Blotting

Cellular protein extracts can be prepared using a standard micro preparation technique (for example using RIPA buffer). Cellular protein extracts are run on Tris-Glycine polyacrylamide gel and transferred onto membranes. Non-specific binding can be blocked by incubation, for example, with 5% non-fat milk for 1 hour followed by primary antibody for 16 hours at 4° C. Following washes, the secondary antibody is applied, for example (1:10,000 dilution) for 1 hour at room temperature and the signal detected on a VersaDoc imaging system In several cell culture systems, cationic lipids have been shown to enhance the bioavailability of oligonucleotides to cells in culture (Bennet, et al., 1992, Mol. Pharmacology, 41, 1023-1033). In one embodiment, dsRNA molecules of the invention are complexed with cationic lipids for cell culture experiments. dsRNA and cationic lipid mixtures are prepared in serum-free OptimMEM (InVitrogen) immediately prior to addition to the cells. OptiMEM is warmed to room temperature (about 20-25° C.) and cationic lipid is added to the final desired concentration. dsRNA molecules are added to OptiMEM to the desired concentration and the solution is added to the diluted dsRNA and incubated for 15 minutes at room temperature. In dose response experiments, the RNA complex is serially diluted into OptiMEM prior to addition of the cationic lipid.

Animal Models

The efficacy of anti-C5 dsRNA agents may be evaluated in an animal model. Animal models of PNH as are known in the art can be used for evaluation of the efficacy, potency, toxicity, etc. of anti-C5 dsRNAs. Exemplary animal models useful for assessment of anti-C5 dsRNAs include genetically engineered mouse models of PNH disease. Such animal models may also be used as source cells or tissue for assays of the compositions of the invention. Such models can additionally be used or adapted for use for pre-clinical evaluation of the efficacy of dsRNA compositions of the invention in modulating C5 gene expression toward therapeutic use.

Such models and/or wild-type mice can be used in evaluating the efficacy of dsRNA molecules of the invention to inhibit C5 levels, expression, development of C5-associated phenotypes, diseases or disorders, etc. These models, wild-type mice and/or other models can similarly be used to evaluate the safety/toxicity and efficacy of dsRNA molecules of the invention in a pre-clinical setting.

Specific examples of animal model systems useful for evaluation of the C5-targeting dsRNAs of the invention include wild-type mice and genetically engineered mice, e.g., $CHF^{-/-}$ mice and $PIG-a^{flox}$ mice, as described in Goicoechea de Jorge et al. (*J Am Soc Nephrol* 22: 137-145), Tarutani et al. (*Proc. Natl. Acad. Sci. USA* 94: 7400-7405), and Visconte et al. (*Haematologica* 95: 214-223). In an exemplary in vivo experiment, dsRNAs of the invention are tail vein injected into such mouse models at doses ranging from 0.1 to 1 to 10 mg/kg or, alternatively, repeated doses are administered at single-dose $IC_{50}$ levels, and organ samples (e.g., blood or bone marrow, but may also include prostate, kidney, lung, pancreas, colon, skin, spleen, liver, lymph nodes, mammary fat pad, etc.) are harvested 24 hours after administration of the final dose. Such organs are then evaluated for mouse and/or human C5 levels, depending upon the model used, and/or for impact upon PNH-related phenotypes. Duration of action can also be examined at, e.g., 1, 4, 7, 14, 21 or more days after final dsRNA administration.

The practice of the present invention employs, unless otherwise indicated, conventional techniques of chemistry, molecular biology, microbiology, recombinant DNA, genetics, immunology, cell biology, cell culture and transgenic biology, which are within the skill of the art. See, e.g., Maniatis et al., 1982, Molecular Cloning (Cold Spring Harbor Laboratory Press, Cold Spring Harbor, N.Y.); Sambrook et al., 1989, Molecular Cloning, 2nd Ed. (Cold Spring Harbor Laboratory Press, Cold Spring Harbor, N.Y.); Sambrook and Russell, 2001, Molecular Cloning, 3rd Ed. (Cold Spring Harbor Laboratory Press, Cold Spring Harbor, N.Y.); Ausubel et al., 1992), Current Protocols in Molecular Biology (John Wiley & Sons, including periodic updates); Glover, 1985, DNA Cloning (IRL Press, Oxford); Anand, 1992; Guthrie and Fink, 1991; Harlow and Lane, 1988, Antibodies, (Cold Spring Harbor Laboratory Press, Cold Spring Harbor, N.Y.); Jakoby and Pastan, 1979; Nucleic Acid Hybridization (B. D. Hames & S. J. Higgins eds. 1984); Transcription And Translation (B. D. Hames & S. J. Higgins eds. 1984); Culture Of Animal Cells (R. I. Freshney, Alan R. Liss, Inc., 1987); Immobilized Cells And Enzymes (IRL Press, 1986); B. Perbal, A Practical Guide To Molecular Cloning (1984); the treatise, Methods In Enzymology (Academic Press, Inc., N.Y.); Gene Transfer Vectors For Mammalian Cells (J. H. Miller and M. P. Calos eds., 1987, Cold Spring Harbor Laboratory); Methods In Enzymology, Vols. 154 and 155 (Wu et al. eds.), Immunochemical Methods In Cell And Molecular Biology (Mayer and Walker, eds., Academic Press, London, 1987); Handbook Of Experimental Immunology, Volumes I-IV (D. M. Weir and C. C. Blackwell, eds., 1986); Riott, Essential Immunology, 6th Edition, Blackwell Scientific Publications, Oxford, 1988; Hogan et al., Manipulating the Mouse Embryo, (Cold Spring Harbor Laboratory Press, Cold Spring Harbor, N.Y., 1986); Westerfield, M., The zebrafish book. A guide for the laboratory use of zebrafish (*Danio rerio*), (4th Ed., Univ. of Oregon Press, Eugene, 2000).

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

The present invention is described by reference to the following Examples, which are offered by way of illustration and are not intended to limit the invention in any manner. Standard techniques well known in the art or the techniques specifically described below were utilized.

Example 1: Preparation of Double-Stranded RNA Oligonucleotides

Oligonucleotide Synthesis and Purification

DsiRNA molecules were designed to interact with various sites in the RNA message, for example, target sequences within the RNA sequences described herein. In presently exemplified agents, 384 human target C5 sequences were selected for evaluation (a selection of the 384 human target C5 sites were predicted to be conserved with corresponding sites in the mouse Hc (corresponding to human C5) transcript sequence). The sequences of one strand of the DsiRNA molecules were complementary to the target C5 site sequences described above. The DsiRNA molecules were chemically synthesized using methods described herein. Generally, DsiRNA constructs were synthesized using solid phase oligonucleotide synthesis methods as described for 19-23mer siRNAs (see for example Usman et al., U.S. Pat. Nos. 5,804,683; 5,831,071; 5,998,203; 6,117, 657; 6,353,098; 6,362,323; 6,437,117; 6,469,158; Scaringe et al., U.S. Pat. Nos. 6,111,086; 6,008,400; 6,111,086).

Individual RNA strands were synthesized and HPLC purified according to standard methods (Integrated DNA Technologies, Coralville, Iowa). For example, RNA oligonucleotides were synthesized using solid phase phosphoramidite chemistry, deprotected and desalted on NAP-5 columns (Amersham Pharmacia Biotech, Piscataway, N.J.) using standard techniques (Damha and Olgivie, 1993, *Methods Mol Biol* 20: 81-114; Wincott et al., 1995, *Nucleic Acids Res* 23: 2677-84). The oligomers were purified using ion-exchange high performance liquid chromatography (IE-HPLC) on an Amersham Source 15Q column (1.0 cm×25 cm; Amersham Pharmacia Biotech, Piscataway, N.J.) using a 15 min step-linear gradient. The gradient varied from 90:10 Buffers A:B to 52:48 Buffers A:B, where Buffer A was 100 mM Tris pH 8.5 and Buffer B was 100 mM Tris pH 8.5, 1 M NaCl. Samples were monitored at 260 nm and peaks corresponding to the full-length oligonucleotide species were collected, pooled, desalted on NAP-5 columns, and lyophilized.

The purity of each oligomer was determined by capillary electrophoresis (CE) on a Beckman PACE 5000 (Beckman Coulter, Inc., Fullerton, Calif.). The CE capillaries had a 100

μm inner diameter and contained ssDNA 100R Gel (Beckman-Coulter). Typically, about 0.6 nmole of oligonucleotide was injected into a capillary, run in an electric field of 444 V/cm and detected by UV absorbance at 260 nm. Denaturing Tris-Borate-7 M-urea running buffer was purchased from Beckman-Coulter. Oligoribonucleotides were obtained that were at least 90% pure as assessed by CE for use in experiments described below. Compound identity was verified by matrix-assisted laser desorption ionization time-of-flight (MALDI-TOF) mass spectroscopy on a Voyager DE™ Biospectometry Work Station (Applied Biosystems, Foster City, Calif.) following the manufacturer's recommended protocol. Relative molecular masses of all oligomers were obtained, often within 0.2% of expected molecular mass.

Preparation of Duplexes

Single-stranded RNA (ssRNA) oligomers were resuspended, e.g., at 100 μM concentration in duplex buffer consisting of 100 mM potassium acetate, 30 mM HEPES, pH 7.5. Complementary sense and antisense strands were mixed in equal molar amounts to yield a final solution of, e.g., 50 μM duplex. Samples were heated to 100° C. for 5' in RNA buffer (IDT) and allowed to cool to room temperature before use. Double-stranded RNA (dsRNA) oligomers were stored at −20° C. Single-stranded RNA oligomers were stored lyophilized or in nuclease-free water at −80° C.

Nomenclature

For consistency, the following nomenclature has been employed in the instant specification. Names given to duplexes indicate the length of the oligomers and the presence or absence of overhangs. A "25/27" is an asymmetric duplex having a 25 base sense strand and a 27 base antisense strand with a 2-base 3'-overhang. A "27/25" is an asymmetric duplex having a 27 base sense strand and a 25 base antisense strand.

Cell culture and RNA Transfection

HepG2 cells were obtained and maintained in DMEM (HyClone) supplemented with 10% fetal bovine serum (HyClone) at 37° C. under 5% CO2. LMTK− cells were obtained and maintained in DMEM+15% FBS. For RNA transfections, cells were transfected with DsiRNAs at a final concentration of 1 nM or 0.1 nM using Lipofectamine™ RNAiMAX (Invitrogen) and following manufacturer's instructions. Briefly, for 0.1 nM transfections, e.g., of Example 3 below, an aliquot of stock solution of each DsiRNA was mixed with Opti-MEM I (Invitrogen) and Lipofectamine™ RNAiMAX to reach a volume of 175 μL (with 0.3 nM DsiRNA). The resulting 175 μL mix was incubated for 20 min at RT to allow DsiRNA:Lipofectamine™ RNAiMAX complexes to form. Meanwhile, target cells were trypsinized and resuspended in medium. At the end of the 20 min of complexation, 50 uL of the DsiRNA:RNAiMAX mixture was added per well into triplicate wells of 96 well plates. Finally, 100 μL of the cell suspension was added to each well (final volume 150 μL) and plates were placed into the incubator for 24 hours.

Assessment of C5 Inhibition

C5 target gene knockdown in human HepG2 cells and in mouse LMTK− cells was determined by qRT-PCR, with values normalized to HPRT and SFRS9 housekeeping genes in human HepG2 cells or to HPRT and RPL23 housekeeping genes in mouse LMTK− cells, and to transfections with control DsiRNAs and/or mock transfection controls.

RNA Isolation and Analysis

Media was aspirated, and total RNA was extracted using the SV96 kit (Promega). Total RNA was reverse-transcribed using SuperscriptII, Oligo dT, and random hexamers following manufacturer's instructions. Typically, the resulting cDNA was analyzed by qPCR using primers and probes specific for both the C5 gene and for the mouse genes HPRT-1 and RPL23. An ABI 7700 was used for the amplification reactions. Each sample was tested in triplicate. Relative C5 RNA levels were normalized to HPRT1 and RPL23 RNA levels and compared with RNA levels obtained in transfection control samples.

Example 2: DsiRNA Inhibition of C5

DsiRNA molecules targeting C5 were designed and synthesized as described above and tested in human HepG2 cells (alternatively, HeLa or other human cells could have been used) for inhibitory efficacy. For transfection, annealed DsiRNAs were mixed with the transfection reagent (Lipofectamine™ RNAiMAX, Invitrogen) and incubated for 20 minutes at room temperature. The HepG2 (human) or LMTK− (mouse) cells (alternatively, mouse AML12 or other mouse cells could have been used) were trypsinized, resuspended in media, and added to wells (100 uL per well) to give a final DsiRNA concentration of 1 nM in a volume of 150 μL Each DsiRNA transfection mixture was added to 3 wells for triplicate DsiRNA treatments. Cells were incubated at 37° C. for 24 hours in the continued presence of the DsiRNA transfection mixture. At 24 hours, RNA was prepared from each well of treated human or mouse cells. For such cells, the supernatants with the transfection mixtures were first removed and discarded, then the cells were lysed and RNA was prepared from each well. C5/Hc RNA levels post-treatment were evaluated by qRT-PCR for the C5 target gene, with values normalized to those obtained for controls. Triplicate data was averaged and the % error was determined for each treatment. Normalized data were both tabulated and graphed, and the reduction of target mRNA by active DsiRNAs in comparison to controls was determined (see Table 11 below and FIGS. 2A to 2J).

TABLE 11

C5 Inhibitory Efficacy of DsiRNAs Assayed at 1 nM in Human HepG2 and Mouse LMTK-Cells

| Duplex Name | Mm Location | Macaque* Location | Human-HepG2 Normalized HPRT/SFRS9; vs NC1, NC5, NC7 | | Mouse-LMTK- Normalized HPRT/Rpl23; vs NC1, NC5, NC7 | |
| --- | --- | --- | --- | --- | --- | --- |
| | | | Hs 1643-1764(FAM) Assay % Remaining | Hs 4318-4322 (HEX) Assay % Remaining | Mm 2253-2374 (FAM) Assay % Remaining | Mm 4717-4813 (HEX) Assay % Remaining |
| C5-120 | | 114 | 28.3 ± 5.8 | 27.8 ± 7.2 | | |
| C5-169 | | 163 | 50.2 ± 12.5 | 48.8 ± 12.4 | | |

TABLE 11-continued

C5 Inhibitory Efficacy of DsiRNAs Assayed
at 1 nM in Human HepG2 and Mouse LMTK-Cells

| | | | Human-HepG2 Normalized HPRT/SFRS9; vs NC1, NC5, NC7 | | Mouse-LMTK- Normalized HPRT/Rpl23; vs NC1, NC5, NC7 | |
|---|---|---|---|---|---|---|
| Duplex Name | Mm Location | Macaque* Location | Hs 1643-1764(FAM) Assay % Remaining | Hs 4318-4322 (HEX) Assay % Remaining | Mm 2253-2374 (FAM) Assay % Remaining | Mm 4717-4813 (HEX) Assay % Remaining |
| C5-170 | | 164 | 42.5 ± 7.5 | 36.1 ± 6.4 | | |
| C5-171 | | 165 | 29.0 ± 9.3 | 25.3 ± 12.6 | | |
| C5-172 | | 166 | 30.9 ± 20.1 | 27.7 ± 21.7 | | |
| C5-173 | | 167 | 28.2 ± 11.5 | 25.6 ± 11.8 | | |
| C5-174 | | 168 | 50.0 ± 10.3 | 48.8 ± 12.6 | | |
| C5-175 | | 169 | 56.9 ± 8.1 | 53.2 ± 8.0 | | |
| C5-176 | | 170 | 38.8 ± 5.5 | 37.2 ± 6.5 | | |
| C5-177 | | 171 | 55.6 ± 10.3 | 51.7 ± 10.3 | | |
| C5-178 | | 172 | 35.5 ± 14.6 | 31.9 ± 14.9 | | |
| C5-179 | | 173 | 36.0 ± 9.2 | 33.4 ± 7.6 | | |
| C5-180 | | 174 | 31.3 ± 10.0 | 30.0 ± 8.5 | | |
| C5-182 | | 176 | 39.2 ± 11.2 | 37.4 ± 15.0 | | |
| C5-183 | | 177 | 42.0 ± 2.8 | 40.1 ± 6.4 | | |
| C5-185 | | 179 | 32.4 ± 11.9 | 28.8 ± 11.8 | | |
| C5-187 | | 181 | 34.9 ± 9.4 | 35.1 ± 9.9 | | |
| C5-188 | | 182 | 32.1 ± 4.1 | 32.5 ± 6.7 | | |
| C5-189 | | 183 | 27.2 ± 4.8 | 25.8 ± 6.4 | | |
| C5-190 | 218 | 184 | 41.1 ± 4.8 | 38.5 ± 6.2 | 31.6 ± 2.4 | 31.0 ± 9.6 |
| C5-191 | 219 | 185 | 51.8 ± 16.0 | 47.0 ± 17.3 | 42.8 ± 2.8 | 35.5 ± 2.7 |
| C5-192 | 220 | 186 | 28.7 ± 3.6 | 27.0 ± 5.2 | 20.1 ± 2.9 | 17.7 ± 3.4 |
| C5-193 | 221 | 187 | 35.4 ± 11.6 | 32.1 ± 6.5 | 29.7 ± 10.7 | 22.8 ± 10.3 |
| C5-194 | 222 | 188 | 25.2 ± 20.5 | 24.4 ± 16.0 | 35.3 ± 11.2 | 24.1 ± 12.2 |
| C5-196 | | 190 | 50.3 ± 3.3 | 48.3 ± 4.9 | | |
| C5-198 | | 192 | 27.8 ± 15.3 | 25.4 ± 13.5 | | |
| C5-200 | | 194 | 37.2 ± 18.9 | 34.0 ± 14.6 | | |
| C5-204 | | 198 | 35.2 ± 6.7 | 35.5 ± 8.3 | | |
| C5-205 | | 199 | 36.9 ± 9.7 | 37.8 ± 8.2 | | |
| C5-206 | | 200 | 64.8 ± N/A | 70.8 ± N/A | | |
| C5-207 | | 201 | 30.3 ± 15.3 | 35.7 ± 15.0 | | |
| C5-211 | | 205 | 48.9 ± 28.9 | 38.8 ± 17.2 | | |
| C5-212 | | 206 | 58.9 ± 42.6 | 55.8 ± 45.6 | | |
| C5-218 | | 212 | 69.5 ± 17.9 | 52.9 ± 12.4 | | |
| C5-220 | | 214 | 64.5 ± 19.3 | 49.5 ± 22.7 | | |
| C5-223 | | 217 | 70.2 ± 20.2 | 57.2 ± 10.3 | | |
| C5-224 | | 218 | 78.4 ± 19.8 | 75.0 ± 22.3 | | |
| C5-227 | | 221 | 33.6 ± 30.6 | 36.0 ± 25.2 | | |
| C5-228 | | 222 | 41.1 ± 19.6 | 40.3 ± 10.1 | | |
| C5-265 | | 259 | 64.9 ± 11.6 | 48.9 ± 6.9 | | |
| C5-266 | | 260 | 56.8 ± 5.3 | 43.9 ± 4.6 | | |
| C5-360 | | 354 | 82.0 ± 8.8 | 61.8 ± 12.6 | | |
| C5-361 | | 355 | 42.6 ± 16.5 | 30.7 ± 17.3 | | |
| C5-364 | | 358 | 117.7 ± 16.0 | 81.8 ± 11.3 | | |
| C5-365 | | 359 | 89.4 ± 27.8 | 86.9 ± 27.7 | | |
| C5-366 | | 360 | 16.5 ± 28.7 | 15.6 ± 24.4 | | |
| C5-367 | | 361 | 47.1 ± 17.7 | 52.4 ± 27.0 | | |
| C5-368 | | 362 | 51.2 ± 4.1 | 39.2 ± 4.7 | | |
| C5-369 | | 363 | 41.6 ± 11.4 | 28.5 ± 10.3 | | |
| C5-370 | | 364 | 98.7 ± 5.8 | 69.2 ± 4.2 | | |
| C5-371 | | 365 | 68.9 ± 23.2 | 46.0 ± 22.0 | | |
| C5-372 | | 366 | 37.9 ± 4.8 | 29.8 ± 3.7 | | |
| C5-373 | | 367 | 101.5 ± 19.4 | 104.3 ± 18.2 | | |
| C5-408 | | 402 | 35.7 ± 16.1 | 36.9 ± 4.9 | | |
| C5-414 | | 408 | 28.2 ± 16.1 | 27.8 ± 19.4 | | |
| C5-418 | | 412 | 18.0 ± 2.9 | 21.4 ± 23.7 | | |
| C5-419 | | 413 | 14.3 ± 1.9 | 15.8 ± 25.7 | | |
| C5-420 | | 414 | 23.9 ± 9.7 | 25.5 ± 12.6 | | |
| C5-422 | | 416 | 24.1 ± 4.5 | 26.5 ± 10.5 | | |
| C5-423 | | 417 | 27.4 ± 18.9 | 29.5 ± 29.6 | | |
| C5-425 | | 419 | 35.0 ± 13.2 | 36.2 ± 12.8 | | |
| C5-436 | | 430 | 28.9 ± 12.3 | 30.3 ± 6.2 | | |
| C5-438 | | 432 | 29.2 ± 16.2 | 31.2 ± 20.0 | | |
| C5-439 | 467 | 433 | 19.4 ± 5.4 | 18.9 ± 5.5 | 24.7 ± 10.1 | 20.7 ± 7.1 |
| C5-440 | 468 | 434 | 46.6 ± 8.0 | 48.1 ± 8.3 | 25.9 ± 5.8 | 23.1 ± 9.6 |
| C5-481 | | 475 | 54.3 ± 8.2 | 55.6 ± 3.5 | | |
| C5-501 | 529 | | 65.0 ± 3.2 | 61.4 ± 5.0 | 52.3 ± 3.0 | 48.5 ± 6.2 |
| C5-502 | 530 | | 81.2 ± 4.3 | 73.3 ± 6.1 | 82.8 ± 6.0 | 72.5 ± 7.0 |
| C5-503 | 531 | | 28.8 ± 4.9 | 27.4 ± 1.8 | 49.4 ± 14.3 | 49.7 ± 10.6 |

TABLE 11-continued

C5 Inhibitory Efficacy of DsiRNAs Assayed
at 1 nM in Human HepG2 and Mouse LMTK-Cells

| | | | Human-HepG2 Normalized HPRT/SFRS9; vs NC1, NC5, NC7 | | Mouse-LMTK- Normalized HPRT/Rpl23; vs NC1, NC5, NC7 | |
|---|---|---|---|---|---|---|
| Duplex Name | Mm Location | Macaque* Location | Hs 1643-1764(FAM) Assay % Remaining | Hs 4318-4322 (HEX) Assay % Remaining | Mm 2253-2374 (FAM) Assay % Remaining | Mm 4717-4813 (HEX) Assay % Remaining |
| C5-504 | 532 | | 38.6 ± 25.7 | 37.0 ± 26.1 | 45.7 ± 12.8 | 37.9 ± 10.1 |
| C5-525 | | 519 | 23.5 ± 6.8 | 21.3 ± 4.5 | | |
| C5-529 | 557 | 523 | 34.9 ± 5.4 | 34.3 ± 8.8 | 34.0 ± 6.7 | 27.7 ± 4.5 |
| C5-530 | 558 | 524 | 32.6 ± 25.1 | 32.5 ± 24.8 | 24.4 ± 11.2 | 22.5 ± 8.8 |
| C5-553 | 581 | | 44.6 ± 3.8 | 44.1 ± 3.6 | 38.3 ± 7.3 | 37.3 ± 3.9 |
| C5-554 | 582 | | 55.4 ± 36.4 | 50.7 ± 33.8 | 35.9 ± 11.6 | 33.5 ± 3.8 |
| C5-568 | | 562 | 44.1 ± 22.5 | 45.0 ± 3.6 | | |
| C5-569 | | 563 | 33.6 ± 2.2 | 32.8 ± 5.7 | | |
| C5-573 | | 567 | 56.0 ± 11.9 | 53.7 ± 14.1 | | |
| C5-574 | | 568 | 40.4 ± 7.2 | 43.0 ± 10.0 | | |
| C5-578 | | 572 | 26.0 ± 6.2 | 27.8 ± 14.4 | | |
| C5-579 | | 573 | 25.5 ± 7.8 | 23.9 ± 7.6 | | |
| C5-595 | 623 | 589 | 25.8 ± 11.0 | 24.1 ± 14.3 | 23.9 ± 9.6 | 23.5 ± 5.5 |
| C5-596 | 624 | 590 | 22.0 ± 4.1 | 21.7 ± 4.2 | 24.7 ± 7.0 | 19.3 ± 12.1 |
| C5-597 | 625 | 591 | 52.8 ± 10.7 | 48.5 ± 6.7 | 34.1 ± 1.6 | 27.7 ± 1.4 |
| C5-598 | 626 | 592 | 18.0 ± 11.3 | 20.3 ± 6.5 | 24.3 ± 9.2 | 25.2 ± 15.8 |
| C5-599 | 627 | 593 | 40.7 ± 11.6 | 41.3 ± 11.7 | 32.3 ± 3.5 | 27.4 ± 6.8 |
| C5-600 | 628 | 594 | 43.2 ± 15.5 | 39.2 ± 15.0 | 280.9 ± 44.1 | 58.7 ± 3.5 |
| C5-601 | 629 | 595 | 16.9 ± 5.8 | 16.3 ± 12.5 | 29.8 ± 6.6 | 20.2 ± 4.9 |
| C5-602 | 630 | 596 | 35.4 ± 18.8 | 34.5 ± 18.7 | 27.7 ± 4.5 | 23.5 ± 8.2 |
| C5-603 | 631 | 597 | 39.8 ± 7.0 | 43.9 ± 7.5 | 49.8 ± 7.3 | 40.1 ± 3.5 |
| C5-604 | 632 | 598 | 16.8 ± 6.1 | 18.9 ± 6.1 | 35.3 ± 2.8 | 23.6 ± 5.4 |
| C5-605 | 633 | 599 | 55.4 ± 12.7 | 57.1 ± 13.7 | 36.2 ± 2.4 | 28.5 ± 1.8 |
| C5-606 | 634 | 600 | 30.8 ± 22.8 | 30.1 ± 24.5 | 29.1 ± 7.9 | 28.2 ± 6.3 |
| C5-607 | 635 | 601 | 25.9 ± 17.7 | 26.6 ± 12.0 | 36.1 ± 12.7 | 28.2 ± 10.5 |
| C5-608 | 636 | 602 | 90.1 ± 1.6 | 84.0 ± 4.9 | 87.7 ± 9.5 | 56.8 ± 7.8 |
| C5-710 | 738 | 704 | 22.6 ± 7.2 | 19.7 ± 6.0 | 23.6 ± 3.3 | 20.3 ± 3.9 |
| C5-711 | 739 | 705 | 39.9 ± 12.3 | 37.1 ± 14.7 | 34.9 ± 9.3 | 33.8 ± 5.1 |
| C5-712 | 740 | 706 | 20.6 ± 32.2 | 20.8 ± 31.7 | 30.0 ± 9.6 | 25.1 ± 1.7 |
| C5-775 | | 769 | 34.7 ± 25.8 | 37.4 ± 28.5 | | |
| C5-776 | | 770 | 27.8 ± 9.8 | 27.1 ± 8.8 | | |
| C5-780 | | 774 | 56.4 ± 7.1 | 55.0 ± 5.1 | | |
| C5-786 | | 780 | 48.5 ± 4.3 | 49.8 ± 3.4 | | |
| C5-787 | | 781 | 33.4 ± 20.7 | 34.0 ± 24.1 | | |
| C5-788 | | 782 | 23.3 ± 11.3 | 21.5 ± 5.4 | | |
| C5-791 | | 785 | 82.1 ± 19.7 | 83.8 ± 18.9 | | |
| C5-792 | | 786 | 37.6 ± 13.2 | 36.3 ± 11.2 | | |
| C5-793 | | 787 | 69.3 ± 9.0 | 63.6 ± 8.8 | | |
| C5-805 | 833 | 799 | 48.4 ± 6.0 | 45.2 ± 7.6 | 47.2 ± 2.1 | 42.2 ± 5.0 |
| C5-806 | 834 | 800 | 68.2 ± 8.3 | 63.9 ± 7.1 | 44.0 ± 4.3 | 37.8 ± 3.6 |
| C5-807 | 835 | 801 | 17.6 ± 9.0 | 17.2 ± 6.4 | 24.3 ± 15.3 | 18.7 ± 12.0 |
| C5-808 | 836 | 802 | 42.3 ± 5.3 | 40.2 ± 4.8 | 39.4 ± 3.0 | 33.0 ± 4.4 |
| C5-809 | 837 | 803 | 17.0 ± 16.4 | 16.9 ± 12.5 | 47.3 ± 11.6 | 28.9 ± 4.5 |
| C5-810 | 838 | 804 | 34.5 ± 5.7 | 30.2 ± 11.6 | 25.7 ± 11.4 | 22.8 ± 4.5 |
| C5-811 | 839 | 805 | 46.2 ± 5.6 | 44.8 ± 5.3 | 31.3 ± 7.3 | 34.6 ± 7.0 |
| C5-812 | 840 | 806 | 60.0 ± 27.5 | 64.0 ± 19.9 | 79.7 ± 6.3 | 69.4 ± 5.8 |
| C5-923 | | 917 | 40.0 ± 26.8 | 37.0 ± 23.6 | | |
| C5-924 | | 918 | 90.6 ± 7.5 | 82.8 ± 7.6 | | |
| C5-926 | | 920 | 40.8 ± 11.7 | 36.9 ± 8.4 | | |
| C5-927 | | 921 | 80.6 ± 18.1 | 72.8 ± 14.2 | | |
| C5-928 | | 922 | 39.6 ± 11.5 | 37.3 ± 11.7 | | |
| C5-931 | | 925 | 34.6 ± 4.1 | 32.9 ± 2.5 | | |
| C5-935 | | 929 | 31.8 ± 4.7 | 30.2 ± 4.7 | | |
| C5-944 | | 938 | 45.4 ± 4.1 | 38.9 ± 4.9 | | |
| C5-946 | | 940 | 37.6 ± 10.9 | 35.1 ± 9.8 | | |
| C5-947 | | 941 | 34.6 ± 3.9 | 32.6 ± 5.0 | | |
| C5-948 | | 942 | 46.0 ± 6.0 | 43.0 ± 8.0 | | |
| C5-953 | | 947 | 44.4 ± 18.8 | 39.6 ± 22.5 | | |
| C5-955 | 983 | 949 | 20.1 ± 11.1 | 18.7 ± 11.3 | 31.7 ± 7.8 | 28.8 ± 3.1 |
| C5-956 | 984 | 950 | 104.6 ± 9.0 | 98.5 ± 5.4 | 52.5 ± 4.5 | 42.0 ± 2.8 |
| C5-968 | | 962 | 53.7 ± 19.2 | 52.9 ± 19.0 | | |
| C5-970 | | 964 | 31.4 ± 5.3 | 36.2 ± 19.9 | | |
| C5-973 | | 967 | 32.0 ± 7.3 | 32.5 ± 6.1 | | |
| C5-977 | | 971 | 27.1 ± 4.1 | 26.1 ± 3.1 | | |
| C5-978 | | 972 | 45.4 ± 4.6 | 44.3 ± 7.3 | | |
| C5-980 | | 974 | 51.5 ± 6.3 | 48.0 ± 6.6 | | |
| C5-1006 | 1034 | 1000 | 29.8 ± 19.7 | 25.2 ± 20.3 | 33.7 ± 11.0 | 30.3 ± 10.6 |

TABLE 11-continued

C5 Inhibitory Efficacy of DsiRNAs Assayed
at 1 nM in Human HepG2 and Mouse LMTK-Cells

| Duplex Name | Mm Location | Macaque* Location | Human-HepG2 Normalized HPRT/SFRS9; vs NC1, NC5, NC7 | | Mouse-LMTK- Normalized HPRT/Rpl23; vs NC1, NC5, NC7 | |
|---|---|---|---|---|---|---|
| | | | Hs 1643-1764(FAM) Assay % Remaining | Hs 4318-4322 (HEX) Assay % Remaining | Mm 2253-2374 (FAM) Assay % Remaining | Mm 4717-4813 (HEX) Assay % Remaining |
| C5-1007 | 1035 | 1001 | 54.1 ± 7.9 | 50.3 ± 4.2 | 37.3 ± 22.9 | 32.9 ± 12.6 |
| C5-1008 | 1036 | 1002 | 28.3 ± 11.0 | 31.7 ± 5.3 | 35.2 ± 9.1 | 28.6 ± 10.7 |
| C5-1009 | 1037 | 1003 | 31.4 ± 13.4 | 29.2 ± 12.0 | 30.7 ± 14.7 | 27.0 ± 7.4 |
| C5-1010 | 1038 | 1004 | 36.7 ± 7.7 | 32.2 ± 7.7 | 43.9 ± 10.4 | 37.0 ± 12.4 |
| C5-1011 | 1039 | 1005 | 37.8 ± 14.3 | 34.4 ± 11.1 | 40.9 ± 16.8 | 30.2 ± 16.9 |
| C5-1012 | 1040 | 1006 | 58.6 ± 10.0 | 52.2 ± 10.8 | 38.5 ± 8.5 | 33.4 ± 11.4 |
| C5-1013 | 1041 | 1007 | 34.9 ± 10.1 | 31.9 ± 10.4 | 39.9 ± 11.8 | 39.1 ± 8.7 |
| C5-1014 | | 1008 | 59.3 ± 7.5 | 56.6 ± 8.1 | | |
| C5-1015 | | 1009 | 46.3 ± 1.9 | 43.8 ± 1.7 | | |
| C5-1016 | | 1010 | 62.0 ± 16.5 | 63.1 ± 13.6 | | |
| C5-1017 | | 1011 | 82.3 ± 4.4 | 78.0 ± 4.2 | | |
| C5-1019 | | 1013 | 55.2 ± 8.6 | 48.7 ± 2.5 | | |
| C5-1088 | 1116 | 1082 | 85.8 ± 2.8 | 81.3 ± 1.6 | 71.3 ± 5.1 | 65.8 ± 2.2 |
| C5-1105 | | 1099 | 56.5 ± 8.6 | 48.7 ± 12.6 | | |
| C5-1109 | | 1103 | 53.6 ± 6.6 | 46.9 ± 11.4 | | |
| C5-1110 | | 1104 | 28.5 ± 4.0 | 23.6 ± 3.6 | | |
| C5-1222 | | 1216 | 42.5 ± 8.9 | 37.9 ± 10.4 | | |
| C5-1223 | | 1217 | 36.3 ± 11.4 | 30.0 ± 14.5 | | |
| C5-1249 | 1277 | 1243 | 36.0 ± 5.5 | 34.1 ± 0.8 | 35.7 ± 1.3 | 32.7 ± 7.9 |
| C5-1250 | 1278 | 1244 | 15.3 ± 4.5 | 16.1 ± 2.6 | 35.1 ± 4.2 | 36.3 ± 4.0 |
| C5-1405 | | 1399 | 54.1 ± 21.8 | 48.7 ± 22.4 | | |
| C5-1433 | | 1427 | 27.8 ± 4.7 | 26.6 ± 3.4 | | |
| C5-1434 | | 1428 | 51.6 ± 12.0 | 49.7 ± 14.0 | | |
| C5-1435 | | 1429 | 47.6 ± 6.9 | 46.3 ± 5.5 | | |
| C5-1436 | | 1430 | 50.9 ± 2.0 | 51.0 ± 1.2 | | |
| C5-1519 | | 1513 | 53.9 ± 8.0 | 50.3 ± 14.3 | | |
| C5-1523 | | 1517 | 60.5 ± 4.2 | 60.9 ± 2.8 | | |
| C5-1524 | | 1518 | 45.1 ± 11.8 | 41.1 ± 12.0 | | |
| C5-1526 | | 1520 | 58.3 ± 3.1 | 48.9 ± 2.9 | | |
| C5-1527 | | 1521 | 29.6 ± 12.7 | 27.6 ± 10.0 | | |
| C5-1528 | | 1522 | 49.0 ± 14.5 | 50.6 ± 16.9 | | |
| C5-1531 | | 1525 | 42.5 ± 2.1 | 39.7 ± 2.4 | | |
| C5-1533 | | 1527 | 55.1 ± 6.1 | 54.1 ± 8.1 | | |
| C5-1534 | 1562 | 1528 | 33.8 ± 7.0 | 31.9 ± 6.8 | 32.8 ± 7.3 | 33.7 ± 3.6 |
| C5-1535 | 1563 | 1529 | 28.6 ± 6.0 | 27.0 ± 6.5 | 28.5 ± 7.6 | 32.3 ± 7.5 |
| C5-1536 | 1564 | 1530 | 28.5 ± 13.1 | 26.3 ± 10.8 | 30.6 ± 6.9 | 30.5 ± 2.3 |
| C5-1537 | 1565 | 1531 | 23.6 ± 9.4 | 21.6 ± 10.9 | 29.4 ± 7.5 | 27.7 ± 8.7 |
| C5-1538 | 1566 | 1532 | 32.1 ± 13.6 | 27.3 ± 10.6 | 32.5 ± 9.8 | 30.3 ± 9.7 |
| C5-1539 | 1567 | 1533 | 23.4 ± 12.9 | 21.9 ± 5.5 | 34.3 ± 6.6 | 35.2 ± 9.3 |
| C5-1540 | 1568 | 1534 | 24.0 ± 7.0 | 23.9 ± 6.1 | 27.2 ± 9.9 | 24.3 ± 3.8 |
| C5-1541 | 1569 | 1535 | 35.3 ± 7.6 | 37.5 ± 5.8 | 30.5 ± 15.7 | 26.8 ± 13.2 |
| C5-1542 | 1570 | 1536 | 78.9 ± 3.7 | 72.4 ± 4.2 | 41.6 ± 11.3 | 44.2 ± 5.6 |
| C5-1543 | 1571 | 1537 | 63.1 ± 6.1 | 56.4 ± 6.1 | 35.0 ± 4.2 | 36.9 ± 7.9 |
| C5-1544 | 1572 | 1538 | 24.7 ± 25.9 | 26.2 ± 26.5 | 23.6 ± 11.8 | 24.5 ± 18.1 |
| C5-1545 | 1573 | 1539 | 26.2 ± 7.9 | 25.6 ± 6.3 | 23.4 ± 1.5 | 23.8 ± 6.4 |
| C5-1546 | 1574 | 1540 | 32.5 ± 12.6 | 29.9 ± 16.2 | 30.5 ± 7.2 | 24.4 ± 5.1 |
| C5-1547 | 1575 | 1541 | 50.7 ± 12.5 | 55.3 ± 12.1 | 37.6 ± 3.6 | 30.6 ± 9.1 |
| C5-1548 | 1576 | 1542 | 18.5 ± 15.7 | 20.9 ± 7.4 | 35.4 ± 14.4 | 33.6 ± 5.6 |
| C5-1549 | 1577 | 1543 | 38.6 ± 9.7 | 40.3 ± 6.5 | 40.3 ± 14.3 | 37.5 ± 12.3 |
| C5-1550 | 1578 | 1544 | 91.4 ± 7.9 | 78.8 ± 8.5 | 48.0 ± 6.9 | 47.5 ± 9.8 |
| C5-1551 | 1579 | 1545 | 91.3 ± 5.6 | 80.4 ± 5.7 | 43.6 ± 12.0 | 38.9 ± 9.3 |
| C5-1552 | 1580 | 1546 | 44.1 ± 9.0 | 37.1 ± 9.1 | 30.9 ± 13.3 | 24.8 ± 10.4 |
| C5-1553 | 1581 | 1547 | 47.0 ± 17.9 | 41.1 ± 13.2 | 37.9 ± 18.4 | 32.3 ± 10.9 |
| C5-1719 | | 1713 | 41.3 ± 6.8 | 41.2 ± 9.0 | | |
| C5-1721 | | 1715 | 47.6 ± 14.8 | 46.3 ± 9.8 | | |
| C5-1722 | | 1716 | 31.4 ± 12.1 | 29.5 ± 14.3 | | |
| C5-1723 | | 1717 | 45.3 ± 10.2 | 41.7 ± 10.2 | | |
| C5-1724 | | 1718 | 36.5 ± 14.7 | 41.5 ± 11.7 | | |
| C5-1726 | | 1720 | 26.6 ± 4.3 | 29.0 ± 3.4 | | |
| C5-1727 | | 1721 | 44.8 ± 3.5 | 42.1 ± 7.2 | | |
| C5-1728 | | 1722 | 60.1 ± N/A | 58.7 ± N/A | | |
| C5-1729 | | 1723 | 57.7 ± 9.0 | 62.9 ± 12.8 | | |
| C5-1730 | | 1724 | 26.1 ± 2.4 | 26.6 ± 6.6 | | |
| C5-1731 | | 1725 | 35.2 ± 15.2 | 32.9 ± 18.3 | | |
| C5-1732 | | 1726 | 32.5 ± 14.3 | 39.0 ± 12.8 | | |
| C5-1733 | | 1727 | 34.9 ± 10.7 | 36.4 ± 6.8 | | |
| C5-1753 | 1781 | 1747 | 49.8 ± 17.4 | 46.9 ± 12.7 | 40.1 ± 16.7 | 32.8 ± 6.6 |

TABLE 11-continued

C5 Inhibitory Efficacy of DsiRNAs Assayed
at 1 nM in Human HepG2 and Mouse LMTK-Cells

| Duplex Name | Mm Location | Macaque* Location | Human-HepG2 Normalized HPRT/SFRS9; vs NC1, NC5, NC7 | | Mouse-LMTK- Normalized HPRT/Rpl23; vs NC1, NC5, NC7 | |
|---|---|---|---|---|---|---|
| | | | Hs 1643-1764(FAM) Assay % Remaining | Hs 4318-4322 (HEX) Assay % Remaining | Mm 2253-2374 (FAM) Assay % Remaining | Mm 4717-4813 (HEX) Assay % Remaining |
| C5-1754 | 1782 | 1748 | 91.0 ± 5.0 | 96.1 ± 5.1 | 72.8 ± 7.6 | 72.9 ± 1.2 |
| C5-1948 | 1979 | 1942 | 113.5 ± 4.8 | 103.5 ± 4.1 | 92.4 ± 3.6 | 96.2 ± 3.4 |
| C5-1949 | 1980 | 1943 | 99.5 ± 5.5 | 90.7 ± 6.5 | 63.9 ± 8.2 | 68.5 ± 7.9 |
| C5-1950 | 1981 | 1944 | 130.4 ± 4.6 | 107.7 ± 6.3 | 86.1 ± 4.7 | 92.6 ± 3.7 |
| C5-1951 | 1982 | 1945 | 133.4 ± 4.0 | 109.1 ± 2.7 | 75.0 ± 7.3 | 81.5 ± 3.8 |
| C5-1952 | 1983 | 1946 | 149.5 ± 4.5 | 121.9 ± 4.1 | 83.7 ± 8.0 | 86.6 ± 11.5 |
| C5-1953 | 1984 | 1947 | 123.3 ± 4.9 | 102.8 ± 4.9 | 89.4 ± 1.5 | 94.4 ± 3.5 |
| C5-1954 | 1985 | 1948 | 107.1 ± 7.4 | 93.7 ± 5.9 | 48.4 ± 6.1 | 45.2 ± 6.4 |
| C5-2043 | | 2037 | 19.6 ± 9.8 | 21.8 ± 19.3 | | |
| C5-2048 | | 2042 | 21.5 ± 5.8 | 22.0 ± 2.8 | | |
| C5-2050 | | 2044 | 65.0 ± 3.4 | 65.4 ± 6.0 | | |
| C5-2051 | | 2045 | 25.9 ± 16.7 | 30.2 ± 10.4 | | |
| C5-2057 | 2088 | | 43.3 ± 17.9 | 39.4 ± 18.6 | 45.8 ± 9.7 | 40.2 ± 4.5 |
| C5-2058 | 2089 | | 94.8 ± 2.0 | 82.3 ± 2.0 | 75.7 ± 7.7 | 67.7 ± 12.4 |
| C5-2133 | | 2127 | 26.1 ± 16.1 | 27.1 ± 15.1 | | |
| C5-2134 | | 2128 | 27.4 ± 14.0 | 26.3 ± 12.7 | | |
| C5-2316 | | 2310 | 51.3 ± 6.4 | 49.8 ± 4.3 | | |
| C5-2337 | | 2331 | 32.3 ± 7.7 | 31.7 ± 6.7 | | |
| C5-2498 | 2538 | | 38.7 ± 12.9 | 37.6 ± 10.1 | 49.9 ± 6.7 | 50.0 ± 5.0 |
| C5-2499 | 2539 | | 43.8 ± 9.6 | 42.9 ± 9.8 | 36.1 ± 4.6 | 36.5 ± 2.5 |
| C5-2500 | 2540 | 2494 | 14.9 ± 7.9 | 14.2 ± 11.7 | 25.6 ± 22.8 | 25.4 ± 15.0 |
| C5-2501 | 2541 | 2495 | 30.2 ± 7.1 | 27.7 ± 6.4 | 26.6 ± 8.2 | 28.2 ± 8.4 |
| C5-2518 | | 2512 | 30.7 ± 9.4 | 32.2 ± 7.9 | | |
| C5-2527 | | 2521 | 39.0 ± 10.6 | 36.9 ± 11.6 | | |
| C5-2528 | | 2522 | 33.1 ± 2.8 | 34.5 ± 3.3 | | |
| C5-2529 | | 2523 | 35.6 ± 9.2 | 36.5 ± 6.6 | | |
| C5-2530 | | 2524 | 44.2 ± 12.1 | 43.2 ± 17.0 | | |
| C5-2531 | | 2525 | 61.6 ± 10.5 | 61.5 ± 9.8 | | |
| C5-2532 | | 2526 | 44.4 ± 14.5 | 49.6 ± 15.8 | | |
| C5-2533 | | 2527 | 40.9 ± 3.7 | 34.3 ± 2.0 | | |
| C5-2534 | | 2528 | 50.9 ± 12.3 | 40.0 ± 7.6 | | |
| C5-2535 | | 2529 | 73.2 ± 5.7 | 61.5 ± 2.3 | | |
| C5-2536 | | 2530 | 62.7 ± 2.3 | 53.7 ± 5.7 | | |
| C5-2537 | | 2531 | 36.4 ± 6.7 | 25.4 ± 5.2 | | |
| C5-2557 | 2597 | | 25.6 ± 24.3 | 24.6 ± 31.2 | 25.4 ± 16.3 | 28.9 ± 5.2 |
| C5-2558 | 2598 | | 68.6 ± 6.7 | 66.5 ± 9.7 | 54.5 ± 8.8 | 71.0 ± 12.4 |
| C5-2559 | 2599 | | 27.8 ± 3.5 | 24.2 ± 6.3 | 28.6 ± 3.3 | 29.5 ± 11.6 |
| C5-2560 | 2600 | | 37.3 ± 11.9 | 32.4 ± 13.3 | 40.0 ± 8.9 | 45.0 ± 3.8 |
| C5-2561 | 2601 | | 34.6 ± 36.3 | 32.8 ± 36.7 | 28.7 ± 5.7 | 30.0 ± 7.7 |
| C5-2562 | 2602 | | 35.6 ± 5.6 | 32.3 ± 3.7 | 41.1 ± 10.0 | 37.3 ± 8.0 |
| C5-2563 | 2603 | | 64.0 ± 9.2 | 65.5 ± 8.4 | 46.3 ± 2.3 | 47.2 ± 3.7 |
| C5-2564 | 2604 | | 88.8 ± 3.3 | 79.2 ± 5.3 | 57.9 ± 2.2 | 59.1 ± 4.7 |
| C5-2565 | 2605 | | 35.8 ± 16.3 | 37.7 ± 14.7 | 27.0 ± 6.5 | 31.2 ± 7.1 |
| C5-2566 | 2606 | | 28.3 ± 8.5 | 26.5 ± 6.2 | 29.6 ± 6.7 | 30.6 ± 7.2 |
| C5-2567 | 2607 | | 27.0 ± 7.3 | 23.7 ± 5.1 | 28.9 ± 6.4 | 31.3 ± 5.7 |
| C5-2568 | 2608 | | 49.2 ± 6.3 | 51.2 ± 7.5 | 45.4 ± 4.2 | 50.8 ± 4.8 |
| C5-2569 | 2609 | | 70.9 ± 3.9 | 69.2 ± 4.1 | 40.6 ± 14.2 | 36.9 ± 6.0 |
| C5-2570 | 2610 | | 32.7 ± 4.8 | 29.7 ± 4.0 | 43.5 ± 3.2 | 36.1 ± 3.9 |
| C5-2571 | 2611 | | 58.0 ± 7.0 | 56.9 ± 4.9 | 57.8 ± 4.7 | 58.3 ± 4.1 |
| C5-2572 | 2612 | | 31.4 ± 3.0 | 26.6 ± 3.5 | 42.0 ± 5.6 | 35.2 ± 9.9 |
| C5-2573 | 2613 | | 74.6 ± 2.4 | 68.2 ± 6.3 | 36.6 ± 4.7 | 33.3 ± 5.0 |
| C5-2574 | 2614 | | 40.8 ± 8.5 | 38.1 ± 6.7 | 27.2 ± 9.3 | 22.5 ± 13.1 |
| C5-2575 | 2615 | 2569 | 30.4 ± 3.4 | 29.5 ± 5.2 | 21.0 ± 5.8 | 19.5 ± 2.8 |
| C5-2576 | 2616 | 2570 | 64.2 ± 9.0 | 54.9 ± 6.4 | 35.3 ± 5.8 | 32.9 ± 6.7 |
| C5-2577 | 2617 | 2571 | 40.0 ± 17.6 | 33.4 ± 17.3 | 22.8 ± 8.2 | 24.4 ± 6.3 |
| C5-2578 | 2618 | 2572 | 30.7 ± 7.4 | 28.6 ± 3.0 | 19.5 ± 6.5 | 19.0 ± 5.0 |
| C5-2579 | 2619 | 2573 | 34.9 ± 19.2 | 29.1 ± 19.7 | 24.2 ± 13.4 | 23.3 ± 4.3 |
| C5-2580 | 2620 | 2574 | 35.0 ± 7.1 | 29.8 ± 4.0 | 23.8 ± 12.4 | 19.5 ± 5.2 |
| C5-2581 | 2621 | 2575 | 36.7 ± 12.6 | 36.7 ± 15.7 | 33.4 ± 5.7 | 32.7 ± 9.0 |
| C5-2623 | 2663 | 2617 | 69.6 ± 2.0 | 63.0 ± 1.9 | 66.4 ± 3.5 | 53.0 ± 3.7 |
| C5-2624 | 2664 | 2618 | 78.9 ± 10.5 | 70.2 ± 5.9 | 56.4 ± 18.0 | 60.0 ± 12.8 |
| C5-2625 | 2665 | 2619 | 104.8 ± 4.6 | 100.1 ± 3.3 | 96.3 ± 3.3 | 91.0 ± 6.3 |
| C5-2626 | 2666 | 2620 | 76.1 ± 3.9 | 70.3 ± 4.7 | 42.2 ± 4.5 | 40.1 ± 4.9 |
| C5-2627 | 2667 | 2621 | 55.5 ± 6.0 | 50.5 ± 6.6 | 52.8 ± 5.1 | 42.6 ± 1.5 |
| C5-2753 | 2793 | 2747 | 88.1 ± 2.9 | 79.1 ± 3.0 | 75.0 ± 3.3 | 69.3 ± 5.9 |
| C5-2754 | 2794 | 2748 | 123.6 ± 3.0 | 112.8 ± 2.4 | 107.9 ± 5.4 | 91.5 ± 5.5 |
| C5-2755 | 2795 | 2749 | 67.8 ± 2.4 | 62.0 ± 5.3 | 56.2 ± 5.1 | 53.9 ± 3.6 |

TABLE 11-continued

C5 Inhibitory Efficacy of DsiRNAs Assayed
at 1 nM in Human HepG2 and Mouse LMTK-Cells

| Duplex Name | Mm Location | Macaque* Location | Human-HepG2 Normalized HPRT/SFRS9; vs NC1, NC5, NC7 | | Mouse-LMTK- Normalized HPRT/Rpl23; vs NC1, NC5, NC7 | |
|---|---|---|---|---|---|---|
| | | | Hs 1643-1764(FAM) Assay % Remaining | Hs 4318-4322 (HEX) Assay % Remaining | Mm 2253-2374 (FAM) Assay % Remaining | Mm 4717-4813 (HEX) Assay % Remaining |
| C5-2756 | 2796 | 2750 | 48.8 ± 9.3 | 39.8 ± 10.4 | 46.0 ± 9.3 | 38.5 ± 8.8 |
| C5-2757 | 2797 | 2751 | 81.1 ± 8.3 | 79.0 ± 7.6 | 61.0 ± 24.6 | 61.8 ± 14.6 |
| C5-2758 | 2798 | 2752 | 50.9 ± 18.5 | 41.3 ± 28.0 | 27.5 ± 14.4 | 27.7 ± 5.8 |
| C5-2759 | 2799 | 2753 | 35.8 ± 7.6 | 28.5 ± 7.3 | 32.2 ± 8.5 | 32.7 ± 4.1 |
| C5-2760 | 2800 | | 43.1 ± 11.2 | 39.7 ± 7.2 | 32.0 ± 10.1 | 36.7 ± 6.7 |
| C5-2967 | | 2967 | 36.9 ± 14.1 | 25.0 ± 11.7 | | |
| C5-2968 | | 2968 | 44.5 ± 24.4 | 30.1 ± 15.7 | | |
| C5-2973 | | 2973 | 35.0 ± 3.7 | 22.4 ± 2.9 | | |
| C5-3049 | 3089 | 3049 | 100.4 ± 2.9 | 99.1 ± 4.2 | 80.0 ± 10.5 | 80.7 ± 6.4 |
| C5-3050 | 3090 | 3050 | 132.3 ± 9.5 | 128.7 ± 9.5 | 74.4 ± 4.5 | 76.0 ± 2.2 |
| C5-3103 | | 3103 | 36.4 ± 2.5 | 18.4 ± 14.8 | | |
| C5-3135 | | 3135 | 51.6 ± 3.9 | 31.9 ± 7.4 | | |
| C5-3136 | | 3136 | 45.0 ± 5.9 | 29.0 ± 6.4 | | |
| C5-3216 | | 3216 | 38.8 ± 2.6 | 26.6 ± 3.3 | | |
| C5-3281 | | 3281 | 36.8 ± 6.0 | 20.4 ± 2.3 | | |
| C5-3284 | | 3284 | 30.7 ± 5.4 | 20.5 ± 9.0 | | |
| C5-3285 | | 3285 | 24.6 ± 7.2 | 16.1 ± 9.4 | | |
| C5-3298 | | 3298 | 39.8 ± 3.7 | 23.7 ± 6.4 | | |
| C5-3299 | | 3299 | 50.3 ± 4.4 | 32.1 ± 1.8 | | |
| C5-3302 | | 3302 | 35.2 ± 10.1 | 23.7 ± 9.8 | | |
| C5-3303 | | 3303 | 30.9 ± 8.5 | 21.2 ± 13.7 | | |
| C5-3332 | | 3332 | 37.3 ± 11.5 | 22.4 ± 22.3 | | |
| C5-3333 | | 3333 | 27.2 ± 7.3 | 14.1 ± 9.5 | | |
| C5-3334 | | 3334 | 26.5 ± 6.6 | 15.1 ± 9.2 | | |
| C5-3335 | | 3335 | 41.5 ± 7.2 | 24.6 ± 5.5 | | |
| C5-3419 | | 3419 | 44.3 ± 4.8 | 27.4 ± 4.0 | | |
| C5-3429 | 3469 | | 39.5 ± 10.3 | 27.4 ± 15.1 | 37.3 ± 4.8 | 25.6 ± 3.7 |
| C5-3430 | 3470 | | 39.4 ± 8.5 | 27.4 ± 14.3 | 29.7 ± 12.7 | 22.3 ± 17.1 |
| C5-3431 | 3471 | | 70.8 ± 7.9 | 58.3 ± 10.7 | 44.4 ± 1.0 | 35.8 ± 9.9 |
| C5-3497 | 3537 | | 45.6 ± 14.0 | 34.7 ± 12.5 | 44.4 ± 14.0 | 36.3 ± 16.4 |
| C5-3498 | 3538 | | 71.6 ± 3.3 | 62.1 ± 3.8 | 66.8 ± 2.2 | 63.7 ± 0.8 |
| C5-3499 | 3539 | | 103.5 ± 3.9 | 93.6 ± 5.4 | 72.6 ± 2.7 | 71.5 ± 3.6 |
| C5-3500 | 3540 | | 55.0 ± 11.0 | 48.0 ± 10.3 | 44.4 ± 2.5 | 39.4 ± 3.8 |
| C5-3672 | | 3576 | 42.8 ± 12.1 | 28.1 ± 4.9 | | |
| C5-3690 | | 3594 | 55.1 ± 8.4 | 34.3 ± 6.1 | | |
| C5-3691 | | 3595 | 59.6 ± 7.2 | 33.4 ± 7.8 | | |
| C5-3692 | | 3596 | 67.0 ± 16.8 | 48.8 ± 27.3 | | |
| C5-3696 | | 3600 | 34.1 ± 3.8 | 20.1 ± 8.6 | | |
| C5-3697 | | 3601 | 32.3 ± 4.3 | 20.0 ± 8.6 | | |
| C5-3722 | | 3626 | 39.2 ± 6.5 | 25.7 ± 7.7 | | |
| C5-3814 | | 3718 | 58.6 ± 7.5 | 47.6 ± 6.1 | | |
| C5-3815 | | 3719 | 53.7 ± 5.9 | 37.1 ± 6.0 | | |
| C5-3820 | | 3724 | 57.0 ± 8.0 | 32.6 ± 8.2 | | |
| C5-3824 | | 3728 | 63.6 ± 3.0 | 35.2 ± 3.1 | | |
| C5-3880 | 3920 | 3784 | 79.1 ± 4.7 | 73.6 ± 4.0 | 73.1 ± 12.0 | 62.6 ± 5.8 |
| C5-3881 | 3921 | 3785 | 46.1 ± 7.0 | 27.5 ± 16.1 | 44.4 ± 7.6 | 39.9 ± 8.9 |
| C5-3949 | | 3853 | 58.6 ± 9.6 | 41.6 ± 9.7 | | |
| C5-4019 | | 3923 | 59.2 ± 5.2 | 37.5 ± 2.6 | | |
| C5-4132 | | 4036 | 45.4 ± 15.7 | 32.3 ± 23.9 | | |
| C5-4168 | | 4072 | 40.9 ± 2.5 | 24.2 ± 7.1 | | |
| C5-4169 | | 4073 | 55.6 ± 2.5 | 25.7 ± 6.6 | | |
| C5-4170 | | 4074 | 45.3 ± 16.0 | 31.3 ± 6.2 | | |
| C5-4171 | | 4075 | 43.0 ± 5.0 | 28.9 ± 2.6 | | |
| C5-4172 | | 4076 | 44.5 ± 2.9 | 29.9 ± 6.1 | | |
| C5-4173 | | 4077 | 41.4 ± 13.3 | 23.4 ± 16.9 | | |
| C5-4174 | | 4078 | 45.0 ± 4.0 | 25.2 ± 5.0 | | |
| C5-4175 | | 4079 | 41.4 ± 2.2 | 23.9 ± 12.3 | | |
| C5-4178 | | 4082 | 71.5 ± 2.9 | 54.9 ± 2.0 | | |
| C5-4199 | | 4103 | 43.4 ± 1.3 | 27.7 ± 1.8 | | |
| C5-4204 | | 4108 | 28.5 ± N/A | 26.8 ± N/A | | |
| C5-4262 | 4302 | 4166 | 74.1 ± 4.9 | 68.8 ± 2.4 | 66.4 ± 9.9 | 53.0 ± 10.2 |
| C5-4263 | 4303 | 4167 | 56.5 ± 4.0 | 50.1 ± 4.0 | 46.3 ± 8.5 | 30.7 ± 2.7 |
| C5-4264 | 4304 | 4168 | 48.9 ± 2.9 | 39.0 ± 5.0 | 34.3 ± 8.0 | 24.5 ± 5.2 |
| C5-4265 | 4305 | 4169 | 80.5 ± 2.5 | 76.9 ± 2.1 | 61.1 ± 2.3 | 59.9 ± 1.6 |
| C5-4266 | 4306 | 4170 | 39.5 ± 8.4 | 25.7 ± 18.0 | 38.5 ± 4.5 | 31.4 ± 6.8 |
| C5-4267 | 4307 | 4171 | 48.6 ± 7.2 | 35.3 ± 13.1 | 43.1 ± 3.7 | 31.5 ± 2.2 |
| C5-4268 | 4308 | 4172 | 95.5 ± 2.0 | 92.9 ± 1.1 | 94.0 ± 5.0 | 85.5 ± 8.7 |

TABLE 11-continued

C5 Inhibitory Efficacy of DsiRNAs Assayed
at 1 nM in Human HepG2 and Mouse LMTK-Cells

| | | | Human-HepG2 Normalized HPRT/SFRS9; vs NC1, NC5, NC7 | | Mouse-LMTK- Normalized HPRT/Rpl23; vs NC1, NC5, NC7 | |
|---|---|---|---|---|---|---|
| Duplex Name | Mm Location | Macaque* Location | Hs 1643-1764(FAM) Assay % Remaining | Hs 4318-4322 (HEX) Assay % Remaining | Mm 2253-2374 (FAM) Assay % Remaining | Mm 4717-4813 (HEX) Assay % Remaining |
| C5-4269 | 4309 | 4173 | 74.3 ± 8.1 | 69.5 ± 8.6 | 71.7 ± 4.2 | 64.6 ± 3.4 |
| C5-4270 | 4310 | 4174 | 106.4 ± 3.8 | 102.5 ± 3.2 | 138.9 ± 8.0 | 133.2 ± 5.8 |
| C5-4423 | | 4327 | 64.6 ± 8.4 | 47.0 ± 9.8 | | |
| C5-4424 | | 4328 | 46.4 ± 5.5 | 31.4 ± 6.2 | | |
| C5-4426 | | 4330 | 58.0 ± 13.9 | 40.3 ± 8.9 | | |
| C5-4428 | | 4332 | 51.1 ± 7.5 | 28.3 ± 7.7 | | |
| C5-4429 | | 4333 | 43.5 ± 5.0 | 28.4 ± 4.2 | | |
| C5-4430 | | 4334 | 55.0 ± 9.9 | 37.5 ± 10.0 | | |
| C5-4435 | 4475 | 4339 | 38.5 ± 15.9 | 27.7 ± 11.2 | 63.1 ± 8.6 | 41.5 ± 4.0 |
| C5-4436 | 4476 | 4340 | 36.1 ± 4.1 | 25.8 ± 6.5 | 52.6 ± 7.8 | 33.7 ± 7.8 |
| C5-4558 | | 4462 | 85.6 ± 3.5 | 65.1 ± 3.0 | | |
| C5-4559 | | 4463 | 46.4 ± 10.6 | 27.2 ± 10.3 | | |
| C5-4561 | | 4465 | 35.9 ± 6.1 | 20.8 ± 5.5 | | |
| C5-4563 | | 4467 | 48.3 ± 6.1 | 33.3 ± 1.4 | | |
| C5-4580 | | 4484 | 50.4 ± 7.9 | 24.5 ± 7.9 | | |
| C5-4601 | 4641 | 4505 | 48.5 ± 4.6 | 36.1 ± 5.9 | 52.9 ± 3.1 | 41.1 ± 4.3 |
| C5-4602 | 4642 | 4506 | 61.2 ± 7.1 | 50.5 ± 7.1 | 91.1 ± 5.8 | 78.8 ± 2.0 |
| C5-4603 | 4643 | 4507 | 80.6 ± 3.0 | 71.0 ± 1.6 | 88.7 ± 1.9 | 78.7 ± 2.4 |
| C5-4604 | 4644 | 4508 | 60.0 ± 15.2 | 46.2 ± 19.6 | 83.0 ± 9.8 | 68.1 ± 12.5 |
| C5-4717 | | 4621 | 42.5 ± 4.0 | 23.9 ± 3.6 | | |
| C5-4718 | | 4622 | 35.0 ± 6.5 | 18.9 ± 6.1 | | |
| C5-4719 | | 4623 | 43.1 ± 5.6 | 24.6 ± 6.2 | | |
| C5-4720 | | 4624 | 41.2 ± 6.1 | 24.6 ± 7.4 | | |
| C5-4721 | | 4625 | 36.5 ± 4.1 | 20.5 ± 6.9 | | |
| C5-4764 | 4804 | 4668 | 49.6 ± 4.6 | 40.5 ± 1.7 | 60.3 ± 9.0 | 52.8 ± 5.6 |
| C5-4765 | 4805 | 4669 | 45.2 ± 17.2 | 35.9 ± 20.9 | 43.6 ± 4.3 | 25.9 ± 1.1 |
| C5-4766 | 4806 | 4670 | 57.0 ± 23.6 | 50.7 ± 26.7 | 50.3 ± 3.6 | 34.3 ± 5.4 |
| C5-4767 | 4807 | 4671 | 47.7 ± 11.3 | 37.0 ± 14.8 | 43.7 ± 9.5 | 29.0 ± 13.2 |
| C5-4768 | 4808 | 4672 | 39.4 ± 8.4 | 28.9 ± 14.2 | 49.2 ± 4.8 | 33.3 ± 3.0 |
| C5-4929 | | 4833 | 45.0 ± 8.7 | 25.7 ± 10.6 | | |
| C5-5013 | | 4917 | 35.4 ± 4.9 | 23.4 ± 6.0 | | |
| C5-5018 | | 4922 | 43.2 ± 2.9 | 27.1 ± 3.1 | | |
| C5-5022 | | 4926 | 45.5 ± 8.8 | 24.5 ± 6.8 | | |
| C5-5027 | | 4931 | 41.1 ± 5.4 | 27.4 ± 15.0 | | |
| C5-5076 | | 4980 | 37.1 ± 3.1 | 21.1 ± 4.5 | | |
| C5-5121 | | 5025 | 59.9 ± 9.5 | 39.1 ± 3.4 | | |
| C5-5123 | | 5027 | 51.0 ± 20.0 | 42.5 ± 22.5 | 133.2 ± 6.5 | 129.3 ± 5.5 |
| C5-5124 | | 5028 | 36.8 ± 15.9 | 25.2 ± 16.1 | 112.2 ± 4.4 | 119.1 ± 1.6 |
| C5-5224 | | 5131 | 36.5 ± 6.7 | 24.9 ± 11.0 | 121.0 ± 7.2 | 108.2 ± 3.1 |
| C5-5225 | | 5132 | 42.4 ± 9.5 | 28.8 ± 11.1 | 102.9 ± 11.7 | 105.6 ± 13.3 |
| C5-5226 | | 5133 | 38.8 ± 7.2 | 28.5 ± 7.3 | 105.1 ± 2.9 | 112.0 ± 3.1 |
| C5-5227 | | 5134 | 41.1 ± 9.8 | 33.4 ± 11.0 | 104.7 ± 3.4 | 100.3 ± 3.4 |
| C5-5295 | | 5202 | 77.7 ± 3.7 | 72.6 ± 3.5 | 96.1 ± 5.4 | 100.7 ± 7.2 |
| C5-5464 | | 5371 | 49.9 ± 6.5 | 39.6 ± 8.3 | 105.5 ± 5.2 | 105.2 ± 4.5 |
| C5-5465 | | 5372 | 50.5 ± 11.0 | 41.9 ± 12.2 | 104.8 ± 5.7 | 111.8 ± 6.4 |
| C5-5468 | | 5375 | 37.4 ± 0.9 | 29.8 ± 3.8 | 103.0 ± 5.4 | 106.0 ± 8.6 |
| C5-5469 | | 5376 | 46.0 ± 6.7 | 36.4 ± 11.1 | 121.6 ± 10.2 | 111.2 ± 10.5 |

*Macaca mulatta

Example 3: DsiRNA Inhibition of C5-Secondary Screen 96 asymmetric DsiRNAs (96 targeting Hs C5, 34 of which also targeted Mm C5) of the above experiment were then examined in a secondary assay ("Phase 2"), with results of such assays presented in histogram form in FIGS. 3A to 3H. Specifically, the 96 asymmetric DsiRNAs selected from those tested above were assessed for inhibition of human C5 at 1 nM or 0.1 nM (in duplicate assays) in the environment of human HepG2 cells (FIGS. 3A to 3D). These 96 asymmetric DsiRNAs were also assessed for inhibition of mouse C5 at 1 nM or 0.1 nM (in duplicate) in the environment of mouse LMTK– cells (FIGS. 3E to 3H). As shown in FIGS. 3A to 3D, most asymmetric DsiRNAs reproducibly exhibited significant human C5 inhibitory efficacies at sub-nanomolar concentrations when assayed in the environment of HepG2 cells.

As shown in FIGS. 3E to 3H, a number of asymmetric DsiRNAs were also identified to possess significant mouse C5 inhibitory efficacies at sub-nanomolar concentrations when assayed in the environment of mouse LMTK– cells.

Example 4: Assessment of In Vivo Efficacy of C5-Targeting DsiRNAs

The ability of certain, active C5-targeting DsiRNAs to reduce C5 levels within the blood, bone marrow, liver, kidney or other target organ of a mouse is examined. Exemplary DsiRNAs are synthesized with passenger (sense) strand modification pattern "SM107" and guide (antisense) strand modification pattern "M48" (patterns described above). To perform the study, a PNH model is obtained (e.g., mice possessing a Pig-a deletion, e.g., as described in Visconte et al. *Haematologica* 95: 214-23, or other model of PNH). Animals are randomized and assigned to groups based on marker levels. Intravenous dosing of animals with lipid nanoparticles (LNPs; optionally, an LNP formulation named EnCore-2345 is employed) containing 1 mg/kg or 0.1 mg/kg of DsiRNA is initiated on day 0. Dosing continues, e.g., BIW for a total of three doses in mice prior to sacrifice and assessment of phenotype and/or knockdown efficacy. Blood, bone marrow, liver and/or kidneys are obtained and C5 levels are assessed using RT-qPCR, ViewRNA, western blot for C5 and/or C5 immunohistochemistry (ViewRNA, western blot for C5 and C5 immunohistochemistry). Serum samples are also subjected to ELISA for detection of C5 (data not shown). DsiRNAs that show robust knockdown of C5 when administered at 1 mg/kg or other doses are thereby identified.

Example 5: Assessment of Modified Forms of C5-Targeting DsiRNAs In Vitro

A selection of 24 DsiRNAs from Example 3 above are prepared with 2'-O-methyl guide strand modification patterns (e.g., "M17", "M35", "M48" and "M8" as shown above), paired with "M107" passenger strand modifications. In exemplary assessments, for each of these DsiRNA sequences, DsiRNAs possessing each of the four guide strand modification patterns M17, M35, M48 and M8 coupled with the "M107" passenger strand modification pattern are assayed for C5 inhibition in human HepG2 cells at 1.0 nM and 0.1 nM (in duplicate) concentrations in the environment of the HepG2 cells. Each of the four modified duplexes associated with the 24 duplex sequences examined is assessed for C5 knockdown efficacy. Duplexes possessing robust C5 knockdown efficacy at even 0.1 nM concentrations are thereby identified, optionally including those possessing knockdown efficacy across the full range of highly modified forms tested.

Additional duplex sequences are also examined for knockdown efficacy in mouse LMTK- cells across the same range of duplex modification patterns. Those duplexes showing robust C5 knockdown efficacy in mouse cells across a range of duplex modification patterns are thereby identified, optionally at concentrations as low as 0.03 nM.

Example 6: Assessment of Additionally Modified Forms of C5-Targeting DsiRNAs In Vitro In this example, the same set of 24 C5-targeting duplex sequences as set forth above in Example 5 are prepared to possess a range of four 2'-O-methyl passenger strand modification patterns ("M107", "M14", "M24" and "M250") coupled with a fixed "M48" guide strand modification pattern. These DsiRNAs are assayed for C5 inhibition at 1.0 nM and 0.1 nM (in duplicate) concentrations in the environment of the HepG2 cells. Human C5 knockdown efficacy data for each of the four modified duplexes associated with the 24 duplex sequences is examined. Tested duplexes that possess robust C5 knockdown efficacy, optionally at even 0.1 nM concentrations across the full range of highly modified passenger strand (with fixed guide strand modification pattern) forms tested, are identified.

Optionally, a number of those duplex sequences in mouse which correspond to human duplexes are also examined for knockdown efficacy in mouse LMTK- cells across the same range of four duplex modification patterns (with passenger strand modification patterns varied and guide strand modification pattern fixed, in contrast to the duplexes of Example 5 above). Those duplexes that show robust C5 knockdown efficacy in mouse cells across a range of duplex modification patterns, optionally at concentrations as low as 0.03 nM, are identified.

Example 7: Indications

The present body of knowledge in C5 research indicates the need for methods to assay C5 activity and for compounds that can regulate C5 expression for research, diagnostic, and therapeutic use. As described herein, the nucleic acid molecules of the present invention can be used in assays to diagnose disease state related to C5 levels. In addition, the nucleic acid molecules can be used to treat disease state related to C5 functionality, misregulation, levels, etc.

Particular disorders and disease states that can be associated with C5 expression modulation include, but are not limited to paroxysmal nocturnal hemoglobinuria (PNH), including phenotypes of such disease in organs such as blood, bone marrow, liver, kidney, eye, skin, etc.

Other therapeutic agents (e.g., Eculizumab, as discussed above) can be combined with or used in conjunction with the nucleic acid molecules (e.g. DsiRNA molecules) of the instant invention. Those skilled in the art will recognize that other compounds and therapies used to treat the diseases and conditions described herein can be combined with the nucleic acid molecules of the instant invention (e.g. siNA molecules, e.g., such as those directed to other enzymes in the targeted complement cascade) and are hence within the scope of the instant invention. For example, for combination therapy, the nucleic acids of the invention can be prepared in one of at least two ways. First, the agents are physically combined in a preparation of nucleic acid and other agent, such as a mixture of a nucleic acid of the invention encapsulated in liposomes and other agent in a solution for intravenous administration, wherein both agents are present in a therapeutically effective concentration (e.g., the other agent in solution to deliver 1000-1250 mg/m2/day and liposome-associated nucleic acid of the invention in the same solution to deliver 0.1-100 mg/kg/day). Alternatively, the agents are administered separately but simultaneously or successively in their respective effective doses (e.g., 1000-1250 mg/m2/d other agent and 0.1 to 100 mg/kg/day nucleic acid of the invention).

Example 8: Serum Stability for DsiRNAs

Serum stability of DsiRNA agents is assessed via incubation of DsiRNA agents in 50% fetal bovine serum for various periods of time (up to 24 h) at 37° C. Serum is extracted and the nucleic acids are separated on a 20% non-denaturing PAGE and can be visualized with Gelstar stain. Relative levels of protection from nuclease degradation are assessed for DsiRNAs (optionally with and without modifications).

Example 9: Diagnostic Uses

The DsiRNA molecules of the invention can be used in a variety of diagnostic applications, such as in the identification of molecular targets (e.g., RNA) in a variety of applications, for example, in clinical, industrial, environmental, agricultural and/or research settings. Such diagnostic use of DsiRNA molecules involves utilizing reconstituted RNAi systems, for example, using cellular lysates or partially purified cellular lysates. DsiRNA molecules of this invention can be used as diagnostic tools to examine genetic drift and mutations within diseased cells. The close relationship between DsiRNA activity and the structure of the target C5 RNA allows the detection of mutations in a region of the C5 molecule, which alters the base-pairing and three-dimensional structure of the target C5 RNA. By using multiple DsiRNA molecules described in this invention, one can map nucleotide changes, which are important to RNA structure and function in vitro, as well as in cells and tissues. Cleavage of target C5 RNAs with DsiRNA molecules can be used to inhibit gene expression and define the role of specified gene products in the progression of a C5-associated disease or disorder. In this manner, other genetic targets can be defined as important mediators of the disease. These experiments will lead to better treatment of the disease progression by affording the possibility of combination therapies (e.g., multiple DsiRNA molecules targeted to different genes, DsiRNA molecules coupled with known peptide/antibody and/or small molecule inhibitors, or intermittent treatment with combinations of DsiRNA molecules and/or other chemical or biological molecules). Other in vitro uses of DsiRNA molecules of this invention are well known in the art, and include detection of the presence of RNAs associated with a disease or related condition. Such RNA is detected by determining the presence of a cleavage product after treatment with a DsiRNA using standard methodologies, for example, fluorescence resonance emission transfer (FRET).

In a specific example, DsiRNA molecules that cleave only wild-type or mutant or polymorphic forms of the target C5 RNA are used for the assay. The first DsiRNA molecules (i.e., those that cleave only wild-type forms of target C5 RNA) are used to identify wild-type C5 RNA present in the sample and the second DsiRNA molecules (i.e., those that cleave only mutant or polymorphic forms of target RNA) are used to identify mutant or polymorphic C5 RNA in the sample. As reaction controls, synthetic substrates of both wild-type and mutant or polymorphic C5 RNA are cleaved by both DsiRNA molecules to demonstrate the relative DsiRNA efficiencies in the reactions and the absence of cleavage of the "non-targeted" C5 RNA species. The cleavage products from the synthetic substrates also serve to generate size markers for the analysis of wild-type and mutant C5 RNAs in the sample population. Thus, each analysis requires two DsiRNA molecules, two substrates and one unknown sample, which is combined into six reactions. The presence of cleavage products is determined using an RNase protection assay so that full-length and cleavage fragments of each C5 RNA can be analyzed in one lane of a polyacrylamide gel. It is not absolutely required to quantify the results to gain insight into the expression of mutant or polymorphic C5 RNAs and putative risk of C5-associated phenotypic changes in target cells. The expression of C5 mRNA whose protein product is implicated in the development of the phenotype (i.e., disease related/associated) is adequate to establish risk. If probes of comparable specific activity are used for both transcripts, then a qualitative comparison of C5 RNA levels is adequate and decreases the cost of the initial diagnosis. Higher mutant or polymorphic form to wild-type ratios are correlated with higher risk whether C5 RNA levels are compared qualitatively or quantitatively.

All patents and publications mentioned in the specification are indicative of the levels of skill of those skilled in the art to which the invention pertains. All references cited in this disclosure are incorporated by reference to the same extent as if each reference had been incorporated by reference in its entirety individually.

One skilled in the art would readily appreciate that the present invention is well adapted to carry out the objects and obtain the ends and advantages mentioned, as well as those inherent therein. The methods and compositions described herein as presently representative of preferred embodiments are exemplary and are not intended as limitations on the scope of the invention. Changes therein and other uses will occur to those skilled in the art, which are encompassed within the spirit of the invention, are defined by the scope of the claims.

It will be readily apparent to one skilled in the art that varying substitutions and modifications can be made to the invention disclosed herein without departing from the scope and spirit of the invention. Thus, such additional embodiments are within the scope of the present invention and the following claims. The present invention teaches one skilled in the art to test various combinations and/or substitutions of chemical modifications described herein toward generating nucleic acid constructs with improved activity for mediating RNAi activity. Such improved activity can comprise improved stability, improved bioavailability, and/or improved activation of cellular responses mediating RNAi. Therefore, the specific embodiments described herein are not limiting and one skilled in the art can readily appreciate that specific combinations of the modifications described herein can be tested without undue experimentation toward identifying DsiRNA molecules with improved RNAi activity.

The invention illustratively described herein suitably can be practiced in the absence of any element or elements, limitation or limitations that are not specifically disclosed herein. Thus, for example, in each instance herein any of the terms "comprising", "consisting essentially of", and "consisting of" may be replaced with either of the other two terms. The terms and expressions which have been employed are used as terms of description and not of limitation, and there is no intention that in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments, optional features, modification and variation of the concepts herein disclosed may be resorted to by those skilled in the art, and that such modifications and variations are considered to be within the scope of this invention as defined by the description and the appended claims.

In addition, where features or aspects of the invention are described in terms of Markush groups or other grouping of alternatives, those skilled in the art will recognize that the invention is also thereby described in terms of any individual member or subgroup of members of the Markush group or other group.

The use of the terms "a" and "an" and "the" and similar referents in the context of describing the invention (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Embodiments of this invention are described herein, including the best mode known to the inventors for carrying out the invention. Variations of those embodiments may become apparent to those of ordinary skill in the art upon reading the foregoing description.

The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context. Those skilled in the art will recognize, or be able to ascertain using no more than routine experimentation, many equivalents to the specific embodiments of the invention described herein. Such equivalents are intended to be encompassed by the following claims.

SEQUENCE LISTING (21959 sequences)

SEQ ID NO: 1 - DNA, 25 bp, Artificial Sequence
  Synthetic oligonucleotide
auaugucauuucagcaccaaaaata

SEQ ID NO: 2 - DNA, 25 bp, Artificial Sequence
  Synthetic oligonucleotide
auugugauucaaguuuauggauaca

SEQ ID NO: 3 - DNA, 25 bp, Artificial Sequence
  Synthetic oligonucleotide
uugugauucaaguuuauggauacac

SEQ ID NO: 4 - DNA, 25 bp, Artificial Sequence
  Synthetic oligonucleotide
ugugauucaaguuuauggauacact

SEQ ID NO: 5 - DNA, 25 bp, Artificial Sequence
  Synthetic oligonucleotide
gugauucaaguuuauggauacactg

SEQ ID NO: 6 - DNA, 25 bp, Artificial Sequence
  Synthetic oligonucleotide
ugauucaaguuuauggauacacuga

SEQ ID NO: 7 - DNA, 25 bp, Artificial Sequence
  Synthetic oligonucleotide
gauucaaguuuauggauacacugaa

SEQ ID NO: 8 - DNA, 25 bp, Artificial Sequence
  Synthetic oligonucleotide
auucaaguuuauggauacacugaag

SEQ ID NO: 9 - DNA, 25 bp, Artificial Sequence
  Synthetic oligonucleotide
uucaaguuuauggauacacugaagc

SEQ ID NO: 10 - DNA, 25 bp, Artificial Sequence
  Synthetic oligonucleotide
ucaaguuuauggauacacugaagca

SEQ ID NO: 11 - DNA, 25 bp, Artificial Sequence
  Synthetic oligonucleotide
caaguuuauggauacacugaagcat

SEQ ID NO: 12 - DNA, 25 bp, Artificial Sequence
  Synthetic oligonucleotide
aaguuuauggauacacugaagcatt

SEQ ID NO: 13 - DNA, 25 bp, Artificial Sequence
  Synthetic oligonucleotide
aguuuauggauacacugaagcautt

SEQ ID NO: 14 - DNA, 25 bp, Artificial Sequence
  Synthetic oligonucleotide
uuuauggauacacugaagcauuuga

SEQ ID NO: 15 - DNA, 25 bp, Artificial Sequence
  Synthetic oligonucleotide
uuauggauacacugaagcauuugat

SEQ ID NO: 16 - DNA, 25 bp, Artificial Sequence
  Synthetic oligonucleotide
auggauacacugaagcauuugaugc

SEQ ID NO: 17 - DNA, 25 bp, Artificial Sequence
  Synthetic oligonucleotide
ggauacacugaagcauuugaugcaa

SEQ ID NO: 18 - DNA, 25 bp, Artificial Sequence
  Synthetic oligonucleotide
gauacacugaagcauuugaugcaac

SEQ ID NO: 19 - DNA, 25 bp, Artificial Sequence
  Synthetic oligonucleotide
auacacugaagcauuugaugcaaca

SEQ ID NO: 20 - DNA, 25 bp, Artificial Sequence
  Synthetic oligonucleotide
uacacugaagcauuugaugcaacaa

SEQ ID NO: 21 - DNA, 25 bp, Artificial Sequence
  Synthetic oligonucleotide
acacugaagcauuugaugcaacaat

SEQ ID NO: 22 - DNA, 25 bp, Artificial Sequence
  Synthetic oligonucleotide
cacugaagcauuugaugcaacaatc

SEQ ID NO: 23 - DNA, 25 bp, Artificial Sequence
  Synthetic oligonucleotide
acugaagcauuugaugcaacaauct

SEQ ID NO: 24 - DNA, 25 bp, Artificial Sequence
  Synthetic oligonucleotide
cugaagcauuugaugcaacaauctc

SEQ ID NO: 25 - DNA, 25 bp, Artificial Sequence
  Synthetic oligonucleotide
gaagcauuugaugcaacaaucucta

SEQ ID NO: 26 - DNA, 25 bp, Artificial Sequence
  Synthetic oligonucleotide
agcauuugaugcaacaaucucuatt

SEQ ID NO: 27 - DNA, 25 bp, Artificial Sequence
  Synthetic oligonucleotide
cauuugaugcaacaaucucuauuaa

SEQ ID NO: 28 - DNA, 25 bp, Artificial Sequence
  Synthetic oligonucleotide
ugaugcaacaaucucuauuaaaagt

SEQ ID NO: 29 - DNA, 25 bp, Artificial Sequence
  Synthetic oligonucleotide
gaugcaacaaucucuauuaaaagtt

SEQ ID NO: 30 - DNA, 25 bp, Artificial Sequence
  Synthetic oligonucleotide
augcaacaaucucuauuaaaaguta

SEQ ID NO: 31 - DNA, 25 bp, Artificial Sequence
  Synthetic oligonucleotide
ugcaacaaucucuauuaaaaguuat

SEQ ID NO: 32 - DNA, 25 bp, Artificial Sequence
  Synthetic oligonucleotide
acaaucucuauuaaaaguuaucctg

SEQ ID NO: 33 - DNA, 25 bp, Artificial Sequence
  Synthetic oligonucleotide
caaucucuauuaaaaguuauccuga

SEQ ID NO: 34 - DNA, 25 bp, Artificial Sequence
  Synthetic oligonucleotide
cuauuaaaaguuauccugauaaaaa

SEQ ID NO: 35 - DNA, 25 bp, Artificial Sequence
  Synthetic oligonucleotide
auuaaaaguuauccugauaaaaaat

SEQ ID NO: 36 - DNA, 25 bp, Artificial Sequence
  Synthetic oligonucleotide
aaaaguuauccugauaaaaaauuta

SEQ ID NO: 37 - DNA, 25 bp, Artificial Sequence
  Synthetic oligonucleotide
aaaguuauccugauaaaaaauuuag

SEQ ID NO: 38 - DNA, 25 bp, Artificial Sequence
  Synthetic oligonucleotide
guuauccugauaaaaaauuuaguta

SEQ ID NO: 39 - DNA, 25 bp, Artificial Sequence
  Synthetic oligonucleotide
uuauccugauaaaaaauuuaguuac

SEQ ID NO: 40 - DNA, 25 bp, Artificial Sequence
  Synthetic oligonucleotide
guucauuuauccucagagaauaaat

SEQ ID NO: 41 - DNA, 25 bp, Artificial Sequence
  Synthetic oligonucleotide
uucauuuauccucagagaauaaatt

SEQ ID NO: 42 - DNA, 25 bp, Artificial Sequence
  Synthetic oligonucleotide
guauuuggaaguuguaucaaagcat

SEQ ID NO: 43 - DNA, 25 bp, Artificial Sequence
  Synthetic oligonucleotide
uauuuggaaguuguaucaaagcatt

SEQ ID NO: 44 - DNA, 25 bp, Artificial Sequence
  Synthetic oligonucleotide
uuggaaguuguaucaaagcauuutt

SEQ ID NO: 45 - DNA, 25 bp, Artificial Sequence
  Synthetic oligonucleotide
uggaaguuguaucaaagcauuuutc

SEQ ID NO: 46 - DNA, 25 bp, Artificial Sequence
  Synthetic oligonucleotide
ggaaguuguaucaaagcauuuuuca

SEQ ID NO: 47 - DNA, 25 bp, Artificial Sequence
  Synthetic oligonucleotide
gaaguuguaucaaagcauuuuucaa

SEQ ID NO: 48 - DNA, 25 bp, Artificial Sequence
  Synthetic oligonucleotide
aaguuguaucaaagcauuuuucaaa

SEQ ID NO: 49 - DNA, 25 bp, Artificial Sequence
  Synthetic oligonucleotide
aguuguaucaaagcauuuuucaaaa

SEQ ID NO: 50 - DNA, 25 bp, Artificial Sequence
  Synthetic oligonucleotide
guuguaucaaagcauuuuucaaaat

SEQ ID NO: 51 - DNA, 25 bp, Artificial Sequence
  Synthetic oligonucleotide
uuguaucaaagcauuuuucaaaatc

SEQ ID NO: 52 - DNA, 25 bp, Artificial Sequence
  Synthetic oligonucleotide
uguaucaaagcauuuuucaaaauca

SEQ ID NO: 53 - DNA, 25 bp, Artificial Sequence
  Synthetic oligonucleotide
guaucaaagcauuuuucaaaaucaa

SEQ ID NO: 54 - DNA, 25 bp, Artificial Sequence
  Synthetic oligonucleotide
aauaaccuaugacaauggauuuctc

SEQ ID NO: 55 - DNA, 25 bp, Artificial Sequence
  Synthetic oligonucleotide
cuaugacaauggauuucucuucatt

SEQ ID NO: 56 - DNA, 25 bp, Artificial Sequence
  Synthetic oligonucleotide
gacaauggauuucucuucauucata

SEQ ID NO: 57 - DNA, 25 bp, Artificial Sequence
  Synthetic oligonucleotide
acaauggauuucucuucauucauac

SEQ ID NO: 58 - DNA, 25 bp, Artificial Sequence
  Synthetic oligonucleotide
caauggauuucucuucauucauaca

SEQ ID NO: 59 - DNA, 25 bp, Artificial Sequence
  Synthetic oligonucleotide
auggauuucucuucauucauacaga

SEQ ID NO: 60 - DNA, 25 bp, Artificial Sequence
  Synthetic oligonucleotide
uggauuucucuucauucauacagac

SEQ ID NO: 61 - DNA, 25 bp, Artificial Sequence
  Synthetic oligonucleotide
gauuucucuucauucauacagacaa

SEQ ID NO: 62 - DNA, 25 bp, Artificial Sequence
  Synthetic oligonucleotide
auucauacagacaaaccuguuuata

SEQ ID NO: 63 - DNA, 25 bp, Artificial Sequence
  Synthetic oligonucleotide
ucauacagacaaaccuguuuauact

SEQ ID NO: 64 - DNA, 25 bp, Artificial Sequence
  Synthetic oligonucleotide
cauacagacaaaccuguuuauactc

SEQ ID NO: 65 - DNA, 25 bp, Artificial Sequence
  Synthetic oligonucleotide
auacagacaaaccuguuuauacucc

SEQ ID NO: 66 - DNA, 25 bp, Artificial Sequence
  Synthetic oligonucleotide
guuagaguuuauucguugaaugacg

SEQ ID NO: 67 - DNA, 25 bp, Artificial Sequence
  Synthetic oligonucleotide
ugacgacuugaagccagccaaaaga

SEQ ID NO: 68 - DNA, 25 bp, Artificial Sequence
  Synthetic oligonucleotide
gacgacuugaagccagccaaaagag

SEQ ID NO: 69 - DNA, 25 bp, Artificial Sequence
  Synthetic oligonucleotide
acgacuugaagccagccaaaagaga

SEQ ID NO: 70 - DNA, 25 bp, Artificial Sequence
  Synthetic oligonucleotide
cgacuugaagccagccaaaagagaa

SEQ ID NO: 71 - DNA, 25 bp, Artificial Sequence
  Synthetic oligonucleotide
agaaacugucuuaacuuucauagat

SEQ ID NO: 72 - DNA, 25 bp, Artificial Sequence
  Synthetic oligonucleotide
acugucuuaacuuucauagaucctg

SEQ ID NO: 73 - DNA, 25 bp, Artificial Sequence
  Synthetic oligonucleotide
cugucuuaacuuucauagauccuga

SEQ ID NO: 74 - DNA, 25 bp, Artificial Sequence
  Synthetic oligonucleotide
gaaggaucagaaguugacaugguag

SEQ ID NO: 75 - DNA, 25 bp, Artificial Sequence
  Synthetic oligonucleotide
aaggaucagaaguugacaugguaga

SEQ ID NO: 76 - DNA, 25 bp, Artificial Sequence
  Synthetic oligonucleotide
gacaugguagaagaaauugaucata

SEQ ID NO: 77 - DNA, 25 bp, Artificial Sequence
  Synthetic oligonucleotide
acaugguagaagaaauugaucauat

SEQ ID NO: 78 - DNA, 25 bp, Artificial Sequence
  Synthetic oligonucleotide
gguagaagaaauugaucauauugga

SEQ ID NO: 79 - DNA, 25 bp, Artificial Sequence
  Synthetic oligonucleotide
guagaagaaauugaucauauuggaa

SEQ ID NO: 80 - DNA, 25 bp, Artificial Sequence
  Synthetic oligonucleotide
aagaaauugaucauauuggaauuat

SEQ ID NO: 81 - DNA, 25 bp, Artificial Sequence
  Synthetic oligonucleotide
agaaauugaucauauuggaauuatc

SEQ ID NO: 82 - DNA, 25 bp, Artificial Sequence
  Synthetic oligonucleotide
ggaauuaucucuuuuccugacuuca

SEQ ID NO: 83 - DNA, 25 bp, Artificial Sequence
  Synthetic oligonucleotide
gaauuaucucuuuuccugacuucaa

SEQ ID NO: 84 - DNA, 25 bp, Artificial Sequence
  Synthetic oligonucleotide
aauuaucucuuuuccugacuucaag

SEQ ID NO: 85 - DNA, 25 bp, Artificial Sequence
  Synthetic oligonucleotide
auuaucucuuuuccugacuucaaga

SEQ ID NO: 86 - DNA, 25 bp, Artificial Sequence
  Synthetic oligonucleotide
uuaucucuuuuccugacuucaagat

SEQ ID NO: 87 - DNA, 25 bp, Artificial Sequence
  Synthetic oligonucleotide
uaucucuuuuccugacuucaagatt

SEQ ID NO: 88 - DNA, 25 bp, Artificial Sequence
  Synthetic oligonucleotide
aucucuuuuccugacuucaagautc

SEQ ID NO: 89 - DNA, 25 bp, Artificial Sequence
  Synthetic oligonucleotide
ucucuuuuccugacuucaagauucc

SEQ ID NO: 90 - DNA, 25 bp, Artificial Sequence
  Synthetic oligonucleotide
cucuuuuccugacuucaagauuccg

SEQ ID NO: 91 - DNA, 25 bp, Artificial Sequence
  Synthetic oligonucleotide
ucuuuuccugacuucaagauuccgt

SEQ ID NO: 92 - DNA, 25 bp, Artificial Sequence
  Synthetic oligonucleotide
cuuuuccugacuucaagauuccgtc

SEQ ID NO: 93 - DNA, 25 bp, Artificial Sequence
  Synthetic oligonucleotide
uuuuccugacuucaagauuccguct

SEQ ID NO: 94 - DNA, 25 bp, Artificial Sequence
  Synthetic oligonucleotide
uuuccugacuucaagauuccgucta

SEQ ID NO: 95 - DNA, 25 bp, Artificial Sequence
  Synthetic oligonucleotide
uuccugacuucaagauuccgucuaa

SEQ ID NO: 96 - DNA, 25 bp, Artificial Sequence
  Synthetic oligonucleotide
uuaaagaauaugucuugccacautt

SEQ ID NO: 97 - DNA, 25 bp, Artificial Sequence
  Synthetic oligonucleotide
uaaagaauaugucuugccacauutt

SEQ ID NO: 98 - DNA, 25 bp, Artificial Sequence
  Synthetic oligonucleotide
aaagaauaugucuugccacauuutt

SEQ ID NO: 99 - DNA, 25 bp, Artificial Sequence
  Synthetic oligonucleotide
aagaacuuuaagaauuuugaaauta

SEQ ID NO: 100 - DNA, 25 bp, Artificial Sequence
  Synthetic oligonucleotide
agaacuuuaagaauuuugaaauuac

SEQ ID NO: 101 - DNA, 25 bp, Artificial Sequence
  Synthetic oligonucleotide
cuuuaagaauuuugaaauuacuata

SEQ ID NO: 102 - DNA, 25 bp, Artificial Sequence
  Synthetic oligonucleotide
gaauuuugaaauuacuauaaaagca

SEQ ID NO: 103 - DNA, 25 bp, Artificial Sequence
  Synthetic oligonucleotide
aauuuugaaauuacuauaaaagcaa

SEQ ID NO: 104 - DNA, 25 bp, Artificial Sequence
  Synthetic oligonucleotide
auuuugaaauuacuauaaaagcaag

SEQ ID NO: 105 - DNA, 25 bp, Artificial Sequence
  Synthetic oligonucleotide
uugaaauuacuauaaaagcaagata

SEQ ID NO: 106 - DNA, 25 bp, Artificial Sequence
  Synthetic oligonucleotide
ugaaauuacuauaaaagcaagauat

SEQ ID NO: 107 - DNA, 25 bp, Artificial Sequence
  Synthetic oligonucleotide
gaaauuacuauaaaagcaagauatt

SEQ ID NO: 108 - DNA, 25 bp, Artificial Sequence
  Synthetic oligonucleotide
aaagcaagauauuuuuauaauaaag

SEQ ID NO: 109 - DNA, 25 bp, Artificial Sequence
  Synthetic oligonucleotide
aagcaagauauuuuuauaauaaagt

SEQ ID NO: 110 - DNA, 25 bp, Artificial Sequence
  Synthetic oligonucleotide
agcaagauauuuuuauaauaaagta

SEQ ID NO: 111 - DNA, 25 bp, Artificial Sequence
  Synthetic oligonucleotide
gcaagauauuuuuauaauaaaguag

SEQ ID NO: 112 - DNA, 25 bp, Artificial Sequence
  Synthetic oligonucleotide
caagauauuuuuauaauaaaguagt

SEQ ID NO: 113 - DNA, 25 bp, Artificial Sequence
  Synthetic oligonucleotide
aagauauuuuuauaauaaaguagtc

SEQ ID NO: 114 - DNA, 25 bp, Artificial Sequence
  Synthetic oligonucleotide
agauauuuuuauaauaaaguaguca

SEQ ID NO: 115 - DNA, 25 bp, Artificial Sequence
  Synthetic oligonucleotide
gauauuuuuauaauaaaguagucac

SEQ ID NO: 116 - DNA, 25 bp, Artificial Sequence
  Synthetic oligonucleotide
caauguugauaaauggaauugcuca

SEQ ID NO: 117 - DNA, 25 bp, Artificial Sequence
  Synthetic oligonucleotide
aauguugauaaauggaauugcucaa

SEQ ID NO: 118 - DNA, 25 bp, Artificial Sequence
  Synthetic oligonucleotide
uguugauaaauggaauugcucaagt

SEQ ID NO: 119 - DNA, 25 bp, Artificial Sequence
  Synthetic oligonucleotide
guugauaaauggaauugcucaagtc

SEQ ID NO: 120 - DNA, 25 bp, Artificial Sequence
  Synthetic oligonucleotide
uugauaaauggaauugcucaaguca

SEQ ID NO: 121 - DNA, 25 bp, Artificial Sequence
  Synthetic oligonucleotide
auaaauggaauugcucaagucacat

SEQ ID NO: 122 - DNA, 25 bp, Artificial Sequence
  Synthetic oligonucleotide
auggaauugcucaagucacauuuga

SEQ ID NO: 123 - DNA, 25 bp, Artificial Sequence
  Synthetic oligonucleotide
cucaagucacauuugauucugaaac

SEQ ID NO: 124 - DNA, 25 bp, Artificial Sequence
  Synthetic oligonucleotide
caagucacauuugauucugaaacag

SEQ ID NO: 125 - DNA, 25 bp, Artificial Sequence
  Synthetic oligonucleotide
aagucacauuugauucugaaacagc

SEQ ID NO: 126 - DNA, 25 bp, Artificial Sequence
  Synthetic oligonucleotide
agucacauuugauucugaaacagca

SEQ ID NO: 127 - DNA, 25 bp, Artificial Sequence
  Synthetic oligonucleotide
cauuugauucugaaacagcagucaa

SEQ ID NO: 128 - DNA, 25 bp, Artificial Sequence
  Synthetic oligonucleotide
uuugauucugaaacagcagucaaag

SEQ ID NO: 129 - DNA, 25 bp, Artificial Sequence
  Synthetic oligonucleotide
uugauucugaaacagcagucaaaga

SEQ ID NO: 130 - DNA, 25 bp, Artificial Sequence
  Synthetic oligonucleotide
cagcagucaaagaacugucauacta

SEQ ID NO: 131 - DNA, 25 bp, Artificial Sequence
  Synthetic oligonucleotide
gcagucaaagaacugucauacuaca

SEQ ID NO: 132 - DNA, 25 bp, Artificial Sequence
  Synthetic oligonucleotide
gucaaagaacugucauacuacagtt

SEQ ID NO: 133 - DNA, 25 bp, Artificial Sequence
  Synthetic oligonucleotide
aagaacugucauacuacaguuuaga

SEQ ID NO: 134 - DNA, 25 bp, Artificial Sequence
  Synthetic oligonucleotide
agaacugucauacuacaguuuagaa

SEQ ID NO: 135 - DNA, 25 bp, Artificial Sequence
  Synthetic oligonucleotide
aacugucauacuacaguuuagaaga

SEQ ID NO: 136 - DNA, 25 bp, Artificial Sequence
  Synthetic oligonucleotide
uuaaacaacaaguaccuuuauautg

SEQ ID NO: 137 - DNA, 25 bp, Artificial Sequence
  Synthetic oligonucleotide
uaaacaacaaguaccuuuauauugc

SEQ ID NO: 138 - DNA, 25 bp, Artificial Sequence
  Synthetic oligonucleotide
aaacaacaaguaccuuuauauugct

SEQ ID NO: 139 - DNA, 25 bp, Artificial Sequence
  Synthetic oligonucleotide
aacaacaaguaccuuuauauugctg

SEQ ID NO: 140 - DNA, 25 bp, Artificial Sequence
  Synthetic oligonucleotide
acaacaaguaccuuuauauugcugt

SEQ ID NO: 141 - DNA, 25 bp, Artificial Sequence
  Synthetic oligonucleotide
caacaaguaccuuuauauugcugta

SEQ ID NO: 142 - DNA, 25 bp, Artificial Sequence
  Synthetic oligonucleotide
aacaaguaccuuuauauugcuguaa

SEQ ID NO: 143 - DNA, 25 bp, Artificial Sequence
  Synthetic oligonucleotide
acaaguaccuuuauauugcuguaac

SEQ ID NO: 144 - DNA, 25 bp, Artificial Sequence
  Synthetic oligonucleotide
caaguaccuuuauauugcuguaaca

SEQ ID NO: 145 - DNA, 25 bp, Artificial Sequence
  Synthetic oligonucleotide
aaguaccuuuauauugcuguaacag

SEQ ID NO: 146 - DNA, 25 bp, Artificial Sequence
  Synthetic oligonucleotide
aguaccuuuauauugcuguaacagt

SEQ ID NO: 147 - DNA, 25 bp, Artificial Sequence
  Synthetic oligonucleotide
guaccuuuauauugcuguaacagtc

SEQ ID NO: 148 - DNA, 25 bp, Artificial Sequence
  Synthetic oligonucleotide
accuuuauauugcuguaacagucat

SEQ ID NO: 149 - DNA, 25 bp, Artificial Sequence
  Synthetic oligonucleotide
ucaaauauguccucucucccuacaa

SEQ ID NO: 150 - DNA, 25 bp, Artificial Sequence
  Synthetic oligonucleotide
cccuacaaacugaauuugguugcta

SEQ ID NO: 151 - DNA, 25 bp, Artificial Sequence
  Synthetic oligonucleotide
acaaacugaauuugguugcuacucc

SEQ ID NO: 152 - DNA, 25 bp, Artificial Sequence
  Synthetic oligonucleotide
caaacugaauuugguugcuacucct

SEQ ID NO: 153 - DNA, 25 bp, Artificial Sequence
  Synthetic oligonucleotide
cugaaugcacaaacaauugauguaa

SEQ ID NO: 154 - DNA, 25 bp, Artificial Sequence
  Synthetic oligonucleotide
ugaaugcacaaacaauugauguaaa

SEQ ID NO: 155 - DNA, 25 bp, Artificial Sequence
  Synthetic oligonucleotide
caagagacaucugacuuggauccaa

SEQ ID NO: 156 - DNA, 25 bp, Artificial Sequence
  Synthetic oligonucleotide
aagagacaucugacuuggauccaag

SEQ ID NO: 157 - DNA, 25 bp, Artificial Sequence
  Synthetic oligonucleotide
gguuaccgagcaauagcauacucat

SEQ ID NO: 158 - DNA, 25 bp, Artificial Sequence
  Synthetic oligonucleotide
ucagccaaaguuaccuuuauauuga

SEQ ID NO: 159 - DNA, 25 bp, Artificial Sequence
  Synthetic oligonucleotide
cagccaaaguuaccuuuauauugat

SEQ ID NO: 160 - DNA, 25 bp, Artificial Sequence
  Synthetic oligonucleotide
agccaaaguuaccuuuauauugatt

SEQ ID NO: 161 - DNA, 25 bp, Artificial Sequence
  Synthetic oligonucleotide
gccaaaguuaccuuuauauugautg

SEQ ID NO: 162 - DNA, 25 bp, Artificial Sequence
  Synthetic oligonucleotide
aaaagcccauauauugacaaaauaa

SEQ ID NO: 163 - DNA, 25 bp, Artificial Sequence
  Synthetic oligonucleotide
gcccauauauugacaaaauaacuca

SEQ ID NO: 164 - DNA, 25 bp, Artificial Sequence
  Synthetic oligonucleotide
cccauauauugacaaaauaacucac

SEQ ID NO: 165 - DNA, 25 bp, Artificial Sequence
  Synthetic oligonucleotide
cauauauugacaaaauaacucacta

SEQ ID NO: 166 - DNA, 25 bp, Artificial Sequence
  Synthetic oligonucleotide
auauauugacaaaauaacucacuat

SEQ ID NO: 167 - DNA, 25 bp, Artificial Sequence
  Synthetic oligonucleotide
uauauugacaaaauaacucacuata

SEQ ID NO: 168 - DNA, 25 bp, Artificial Sequence
  Synthetic oligonucleotide
auugacaaaauaacucacuauaatt

SEQ ID NO: 169 - DNA, 25 bp, Artificial Sequence
  Synthetic oligonucleotide
ugacaaaauaacucacuauaauuac

SEQ ID NO: 170 - DNA, 25 bp, Artificial Sequence
  Synthetic oligonucleotide
gacaaaauaacucacuauaauuact

SEQ ID NO: 171 - DNA, 25 bp, Artificial Sequence
  Synthetic oligonucleotide
acaaaauaacucacuauaauuactt

SEQ ID NO: 172 - DNA, 25 bp, Artificial Sequence
  Synthetic oligonucleotide
caaaauaacucacuauaauuacutg

SEQ ID NO: 173 - DNA, 25 bp, Artificial Sequence
  Synthetic oligonucleotide
aaaauaacucacuauaauuacuuga

SEQ ID NO: 174 - DNA, 25 bp, Artificial Sequence
  Synthetic oligonucleotide
aaauaacucacuauaauuacuugat

SEQ ID NO: 175 - DNA, 25 bp, Artificial Sequence
  Synthetic oligonucleotide
aauaacucacuauaauuacuugatt

SEQ ID NO: 176 - DNA, 25 bp, Artificial Sequence
  Synthetic oligonucleotide
auaacucacuauaauuacuugautt

SEQ ID NO: 177 - DNA, 25 bp, Artificial Sequence
  Synthetic oligonucleotide
uaacucacuauaauuacuugauutt

SEQ ID NO: 178 - DNA, 25 bp, Artificial Sequence
  Synthetic oligonucleotide
aacucacuauaauuacuugauuuta

SEQ ID NO: 179 - DNA, 25 bp, Artificial Sequence
  Synthetic oligonucleotide
acucacuauaauuacuugauuuuat

SEQ ID NO: 180 - DNA, 25 bp, Artificial Sequence
  Synthetic oligonucleotide
cucacuauaauuacuugauuuuatc

SEQ ID NO: 181 - DNA, 25 bp, Artificial Sequence
  Synthetic oligonucleotide
ucacuauaauuacuugauuuuaucc

SEQ ID NO: 182 - DNA, 25 bp, Artificial Sequence
  Synthetic oligonucleotide
cacuauaauuacuugauuuuaucca

SEQ ID NO: 183 - DNA, 25 bp, Artificial Sequence
  Synthetic oligonucleotide
acuauaauuacuugauuuuauccaa

SEQ ID NO: 184 - DNA, 25 bp, Artificial Sequence
  Synthetic oligonucleotide
cuauaauuacuugauuuuauccaag

SEQ ID NO: 185 - DNA, 25 bp, Artificial Sequence
  Synthetic oligonucleotide
uauaauuacuugauuuuauccaagg

SEQ ID NO: 186 - DNA, 25 bp, Artificial Sequence
  Synthetic oligonucleotide
auaauuacuugauuuuauccaaggg

SEQ ID NO: 187 - DNA, 25 bp, Artificial Sequence
  Synthetic oligonucleotide
uaauuacuugauuuuauccaagggc

SEQ ID NO: 188 - DNA, 25 bp, Artificial Sequence
  Synthetic oligonucleotide
aauuacuugauuuuauccaagggca

SEQ ID NO: 189 - DNA, 25 bp, Artificial Sequence
  Synthetic oligonucleotide
auuacuugauuuuauccaagggcaa

SEQ ID NO: 190 - DNA, 25 bp, Artificial Sequence
  Synthetic oligonucleotide
gucugauucagucugguuaaauatt

SEQ ID NO: 191 - DNA, 25 bp, Artificial Sequence
  Synthetic oligonucleotide
cugauucagucugguuaaauauuga

SEQ ID NO: 192 - DNA, 25 bp, Artificial Sequence
  Synthetic oligonucleotide
ugauucagucugguuaaauauugaa

SEQ ID NO: 193 - DNA, 25 bp, Artificial Sequence
  Synthetic oligonucleotide
gauucagucugguuaaauauugaag

SEQ ID NO: 194 - DNA, 25 bp, Artificial Sequence
  Synthetic oligonucleotide
auucagucugguuaaauauugaaga

SEQ ID NO: 195 - DNA, 25 bp, Artificial Sequence
  Synthetic oligonucleotide
ucagucugguuaaauauugaagaaa

SEQ ID NO: 196 - DNA, 25 bp, Artificial Sequence
  Synthetic oligonucleotide
cagucugguuaaauauugaagaaaa

SEQ ID NO: 197 - DNA, 25 bp, Artificial Sequence
  Synthetic oligonucleotide
agucugguuaaauauugaagaaaaa

SEQ ID NO: 198 - DNA, 25 bp, Artificial Sequence
  Synthetic oligonucleotide
gucugguuaaauauugaagaaaaat

SEQ ID NO: 199 - DNA, 25 bp, Artificial Sequence
  Synthetic oligonucleotide
ucugguuaaauauugaagaaaaatg

SEQ ID NO: 200 - DNA, 25 bp, Artificial Sequence
  Synthetic oligonucleotide
cugguuaaauauugaagaaaaaugt

SEQ ID NO: 201 - DNA, 25 bp, Artificial Sequence
  Synthetic oligonucleotide
ugguuaaauauugaagaaaaaugtg

SEQ ID NO: 202 - DNA, 25 bp, Artificial Sequence
  Synthetic oligonucleotide
gguuaaauauugaagaaaaaugugg

SEQ ID NO: 203 - DNA, 25 bp, Artificial Sequence
  Synthetic oligonucleotide
uguggcaaccagcuccagguucatc

SEQ ID NO: 204 - DNA, 25 bp, Artificial Sequence
  Synthetic oligonucleotide
guggcaaccagcuccagguucauct

SEQ ID NO: 205 - DNA, 25 bp, Artificial Sequence
  Synthetic oligonucleotide
cugggcuguggggcaggugguggcc

SEQ ID NO: 206 - DNA, 25 bp, Artificial Sequence
  Synthetic oligonucleotide
ugggcuguggggcaggugguggcct

SEQ ID NO: 207 - DNA, 25 bp, Artificial Sequence
  Synthetic oligonucleotide
gggcuguggggcaggugguggcctc

SEQ ID NO: 208 - DNA, 25 bp, Artificial Sequence
  Synthetic oligonucleotide
ggcuguggggcaggugguggccuca

SEQ ID NO: 209 - DNA, 25 bp, Artificial Sequence
  Synthetic oligonucleotide
gcuguggggcaggugguggccucaa

SEQ ID NO: 210 - DNA, 25 bp, Artificial Sequence
  Synthetic oligonucleotide
cuguggggcaggugguggccucaac

SEQ ID NO: 211 - DNA, 25 bp, Artificial Sequence
  Synthetic oligonucleotide
uguggggcaggugguggccucaaca

SEQ ID NO: 212 - DNA, 25 bp, Artificial Sequence
  Synthetic oligonucleotide
agaaaaugaugaaccuuguaaagaa

SEQ ID NO: 213 - DNA, 25 bp, Artificial Sequence
  Synthetic oligonucleotide
augaugaaccuuguaaagaaauuct

SEQ ID NO: 214 - DNA, 25 bp, Artificial Sequence
  Synthetic oligonucleotide
gaugaaccuuguaaagaaauucuca

SEQ ID NO: 215 - DNA, 25 bp, Artificial Sequence
  Synthetic oligonucleotide
augaaccuuguaaagaaauucucag

SEQ ID NO: 216 - DNA, 25 bp, Artificial Sequence
  Synthetic oligonucleotide
cuuguaaagaaauucucaggccaag

SEQ ID NO: 217 - DNA, 25 bp, Artificial Sequence
  Synthetic oligonucleotide
uuguaaagaaauucucaggccaaga

SEQ ID NO: 218 - DNA, 25 bp, Artificial Sequence
  Synthetic oligonucleotide
aguagugaagaaauguuguuacgat

SEQ ID NO: 219 - DNA, 25 bp, Artificial Sequence
  Synthetic oligonucleotide
guagugaagaaauguuguuacgatg

SEQ ID NO: 220 - DNA, 25 bp, Artificial Sequence
  Synthetic oligonucleotide
gaagacccuguuaccaguaagcaag

SEQ ID NO: 221 - DNA, 25 bp, Artificial Sequence
  Synthetic oligonucleotide
caagccagaaauucggaguuauutt

SEQ ID NO: 222 - DNA, 25 bp, Artificial Sequence
  Synthetic oligonucleotide
ucaaggcaaagguguucaaagaugt

SEQ ID NO: 223 - DNA, 25 bp, Artificial Sequence
  Synthetic oligonucleotide
caaggcaaagguguucaaagaugtc

SEQ ID NO: 224 - DNA, 25 bp, Artificial Sequence
  Synthetic oligonucleotide
aaggcaaagguguucaaagauguct

SEQ ID NO: 225 - DNA, 25 bp, Artificial Sequence
  Synthetic oligonucleotide
aggcaaagguguucaaagauguctt

SEQ ID NO: 226 - DNA, 25 bp, Artificial Sequence
  Synthetic oligonucleotide
gaugucuuccuggaaaugaauauac

SEQ ID NO: 227 - DNA, 25 bp, Artificial Sequence
  Synthetic oligonucleotide
cuggaaaugaauauaccauauuctg

SEQ ID NO: 228 - DNA, 25 bp, Artificial Sequence
  Synthetic oligonucleotide
uggaaaugaauauaccauauucugt

SEQ ID NO: 229 - DNA, 25 bp, Artificial Sequence
  Synthetic oligonucleotide
ggaaaugaauauaccauauucugtt

SEQ ID NO: 230 - DNA, 25 bp, Artificial Sequence
  Synthetic oligonucleotide
gaaaugaauauaccauauucugutg

SEQ ID NO: 231 - DNA, 25 bp, Artificial Sequence
  Synthetic oligonucleotide
aaaugaauauaccauauucuguugt

SEQ ID NO: 232 - DNA, 25 bp, Artificial Sequence
  Synthetic oligonucleotide
aaugaauauaccauauucuguugta

SEQ ID NO: 233 - DNA, 25 bp, Artificial Sequence
  Synthetic oligonucleotide
augaauauaccauauucuguuguac

SEQ ID NO: 234 - DNA, 25 bp, Artificial Sequence
  Synthetic oligonucleotide
ugaauauaccauauucuguuguacg

SEQ ID NO: 235 - DNA, 25 bp, Artificial Sequence
  Synthetic oligonucleotide
gaauauaccauauucuguuguacga

SEQ ID NO: 236 - DNA, 25 bp, Artificial Sequence
  Synthetic oligonucleotide
aauauaccauauucuguuguacgag

SEQ ID NO: 237 - DNA, 25 bp, Artificial Sequence
  Synthetic oligonucleotide
auauaccauauucuguuguacgagg

SEQ ID NO: 238 - DNA, 25 bp, Artificial Sequence
  Synthetic oligonucleotide
cgaggagaacagauccaauugaaag

SEQ ID NO: 239 - DNA, 25 bp, Artificial Sequence
  Synthetic oligonucleotide
gaggagaacagauccaauugaaagg

SEQ ID NO: 240 - DNA, 25 bp, Artificial Sequence
  Synthetic oligonucleotide
aggagaacagauccaauugaaagga

SEQ ID NO: 241 - DNA, 25 bp, Artificial Sequence
  Synthetic oligonucleotide
ggagaacagauccaauugaaaggaa

SEQ ID NO: 242 - DNA, 25 bp, Artificial Sequence
  Synthetic oligonucleotide
gagaacagauccaauugaaaggaac

SEQ ID NO: 243 - DNA, 25 bp, Artificial Sequence
  Synthetic oligonucleotide
agaacagauccaauugaaaggaact

SEQ ID NO: 244 - DNA, 25 bp, Artificial Sequence
  Synthetic oligonucleotide
gaacagauccaauugaaaggaactg

SEQ ID NO: 245 - DNA, 25 bp, Artificial Sequence
  Synthetic oligonucleotide
aacagauccaauugaaaggaacugt

SEQ ID NO: 246 - DNA, 25 bp, Artificial Sequence
  Synthetic oligonucleotide
acagauccaauugaaaggaacugtt

SEQ ID NO: 247 - DNA, 25 bp, Artificial Sequence
  Synthetic oligonucleotide
cagauccaauugaaaggaacugutt

SEQ ID NO: 248 - DNA, 25 bp, Artificial Sequence
  Synthetic oligonucleotide
agauccaauugaaaggaacuguuta

SEQ ID NO: 249 - DNA, 25 bp, Artificial Sequence
  Synthetic oligonucleotide
gauccaauugaaaggaacuguuuac

SEQ ID NO: 250 - DNA, 25 bp, Artificial Sequence
  Synthetic oligonucleotide
auccaauugaaaggaacuguuuaca

SEQ ID NO: 251 - DNA, 25 bp, Artificial Sequence
  Synthetic oligonucleotide
uccaauugaaaggaacuguuuacaa

SEQ ID NO: 252 - DNA, 25 bp, Artificial Sequence
  Synthetic oligonucleotide
ccaauugaaaggaacuguuuacaac

SEQ ID NO: 253 - DNA, 25 bp, Artificial Sequence
  Synthetic oligonucleotide
caauugaaaggaacuguuuacaact

SEQ ID NO: 254 - DNA, 25 bp, Artificial Sequence
  Synthetic oligonucleotide
aauugaaaggaacuguuuacaacta

SEQ ID NO: 255 - DNA, 25 bp, Artificial Sequence
  Synthetic oligonucleotide
auugaaaggaacuguuuacaacuat

SEQ ID NO: 256 - DNA, 25 bp, Artificial Sequence
  Synthetic oligonucleotide
uugaaaggaacuguuuacaacuata

SEQ ID NO: 257 - DNA, 25 bp, Artificial Sequence
  Synthetic oligonucleotide
ugaaaggaacuguuuacaacuauag

SEQ ID NO: 258 - DNA, 25 bp, Artificial Sequence
  Synthetic oligonucleotide
gaaaggaacuguuuacaacuauagg

SEQ ID NO: 259 - DNA, 25 bp, Artificial Sequence
  Synthetic oligonucleotide
aaaggaacuguuuacaacuauagga

SEQ ID NO: 260 - DNA, 25 bp, Artificial Sequence
  Synthetic oligonucleotide
aaggaacuguuuacaacuauaggac

SEQ ID NO: 261 - DNA, 25 bp, Artificial Sequence
  Synthetic oligonucleotide
aggaacuguuuacaacuauaggact

SEQ ID NO: 262 - DNA, 25 bp, Artificial Sequence
  Synthetic oligonucleotide
ggaacuguuuacaacuauaggactt

SEQ ID NO: 263 - DNA, 25 bp, Artificial Sequence
  Synthetic oligonucleotide
guuaaaaugucugcuguggagggaa

SEQ ID NO: 264 - DNA, 25 bp, Artificial Sequence
  Synthetic oligonucleotide
uuaaaaugucugcuguggagggaat

SEQ ID NO: 265 - DNA, 25 bp, Artificial Sequence
  Synthetic oligonucleotide
uaaaaugucugcuguggagggaatc

SEQ ID NO: 266 - DNA, 25 bp, Artificial Sequence
  Synthetic oligonucleotide
aaaaugucugcuguggagggaauct

SEQ ID NO: 267 - DNA, 25 bp, Artificial Sequence
  Synthetic oligonucleotide
aaaugucugcuguggagggaauctg

SEQ ID NO: 268 - DNA, 25 bp, Artificial Sequence
  Synthetic oligonucleotide
ugcuuccucuggaaauuggccuuca

SEQ ID NO: 269 - DNA, 25 bp, Artificial Sequence
  Synthetic oligonucleotide
gcuuccucuggaaauuggccuucac

SEQ ID NO: 270 - DNA, 25 bp, Artificial Sequence
  Synthetic oligonucleotide
cuuccucuggaaauuggccuucaca

SEQ ID NO: 271 - DNA, 25 bp, Artificial Sequence
  Synthetic oligonucleotide
uuccucuggaaauuggccuucacaa

SEQ ID NO: 272 - DNA, 25 bp, Artificial Sequence
  Synthetic oligonucleotide
uccucuggaaauuggccuucacaac

SEQ ID NO: 273 - DNA, 25 bp, Artificial Sequence
  Synthetic oligonucleotide
ccucuggaaauuggccuucacaaca

SEQ ID NO: 274 - DNA, 25 bp, Artificial Sequence
  Synthetic oligonucleotide
cucuggaaauuggccuucacaacat

SEQ ID NO: 275 - DNA, 25 bp, Artificial Sequence
  Synthetic oligonucleotide
ucuggaaauuggccuucacaacatc

SEQ ID NO: 276 - DNA, 25 bp, Artificial Sequence
  Synthetic oligonucleotide
agaaaucaaaaggauuuugagugta

SEQ ID NO: 277 - DNA, 25 bp, Artificial Sequence
  Synthetic oligonucleotide
gaaaucaaaaggauuuugaguguaa

SEQ ID NO: 278 - DNA, 25 bp, Artificial Sequence
  Synthetic oligonucleotide
caaaaggauuuugaguguaaaagga

SEQ ID NO: 279 - DNA, 25 bp, Artificial Sequence
  Synthetic oligonucleotide
auccuaacccaccuccccaaaggga

SEQ ID NO: 280 - DNA, 25 bp, Artificial Sequence
  Synthetic oligonucleotide
uccuaacccaccuccccaaagggag

SEQ ID NO: 281 - DNA, 25 bp, Artificial Sequence
  Synthetic oligonucleotide
ccaguauucuauguuuuucacuacc

SEQ ID NO: 282 - DNA, 25 bp, Artificial Sequence
  Synthetic oligonucleotide
aggaaaucauuggaacauuuuucat

SEQ ID NO: 283 - DNA, 25 bp, Artificial Sequence
  Synthetic oligonucleotide
ggaaaucauuggaacauuuuucatt

SEQ ID NO: 284 - DNA, 25 bp, Artificial Sequence
  Synthetic oligonucleotide
gagcauuauguccuacagaaaugct

SEQ ID NO: 285 - DNA, 25 bp, Artificial Sequence
  Synthetic oligonucleotide
cuugguuaacagcuuuugcuuuaag

SEQ ID NO: 286 - DNA, 25 bp, Artificial Sequence
  Synthetic oligonucleotide
gguuaacagcuuuugcuuuaagagt

SEQ ID NO: 287 - DNA, 25 bp, Artificial Sequence
  Synthetic oligonucleotide
guuaacagcuuuugcuuuaagagta

SEQ ID NO: 288 - DNA, 25 bp, Artificial Sequence
  Synthetic oligonucleotide
gcuuuaagaguacuuggacaaguaa

SEQ ID NO: 289 - DNA, 25 bp, Artificial Sequence
  Synthetic oligonucleotide
cuuuaagaguacuuggacaaguaaa

SEQ ID NO: 290 - DNA, 25 bp, Artificial Sequence
  Synthetic oligonucleotide
uaagaguacuuggacaaguaaauaa

SEQ ID NO: 291 - DNA, 25 bp, Artificial Sequence
  Synthetic oligonucleotide
aagaguacuuggacaaguaaauaaa

SEQ ID NO: 292 - DNA, 25 bp, Artificial Sequence
  Synthetic oligonucleotide
uagagcagaaccaaaauucaauutg

SEQ ID NO: 293 - DNA, 25 bp, Artificial Sequence
  Synthetic oligonucleotide
agagcagaaccaaaauucaauuugt

SEQ ID NO: 294 - DNA, 25 bp, Artificial Sequence
  Synthetic oligonucleotide
gagcagaaccaaaauucaauuugta

SEQ ID NO: 295 - DNA, 25 bp, Artificial Sequence
  Synthetic oligonucleotide
agcagaaccaaaauucaauuuguaa

SEQ ID NO: 296 - DNA, 25 bp, Artificial Sequence
  Synthetic oligonucleotide
cacaguaucaaccaauaaaauuaca

SEQ ID NO: 297 - DNA, 25 bp, Artificial Sequence
  Synthetic oligonucleotide
accaauaaaauuacaggguaccutg

SEQ ID NO: 298 - DNA, 25 bp, Artificial Sequence
  Synthetic oligonucleotide
ccaauaaaauuacaggguaccuugc

SEQ ID NO: 299 - DNA, 25 bp, Artificial Sequence
  Synthetic oligonucleotide
caauaaaauuacaggguaccuugcc

SEQ ID NO: 300 - DNA, 25 bp, Artificial Sequence
  Synthetic oligonucleotide
cugugauuggaauuagaaaggcutt

SEQ ID NO: 301 - DNA, 25 bp, Artificial Sequence
  Synthetic oligonucleotide
ugugauuggaauuagaaaggcuutc

SEQ ID NO: 302 - DNA, 25 bp, Artificial Sequence
  Synthetic oligonucleotide
gugauuggaauuagaaaggcuuucg

SEQ ID NO: 303 - DNA, 25 bp, Artificial Sequence
  Synthetic oligonucleotide
ugauuggaauuagaaaggcuuucga

SEQ ID NO: 304 - DNA, 25 bp, Artificial Sequence
  Synthetic oligonucleotide
uucaauuguuucagcuuugaagaga

SEQ ID NO: 305 - DNA, 25 bp, Artificial Sequence
  Synthetic oligonucleotide
gaagagagaagcuuugguuaaaggt

SEQ ID NO: 306 - DNA, 25 bp, Artificial Sequence
  Synthetic oligonucleotide
aagagagaagcuuugguuaaaggta

SEQ ID NO: 307 - DNA, 25 bp, Artificial Sequence
  Synthetic oligonucleotide
agagagaagcuuugguuaaagguaa

SEQ ID NO: 308 - DNA, 25 bp, Artificial Sequence
  Synthetic oligonucleotide
agaagcuuugguuaaagguaaucca

SEQ ID NO: 309 - DNA, 25 bp, Artificial Sequence
  Synthetic oligonucleotide
gaagcuuugguuaaagguaauccac

SEQ ID NO: 310 - DNA, 25 bp, Artificial Sequence
  Synthetic oligonucleotide
ccauuuaucguuuuuggaaagacaa

SEQ ID NO: 311 - DNA, 25 bp, Artificial Sequence
  Synthetic oligonucleotide
gcuuuacucaccagucugaacuuga

SEQ ID NO: 312 - DNA, 25 bp, Artificial Sequence
  Synthetic oligonucleotide
cuuuacucaccagucugaacuugaa

SEQ ID NO: 313 - DNA, 25 bp, Artificial Sequence
  Synthetic oligonucleotide
cucaccagucugaacuugaaagata

SEQ ID NO: 314 - DNA, 25 bp, Artificial Sequence
  Synthetic oligonucleotide
ccagucugaacuugaaagauauaaa

SEQ ID NO: 315 - DNA, 25 bp, Artificial Sequence
  Synthetic oligonucleotide
gaagagcagagguauggagguggct

SEQ ID NO: 316 - DNA, 25 bp, Artificial Sequence
  Synthetic oligonucleotide
aagagcagagguauggagguggctt

SEQ ID NO: 317 - DNA, 25 bp, Artificial Sequence
  Synthetic oligonucleotide
gaauauucacuccugguuaaacaac

SEQ ID NO: 318 - DNA, 25 bp, Artificial Sequence
  Synthetic oligonucleotide
ccuuacauaauuauaaaaugacaga

SEQ ID NO: 319 - DNA, 25 bp, Artificial Sequence
  Synthetic oligonucleotide
cauguaacaacuguaguucacaaaa

SEQ ID NO: 320 - DNA, 25 bp, Artificial Sequence
  Synthetic oligonucleotide
gaggaaguuugcagcuuuuauuuga

SEQ ID NO: 321 - DNA, 25 bp, Artificial Sequence
  Synthetic oligonucleotide
aggaaguuugcagcuuuuauuugaa

SEQ ID NO: 322 - DNA, 25 bp, Artificial Sequence
  Synthetic oligonucleotide
ggaaguuugcagcuuuuauuugaaa

SEQ ID NO: 323 - DNA, 25 bp, Artificial Sequence
  Synthetic oligonucleotide
gaaguuugcagcuuuuauuugaaaa

SEQ ID NO: 324 - DNA, 25 bp, Artificial Sequence
  Synthetic oligonucleotide
aaguuugcagcuuuuauuugaaaat

SEQ ID NO: 325 - DNA, 25 bp, Artificial Sequence
  Synthetic oligonucleotide
aguuugcagcuuuuauuugaaaatc

SEQ ID NO: 326 - DNA, 25 bp, Artificial Sequence
  Synthetic oligonucleotide
guuugcagcuuuuauuugaaaaucg

SEQ ID NO: 327 - DNA, 25 bp, Artificial Sequence
  Synthetic oligonucleotide
uuugcagcuuuuauuugaaaaucga

SEQ ID NO: 328 - DNA, 25 bp, Artificial Sequence
  Synthetic oligonucleotide
gcagcuuuuauuugaaaaucgauac

SEQ ID NO: 329 - DNA, 25 bp, Artificial Sequence
  Synthetic oligonucleotide
auacucaggauauugaagcauccca

SEQ ID NO: 330 - DNA, 25 bp, Artificial Sequence
  Synthetic oligonucleotide
caggauauugaagcaucccacuaca

SEQ ID NO: 331 - DNA, 25 bp, Artificial Sequence
  Synthetic oligonucleotide
uagcaugugccagcuacaagcccag

SEQ ID NO: 332 - DNA, 25 bp, Artificial Sequence
  Synthetic oligonucleotide
agcaugugccagcuacaagcccagc

SEQ ID NO: 333 - DNA, 25 bp, Artificial Sequence
  Synthetic oligonucleotide
gcaugugccagcuacaagcccagca

SEQ ID NO: 334 - DNA, 25 bp, Artificial Sequence
  Synthetic oligonucleotide
caugugccagcuacaagcccagcag

SEQ ID NO: 335 - DNA, 25 bp, Artificial Sequence
  Synthetic oligonucleotide
augugccagcuacaagcccagcagg

SEQ ID NO: 336 - DNA, 25 bp, Artificial Sequence
  Synthetic oligonucleotide
ugugccagcuacaagcccagcaggg

SEQ ID NO: 337 - DNA, 25 bp, Artificial Sequence
  Synthetic oligonucleotide
gugccagcuacaagcccagcaggga

SEQ ID NO: 338 - DNA, 25 bp, Artificial Sequence
  Synthetic oligonucleotide
ugccagcuacaagcccagcagggaa

SEQ ID NO: 339 - DNA, 25 bp, Artificial Sequence
  Synthetic oligonucleotide
gccagcuacaagcccagcagggaag

SEQ ID NO: 340 - DNA, 25 bp, Artificial Sequence
  Synthetic oligonucleotide
gauggacauguuauucugcaacuga

SEQ ID NO: 341 - DNA, 25 bp, Artificial Sequence
  Synthetic oligonucleotide
auggacauguuauucugcaacugaa

SEQ ID NO: 342 - DNA, 25 bp, Artificial Sequence
  Synthetic oligonucleotide
ggacauguuauucugcaacugaatt

SEQ ID NO: 343 - DNA, 25 bp, Artificial Sequence
  Synthetic oligonucleotide
acauguuauucugcaacugaauucg

SEQ ID NO: 344 - DNA, 25 bp, Artificial Sequence
  Synthetic oligonucleotide
cauguuauucugcaacugaauucga

SEQ ID NO: 345 - DNA, 25 bp, Artificial Sequence
  Synthetic oligonucleotide
auguuauucugcaacugaauucgat

SEQ ID NO: 346 - DNA, 25 bp, Artificial Sequence
  Synthetic oligonucleotide
auucugcaacugaauucgauuccct

SEQ ID NO: 347 - DNA, 25 bp, Artificial Sequence
  Synthetic oligonucleotide
uucugcaacugaauucgauuccctc

SEQ ID NO: 348 - DNA, 25 bp, Artificial Sequence
  Synthetic oligonucleotide
gauaaacaguguaccauguuuuata

SEQ ID NO: 349 - DNA, 25 bp, Artificial Sequence
  Synthetic oligonucleotide
auaaacaguguaccauguuuuauag

SEQ ID NO: 350 - DNA, 25 bp, Artificial Sequence
  Synthetic oligonucleotide
aaacaguguaccauguuuuauagca

SEQ ID NO: 351 - DNA, 25 bp, Artificial Sequence
  Synthetic oligonucleotide
acaguguaccauguuuuauagcact

SEQ ID NO: 352 - DNA, 25 bp, Artificial Sequence
  Synthetic oligonucleotide
auagcacuuccaauaucaaaauuca

SEQ ID NO: 353 - DNA, 25 bp, Artificial Sequence
  Synthetic oligonucleotide
uucagaaagucugugaaggagccgc

SEQ ID NO: 354 - DNA, 25 bp, Artificial Sequence
  Synthetic oligonucleotide
ucagaaagucugugaaggagccgcg

SEQ ID NO: 355 - DNA, 25 bp, Artificial Sequence
  Synthetic oligonucleotide
cagaaagucugugaaggagccgcgt

SEQ ID NO: 356 - DNA, 25 bp, Artificial Sequence
  Synthetic oligonucleotide
agaaagucugugaaggagccgcgtg

SEQ ID NO: 357 - DNA, 25 bp, Artificial Sequence
  Synthetic oligonucleotide
ccagagauugcauaugcuuauaaag

SEQ ID NO: 358 - DNA, 25 bp, Artificial Sequence
  Synthetic oligonucleotide
cagagauugcauaugcuuauaaagt

SEQ ID NO: 359 - DNA, 25 bp, Artificial Sequence
  Synthetic oligonucleotide
agagauugcauaugcuuauaaagtt

SEQ ID NO: 360 - DNA, 25 bp, Artificial Sequence
  Synthetic oligonucleotide
gagauugcauaugcuuauaaaguta

SEQ ID NO: 361 - DNA, 25 bp, Artificial Sequence
  Synthetic oligonucleotide
agauugcauaugcuuauaaaguuag

SEQ ID NO: 362 - DNA, 25 bp, Artificial Sequence
  Synthetic oligonucleotide
agaaaauguuuuugucaaguacaag

SEQ ID NO: 363 - DNA, 25 bp, Artificial Sequence
  Synthetic oligonucleotide
gaaaauguuuuugucaaguacaagg

SEQ ID NO: 364 - DNA, 25 bp, Artificial Sequence
  Synthetic oligonucleotide
aaaauguuuuugucaaguacaaggc

SEQ ID NO: 365 - DNA, 25 bp, Artificial Sequence
  Synthetic oligonucleotide
aaauguuuuugucaaguacaaggca

SEQ ID NO: 366 - DNA, 25 bp, Artificial Sequence
  Synthetic oligonucleotide
aauguuuuugucaaguacaaggcaa

SEQ ID NO: 367 - DNA, 25 bp, Artificial Sequence
  Synthetic oligonucleotide
ccagauaaaauacaauuucaguutc

SEQ ID NO: 368 - DNA, 25 bp, Artificial Sequence
  Synthetic oligonucleotide
auguucaucgugucaagcauuuuta

SEQ ID NO: 369 - DNA, 25 bp, Artificial Sequence
  Synthetic oligonucleotide
caucgugucaagcauuuuuagcuaa

SEQ ID NO: 370 - DNA, 25 bp, Artificial Sequence
  Synthetic oligonucleotide
gugucaagcauuuuuagcuaauuta

SEQ ID NO: 371 - DNA, 25 bp, Artificial Sequence
  Synthetic oligonucleotide
aagcauuuuuagcuaauuuagauga

SEQ ID NO: 372 - DNA, 25 bp, Artificial Sequence
  Synthetic oligonucleotide
uggaugcuaaaauuccugaaguuca

SEQ ID NO: 373 - DNA, 25 bp, Artificial Sequence
  Synthetic oligonucleotide
auggacuccuguuguugaaguucgt

SEQ ID NO: 374 - DNA, 25 bp, Artificial Sequence
  Synthetic oligonucleotide
ggacuccuguuguugaaguucgutt

SEQ ID NO: 375 - DNA, 25 bp, Artificial Sequence
  Synthetic oligonucleotide
gacuccuguuguugaaguucguutt

SEQ ID NO: 376 - DNA, 25 bp, Artificial Sequence
  Synthetic oligonucleotide
uugcuuuuauuagagaaugauuuca

SEQ ID NO: 377 - DNA, 25 bp, Artificial Sequence
  Synthetic oligonucleotide
ugcuuuuauuagagaaugauuucaa

SEQ ID NO: 378 - DNA, 25 bp, Artificial Sequence
  Synthetic oligonucleotide
gcuuuuauuagagaaugauuucaaa

SEQ ID NO: 379 - DNA, 25 bp, Artificial Sequence
  Synthetic oligonucleotide
cuuuuauuagagaaugauuucaaat

SEQ ID NO: 380 - DNA, 25 bp, Artificial Sequence
  Synthetic oligonucleotide
cagauacuccuccaagguuauugga

SEQ ID NO: 381 - DNA, 25 bp, Artificial Sequence
  Synthetic oligonucleotide
cauuaaagccugaguuugcuuucaa

SEQ ID NO: 382 - DNA, 25 bp, Artificial Sequence
  Synthetic oligonucleotide
auuaaagccugaguuugcuuucaaa

SEQ ID NO: 383 - DNA, 25 bp, Artificial Sequence
  Synthetic oligonucleotide
aaagccugaguuugcuuucaaaaaa

SEQ ID NO: 384 - DNA, 25 bp, Artificial Sequence
  Synthetic oligonucleotide
aagccugaguuugcuuucaaaaaaa

SEQ ID NO: 385 - RNA, 27 nt, Artificial Sequence
  Synthetic oligonucleotide
uauuuuuggugcugaaaugacauaugu

SEQ ID NO: 386 - RNA, 27 nt, Artificial Sequence
  Synthetic oligonucleotide
uguauccauaaacuugaaucacaauau

SEQ ID NO: 387 - RNA, 27 nt, Artificial Sequence
  Synthetic oligonucleotide
guguauccauaaacuugaaucacaaua

SEQ ID NO: 388 - RNA, 27 nt, Artificial Sequence
  Synthetic oligonucleotide
aguguauccauaaacuugaaucacaau

SEQ ID NO: 389 - RNA, 27 nt, Artificial Sequence
  Synthetic oligonucleotide
caguguauccauaaacuugaaucacaa

SEQ ID NO: 390 - RNA, 27 nt, Artificial Sequence
  Synthetic oligonucleotide
ucaguguauccauaaacuugaaucaca

SEQ ID NO: 391 - RNA, 27 nt, Artificial Sequence
  Synthetic oligonucleotide
uucaguguauccauaaacuugaaucac

SEQ ID NO: 392 - RNA, 27 nt, Artificial Sequence
  Synthetic oligonucleotide
cuucaguguauccauaaacuugaauca

SEQ ID NO: 393 - RNA, 27 nt, Artificial Sequence
  Synthetic oligonucleotide
gcuucaguguauccauaaacuugaauc

SEQ ID NO: 394 - RNA, 27 nt, Artificial Sequence
  Synthetic oligonucleotide
ugcuucaguguauccauaaacuugaau

SEQ ID NO: 395 - RNA, 27 nt, Artificial Sequence
  Synthetic oligonucleotide
augcuucaguguauccauaaacuugaa

SEQ ID NO: 396 - RNA, 27 nt, Artificial Sequence
  Synthetic oligonucleotide
aaugcuucaguguauccauaaacuuga

SEQ ID NO: 397 - RNA, 27 nt, Artificial Sequence
  Synthetic oligonucleotide
aaaugcuucaguguauccauaaacuug

SEQ ID NO: 398 - RNA, 27 nt, Artificial Sequence
  Synthetic oligonucleotide
ucaaaugcuucaguguauccauaaacu

SEQ ID NO: 399 - RNA, 27 nt, Artificial Sequence
  Synthetic oligonucleotide
aucaaaugcuucaguguauccauaaac

SEQ ID NO: 400 - RNA, 27 nt, Artificial Sequence
  Synthetic oligonucleotide
gcaucaaaugcuucaguguauccauaa

SEQ ID NO: 401 - RNA, 27 nt, Artificial Sequence
  Synthetic oligonucleotide
uugcaucaaaugcuucaguguauccau

SEQ ID NO: 402 - RNA, 27 nt, Artificial Sequence
  Synthetic oligonucleotide
guugcaucaaaugcuucaguguaucca

SEQ ID NO: 403 - RNA, 27 nt, Artificial Sequence
  Synthetic oligonucleotide
uguugcaucaaaugcuucaguguaucc

SEQ ID NO: 404 - RNA, 27 nt, Artificial Sequence
  Synthetic oligonucleotide
uuguugcaucaaaugcuucaguguauc

SEQ ID NO: 405 - RNA, 27 nt, Artificial Sequence
  Synthetic oligonucleotide
auuguugcaucaaaugcuucaguguau

SEQ ID NO: 406 - RNA, 27 nt, Artificial Sequence
  Synthetic oligonucleotide
gauuguugcaucaaaugcuucagugua

SEQ ID NO: 407 - RNA, 27 nt, Artificial Sequence
  Synthetic oligonucleotide
agauuguugcaucaaaugcuucagugu

SEQ ID NO: 408 - RNA, 27 nt, Artificial Sequence
  Synthetic oligonucleotide
gagauuguugcaucaaaugcuucagug

SEQ ID NO: 409 - RNA, 27 nt, Artificial Sequence
  Synthetic oligonucleotide
uagagauuguugcaucaaaugcuucag

SEQ ID NO: 410 - RNA, 27 nt, Artificial Sequence
  Synthetic oligonucleotide
aauagagauuguugcaucaaaugcuuc

SEQ ID NO: 411 - RNA, 27 nt, Artificial Sequence
  Synthetic oligonucleotide
uuaauagagauuguugcaucaaaugcu

SEQ ID NO: 412 - RNA, 27 nt, Artificial Sequence
  Synthetic oligonucleotide
acuuuuaauagagauuguugcaucaaa

SEQ ID NO: 413 - RNA, 27 nt, Artificial Sequence
  Synthetic oligonucleotide
aacuuuuaauagagauuguugcaucaa

SEQ ID NO: 414 - RNA, 27 nt, Artificial Sequence
  Synthetic oligonucleotide
uaacuuuuaauagagauuguugcauca

SEQ ID NO: 415 - RNA, 27 nt, Artificial Sequence
  Synthetic oligonucleotide
auaacuuuuaauagagauuguugcauc

SEQ ID NO: 416 - RNA, 27 nt, Artificial Sequence
  Synthetic oligonucleotide
caggauaacuuuuaauagagauuguug

SEQ ID NO: 417 - RNA, 27 nt, Artificial Sequence
  Synthetic oligonucleotide
ucaggauaacuuuuaauagagauuguu

SEQ ID NO: 418 - RNA, 27 nt, Artificial Sequence
  Synthetic oligonucleotide
uuuuuaucaggauaacuuuuaauagag

SEQ ID NO: 419 - RNA, 27 nt, Artificial Sequence
  Synthetic oligonucleotide
auuuuuuaucaggauaacuuuuaauag

SEQ ID NO: 420 - RNA, 27 nt, Artificial Sequence
  Synthetic oligonucleotide
uaaauuuuuuaucaggauaacuuuuaa

SEQ ID NO: 421 - RNA, 27 nt, Artificial Sequence
  Synthetic oligonucleotide
cuaaauuuuuuaucaggauaacuuuua

SEQ ID NO: 422 - RNA, 27 nt, Artificial Sequence
  Synthetic oligonucleotide
uaacuaaauuuuuuaucaggauaacuu

SEQ ID NO: 423 - RNA, 27 nt, Artificial Sequence
  Synthetic oligonucleotide
guaacuaaauuuuuuaucaggauaacu

SEQ ID NO: 424 - RNA, 27 nt, Artificial Sequence
  Synthetic oligonucleotide
auuuauucucugaggauaaaugaacau

SEQ ID NO: 425 - RNA, 27 nt, Artificial Sequence
  Synthetic oligonucleotide
aauuuauucucugaggauaaaugaaca

SEQ ID NO: 426 - RNA, 27 nt, Artificial Sequence
  Synthetic oligonucleotide
augcuuugauacaacuuccaaauacac

SEQ ID NO: 427 - RNA, 27 nt, Artificial Sequence
  Synthetic oligonucleotide
aaugcuuugauacaacuuccaaauaca

SEQ ID NO: 428 - RNA, 27 nt, Artificial Sequence
  Synthetic oligonucleotide
aaaaaugcuuugauacaacuuccaaau

SEQ ID NO: 429 - RNA, 27 nt, Artificial Sequence
  Synthetic oligonucleotide
gaaaaaugcuuugauacaacuuccaaa

SEQ ID NO: 430 - RNA, 27 nt, Artificial Sequence
  Synthetic oligonucleotide
ugaaaaaugcuuugauacaacuuccaa

SEQ ID NO: 431 - RNA, 27 nt, Artificial Sequence
  Synthetic oligonucleotide
uugaaaaaugcuuugauacaacuucca

SEQ ID NO: 432 - RNA, 27 nt, Artificial Sequence
  Synthetic oligonucleotide
uuugaaaaaugcuuugauacaacuucc

SEQ ID NO: 433 - RNA, 27 nt, Artificial Sequence
  Synthetic oligonucleotide
uuuugaaaaaugcuuugauacaacuuc

SEQ ID NO: 434 - RNA, 27 nt, Artificial Sequence
  Synthetic oligonucleotide
auuuugaaaaaugcuuugauacaacuu

SEQ ID NO: 435 - RNA, 27 nt, Artificial Sequence
  Synthetic oligonucleotide
gauuuugaaaaaugcuuugauacaacu

SEQ ID NO: 436 - RNA, 27 nt, Artificial Sequence
  Synthetic oligonucleotide
ugauuuugaaaaaugcuuugauacaac

SEQ ID NO: 437 - RNA, 27 nt, Artificial Sequence
  Synthetic oligonucleotide
uugauuuugaaaaaugcuuugauacaa

SEQ ID NO: 438 - RNA, 27 nt, Artificial Sequence
  Synthetic oligonucleotide
gagaaauccauugucauagguuauugg

SEQ ID NO: 439 - RNA, 27 nt, Artificial Sequence
  Synthetic oligonucleotide
aaugaagagaaauccauugucauaggu

SEQ ID NO: 440 - RNA, 27 nt, Artificial Sequence
  Synthetic oligonucleotide
uaugaaugaagagaaauccauugucau

SEQ ID NO: 441 - RNA, 27 nt, Artificial Sequence
  Synthetic oligonucleotide
guaugaaugaagagaaauccauuguca

SEQ ID NO: 442 - RNA, 27 nt, Artificial Sequence
  Synthetic oligonucleotide
uguaugaaugaagagaaauccauuguc

SEQ ID NO: 443 - RNA, 27 nt, Artificial Sequence
  Synthetic oligonucleotide
ucuguaugaaugaagagaaauccauug

SEQ ID NO: 444 - RNA, 27 nt, Artificial Sequence
  Synthetic oligonucleotide
gucuguaugaaugaagagaaauccauu

SEQ ID NO: 445 - RNA, 27 nt, Artificial Sequence
  Synthetic oligonucleotide
uugucuguaugaaugaagagaaaucca

SEQ ID NO: 446 - RNA, 27 nt, Artificial Sequence
  Synthetic oligonucleotide
uauaaacagguuugucuguaugaauga

SEQ ID NO: 447 - RNA, 27 nt, Artificial Sequence
  Synthetic oligonucleotide
aguauaaacagguuugucuguaugaau

SEQ ID NO: 448 - RNA, 27 nt, Artificial Sequence
  Synthetic oligonucleotide
gaguauaaacagguuugucuguaugaa

SEQ ID NO: 449 - RNA, 27 nt, Artificial Sequence
  Synthetic oligonucleotide
ggaguauaaacagguuugucuguauga

SEQ ID NO: 450 - RNA, 27 nt, Artificial Sequence
  Synthetic oligonucleotide
cgucauucaacgaauaaacucuaacuu

SEQ ID NO: 451 - RNA, 27 nt, Artificial Sequence
  Synthetic oligonucleotide
ucuuuuggcuggcuucaagucgucauu

SEQ ID NO: 452 - RNA, 27 nt, Artificial Sequence
  Synthetic oligonucleotide
cucuuuuggcuggcuucaagucgucau

SEQ ID NO: 453 - RNA, 27 nt, Artificial Sequence
  Synthetic oligonucleotide
ucucuuuuggcuggcuucaagucguca

SEQ ID NO: 454 - RNA, 27 nt, Artificial Sequence
  Synthetic oligonucleotide
uucucuuuuggcuggcuucaagucguc

SEQ ID NO: 455 - RNA, 27 nt, Artificial Sequence
  Synthetic oligonucleotide
aucuaugaaaguuaagacaguuucucu

SEQ ID NO: 456 - RNA, 27 nt, Artificial Sequence
  Synthetic oligonucleotide
caggaucuaugaaaguuaagacaguuu

SEQ ID NO: 457 - RNA, 27 nt, Artificial Sequence
  Synthetic oligonucleotide
ucaggaucuaugaaaguuaagacaguu

SEQ ID NO: 458 - RNA, 27 nt, Artificial Sequence
  Synthetic oligonucleotide
cuaccaugucaacuucugauccuucag

SEQ ID NO: 459 - RNA, 27 nt, Artificial Sequence
  Synthetic oligonucleotide
ucuaccaugucaacuucugauccuuca

SEQ ID NO: 460 - RNA, 27 nt, Artificial Sequence
  Synthetic oligonucleotide
uaugaucaauuucuucuaccaugucaa

SEQ ID NO: 461 - RNA, 27 nt, Artificial Sequence
  Synthetic oligonucleotide
auaugaucaauuucuucuaccauguca

SEQ ID NO: 462 - RNA, 27 nt, Artificial Sequence
  Synthetic oligonucleotide
uccaauaugaucaauuucuucuaccau

SEQ ID NO: 463 - RNA, 27 nt, Artificial Sequence
  Synthetic oligonucleotide
uuccaauaugaucaauuucuucuacca

SEQ ID NO: 464 - RNA, 27 nt, Artificial Sequence
  Synthetic oligonucleotide
auaauuccaauaugaucaauuucuucu

SEQ ID NO: 465 - RNA, 27 nt, Artificial Sequence
  Synthetic oligonucleotide
gauaauuccaauaugaucaauuucuuc

SEQ ID NO: 466 - RNA, 27 nt, Artificial Sequence
  Synthetic oligonucleotide
ugaagucaggaaaagagauaauuccaa

SEQ ID NO: 467 - RNA, 27 nt, Artificial Sequence
  Synthetic oligonucleotide
uugaagucaggaaaagagauaauucca

SEQ ID NO: 468 - RNA, 27 nt, Artificial Sequence
  Synthetic oligonucleotide
cuugaagucaggaaaagagauaauucc

SEQ ID NO: 469 - RNA, 27 nt, Artificial Sequence
  Synthetic oligonucleotide
ucuugaagucaggaaaagagauaauuc

SEQ ID NO: 470 - RNA, 27 nt, Artificial Sequence
  Synthetic oligonucleotide
aucuugaagucaggaaaagagauaauu

SEQ ID NO: 471 - RNA, 27 nt, Artificial Sequence
  Synthetic oligonucleotide
aaucuugaagucaggaaaagagauaau

SEQ ID NO: 472 - RNA, 27 nt, Artificial Sequence
  Synthetic oligonucleotide
gaaucuugaagucaggaaaagagauaa

SEQ ID NO: 473 - RNA, 27 nt, Artificial Sequence
  Synthetic oligonucleotide
ggaaucuugaagucaggaaaagagaua

SEQ ID NO: 474 - RNA, 27 nt, Artificial Sequence
  Synthetic oligonucleotide
cggaaucuugaagucaggaaaagagau

SEQ ID NO: 475 - RNA, 27 nt, Artificial Sequence
  Synthetic oligonucleotide
acggaaucuugaagucaggaaaagaga

SEQ ID NO: 476 - RNA, 27 nt, Artificial Sequence
  Synthetic oligonucleotide
gacggaaucuugaagucaggaaaagag

SEQ ID NO: 477 - RNA, 27 nt, Artificial Sequence
  Synthetic oligonucleotide
agacggaaucuugaagucaggaaaaga

SEQ ID NO: 478 - RNA, 27 nt, Artificial Sequence
  Synthetic oligonucleotide
uagacggaaucuugaagucaggaaaag

SEQ ID NO: 479 - RNA, 27 nt, Artificial Sequence
  Synthetic oligonucleotide
uuagacggaaucuugaagucaggaaaa

SEQ ID NO: 480 - RNA, 27 nt, Artificial Sequence
  Synthetic oligonucleotide
aaauguggcaagacauauucuuuaacu

SEQ ID NO: 481 - RNA, 27 nt, Artificial Sequence
  Synthetic oligonucleotide
aaaauguggcaagacauauucuuuaac

SEQ ID NO: 482 - RNA, 27 nt, Artificial Sequence
  Synthetic oligonucleotide
aaaaauguggcaagacauauucuuuaa

SEQ ID NO: 483 - RNA, 27 nt, Artificial Sequence
  Synthetic oligonucleotide
uaauuucaaaauucuuaaaguucuugu

SEQ ID NO: 484 - RNA, 27 nt, Artificial Sequence
  Synthetic oligonucleotide
guaauuucaaaauucuuaaaguucuug

SEQ ID NO: 485 - RNA, 27 nt, Artificial Sequence
  Synthetic oligonucleotide
uauaguaauuucaaaauucuuaaaguu

SEQ ID NO: 486 - RNA, 27 nt, Artificial Sequence
  Synthetic oligonucleotide
ugcuuuuauaguaauuucaaaauucuu

SEQ ID NO: 487 - RNA, 27 nt, Artificial Sequence
  Synthetic oligonucleotide
uugcuuuuauaguaauuucaaaauucu

SEQ ID NO: 488 - RNA, 27 nt, Artificial Sequence
  Synthetic oligonucleotide
cuugcuuuuauaguaauuucaaaauuc

SEQ ID NO: 489 - RNA, 27 nt, Artificial Sequence
  Synthetic oligonucleotide
uaucuugcuuuuauaguaauuucaaaa

SEQ ID NO: 490 - RNA, 27 nt, Artificial Sequence
  Synthetic oligonucleotide
auaucuugcuuuuauaguaauuucaaa

SEQ ID NO: 491 - RNA, 27 nt, Artificial Sequence
  Synthetic oligonucleotide
aauaucuugcuuuuauaguaauuucaa

SEQ ID NO: 492 - RNA, 27 nt, Artificial Sequence
  Synthetic oligonucleotide
cuuuauuauaaaaauaucuugcuuuua

SEQ ID NO: 493 - RNA, 27 nt, Artificial Sequence
  Synthetic oligonucleotide
acuuuauuauaaaaauaucuugcuuuu

SEQ ID NO: 494 - RNA, 27 nt, Artificial Sequence
  Synthetic oligonucleotide
uacuuuauuauaaaaauaucuugcuuu

SEQ ID NO: 495 - RNA, 27 nt, Artificial Sequence
  Synthetic oligonucleotide
cuacuuuauuauaaaaauaucuugcuu

SEQ ID NO: 496 - RNA, 27 nt, Artificial Sequence
  Synthetic oligonucleotide
acuacuuuauuauaaaaauaucuugcu

SEQ ID NO: 497 - RNA, 27 nt, Artificial Sequence
  Synthetic oligonucleotide
gacuacuuuauuauaaaaauaucuugc

SEQ ID NO: 498 - RNA, 27 nt, Artificial Sequence
  Synthetic oligonucleotide
ugacuacuuuauuauaaaaauaucuug

SEQ ID NO: 499 - RNA, 27 nt, Artificial Sequence
  Synthetic oligonucleotide
gugacuacuuuauuauaaaaauaucuu

SEQ ID NO: 500 - RNA, 27 nt, Artificial Sequence
  Synthetic oligonucleotide
ugagcaauuccauuuaucaacauugug

SEQ ID NO: 501 - RNA, 27 nt, Artificial Sequence
  Synthetic oligonucleotide
uugagcaauuccauuuaucaacauugu

SEQ ID NO: 502 - RNA, 27 nt, Artificial Sequence
  Synthetic oligonucleotide
acuugagcaauuccauuuaucaacauu

SEQ ID NO: 503 - RNA, 27 nt, Artificial Sequence
  Synthetic oligonucleotide
gacuugagcaauuccauuuaucaacau

SEQ ID NO: 504 - RNA, 27 nt, Artificial Sequence
  Synthetic oligonucleotide
ugacuugagcaauuccauuuaucaaca

SEQ ID NO: 505 - RNA, 27 nt, Artificial Sequence
  Synthetic oligonucleotide
augugacuugagcaauuccauuuauca

SEQ ID NO: 506 - RNA, 27 nt, Artificial Sequence
  Synthetic oligonucleotide
ucaaaugugacuugagcaauuccauuu

SEQ ID NO: 507 - RNA, 27 nt, Artificial Sequence
  Synthetic oligonucleotide
guuucagaaucaaaugugacuugagca

SEQ ID NO: 508 - RNA, 27 nt, Artificial Sequence
  Synthetic oligonucleotide
cuguuucagaaucaaaugugacuugag

SEQ ID NO: 509 - RNA, 27 nt, Artificial Sequence
  Synthetic oligonucleotide
gcuguuucagaaucaaaugugacuuga

SEQ ID NO: 510 - RNA, 27 nt, Artificial Sequence
  Synthetic oligonucleotide
ugcuguuucagaaucaaaugugacuug

SEQ ID NO: 511 - RNA, 27 nt, Artificial Sequence
  Synthetic oligonucleotide
uugacugcuguuucagaaucaaaugug

SEQ ID NO: 512 - RNA, 27 nt, Artificial Sequence
  Synthetic oligonucleotide
cuuugacugcuguuucagaaucaaaug

SEQ ID NO: 513 - RNA, 27 nt, Artificial Sequence
  Synthetic oligonucleotide
ucuuugacugcuguuucagaaucaaau

SEQ ID NO: 514 - RNA, 27 nt, Artificial Sequence
  Synthetic oligonucleotide
uaguaugacaguucuuugacugcuguu

SEQ ID NO: 515 - RNA, 27 nt, Artificial Sequence
  Synthetic oligonucleotide
uguaguaugacaguucuuugacugcug

SEQ ID NO: 516 - RNA, 27 nt, Artificial Sequence
  Synthetic oligonucleotide
aacuguaguaugacaguucuuugacug

SEQ ID NO: 517 - RNA, 27 nt, Artificial Sequence
  Synthetic oligonucleotide
ucuaaacuguaguaugacaguucuuug

SEQ ID NO: 518 - RNA, 27 nt, Artificial Sequence
  Synthetic oligonucleotide
uucuaaacuguaguaugacaguucuuu

SEQ ID NO: 519 - RNA, 27 nt, Artificial Sequence
  Synthetic oligonucleotide
ucuucuaaacuguaguaugacaguucu

SEQ ID NO: 520 - RNA, 27 nt, Artificial Sequence
  Synthetic oligonucleotide
caauauaaagguacuuguuguuuaaau

SEQ ID NO: 521 - RNA, 27 nt, Artificial Sequence
  Synthetic oligonucleotide
gcaauauaaagguacuuguuguuuaaa

SEQ ID NO: 522 - RNA, 27 nt, Artificial Sequence
  Synthetic oligonucleotide
agcaauauaaagguacuuguuguuuaa

SEQ ID NO: 523 - RNA, 27 nt, Artificial Sequence
  Synthetic oligonucleotide
cagcaauauaaagguacuuguuguuua

SEQ ID NO: 524 - RNA, 27 nt, Artificial Sequence
  Synthetic oligonucleotide
acagcaauauaaagguacuuguuguuu

SEQ ID NO: 525 - RNA, 27 nt, Artificial Sequence
  Synthetic oligonucleotide
uacagcaauauaaagguacuuguuguu

SEQ ID NO: 526 - RNA, 27 nt, Artificial Sequence
  Synthetic oligonucleotide
uuacagcaauauaaagguacuuguugu

SEQ ID NO: 527 - RNA, 27 nt, Artificial Sequence
  Synthetic oligonucleotide
guuacagcaauauaaagguacuuguug

SEQ ID NO: 528 - RNA, 27 nt, Artificial Sequence
  Synthetic oligonucleotide
uguuacagcaauauaaagguacuuguu

SEQ ID NO: 529 - RNA, 27 nt, Artificial Sequence
  Synthetic oligonucleotide
cuguuacagcaauauaaagguacuugu

SEQ ID NO: 530 - RNA, 27 nt, Artificial Sequence
  Synthetic oligonucleotide
acuguuacagcaauauaaagguacuug

SEQ ID NO: 531 - RNA, 27 nt, Artificial Sequence
  Synthetic oligonucleotide
gacuguuacagcaauauaaagguacuu

SEQ ID NO: 532 - RNA, 27 nt, Artificial Sequence
  Synthetic oligonucleotide
augacuguuacagcaauauaaagguac

SEQ ID NO: 533 - RNA, 27 nt, Artificial Sequence
  Synthetic oligonucleotide
uuguagggagagaggacauauuugaug

SEQ ID NO: 534 - RNA, 27 nt, Artificial Sequence
  Synthetic oligonucleotide
uagcaaccaaauucaguuuguagggag

SEQ ID NO: 535 - RNA, 27 nt, Artificial Sequence
  Synthetic oligonucleotide
ggaguagcaaccaaauucaguuuguag

SEQ ID NO: 536 - RNA, 27 nt, Artificial Sequence
  Synthetic oligonucleotide
aggaguagcaaccaaauucaguuugua

SEQ ID NO: 537 - RNA, 27 nt, Artificial Sequence
  Synthetic oligonucleotide
uuacaucaauuguuugugcauucagug

SEQ ID NO: 538 - RNA, 27 nt, Artificial Sequence
  Synthetic oligonucleotide
uuuacaucaauuguuugugcauucagu

SEQ ID NO: 539 - RNA, 27 nt, Artificial Sequence
  Synthetic oligonucleotide
uuggauccaagucagaugucucuuggu

SEQ ID NO: 540 - RNA, 27 nt, Artificial Sequence
  Synthetic oligonucleotide
cuuggauccaagucagaugucucuugg

SEQ ID NO: 541 - RNA, 27 nt, Artificial Sequence
  Synthetic oligonucleotide
augaguaugcuauugcucgguaaccuu

SEQ ID NO: 542 - RNA, 27 nt, Artificial Sequence
  Synthetic oligonucleotide
ucaauauaaagguaacuuuggcugaga

SEQ ID NO: 543 - RNA, 27 nt, Artificial Sequence
  Synthetic oligonucleotide
aucaauauaaagguaacuuuggcugag

SEQ ID NO: 544 - RNA, 27 nt, Artificial Sequence
  Synthetic oligonucleotide
aaucaauauaaagguaacuuuggcuga

SEQ ID NO: 545 - RNA, 27 nt, Artificial Sequence
  Synthetic oligonucleotide
caaucaauauaaagguaacuuuggcug

SEQ ID NO: 546 - RNA, 27 nt, Artificial Sequence
  Synthetic oligonucleotide
uuauuuugucaauauaugggcuuuugg

SEQ ID NO: 547 - RNA, 27 nt, Artificial Sequence
  Synthetic oligonucleotide
ugaguuauuuugucaauauaugggcuu

SEQ ID NO: 548 - RNA, 27 nt, Artificial Sequence
  Synthetic oligonucleotide
gugaguuauuuugucaauauaugggcu

SEQ ID NO: 549 - RNA, 27 nt, Artificial Sequence
  Synthetic oligonucleotide
uagugaguuauuuugucaauauauggg

SEQ ID NO: 550 - RNA, 27 nt, Artificial Sequence
  Synthetic oligonucleotide
auagugaguuauuuugucaauauaugg

SEQ ID NO: 551 - RNA, 27 nt, Artificial Sequence
  Synthetic oligonucleotide
uauagugaguuauuuugucaauauaug

SEQ ID NO: 552 - RNA, 27 nt, Artificial Sequence
  Synthetic oligonucleotide
aauuauagugaguuauuuugucaauau

SEQ ID NO: 553 - RNA, 27 nt, Artificial Sequence
  Synthetic oligonucleotide
guaauuauagugaguuauuuugucaau

SEQ ID NO: 554 - RNA, 27 nt, Artificial Sequence
  Synthetic oligonucleotide
aguaauuauagugaguuauuuugucaa

SEQ ID NO: 555 - RNA, 27 nt, Artificial Sequence
  Synthetic oligonucleotide
aaguaauuauagugaguuauuuuguca

SEQ ID NO: 556 - RNA, 27 nt, Artificial Sequence
  Synthetic oligonucleotide
caaguaauuauagugaguuauuuuguc

SEQ ID NO: 557 - RNA, 27 nt, Artificial Sequence
  Synthetic oligonucleotide
ucaaguaauuauagugaguuauuuugu

SEQ ID NO: 558 - RNA, 27 nt, Artificial Sequence
  Synthetic oligonucleotide
aucaaguaauuauagugaguuauuuug

SEQ ID NO: 559 - RNA, 27 nt, Artificial Sequence
  Synthetic oligonucleotide
aaucaaguaauuauagugaguuauuuu

SEQ ID NO: 560 - RNA, 27 nt, Artificial Sequence
  Synthetic oligonucleotide
aaaucaaguaauuauagugaguuauuu

SEQ ID NO: 561 - RNA, 27 nt, Artificial Sequence
  Synthetic oligonucleotide
aaaaucaaguaauuauagugaguuauu

SEQ ID NO: 562 - RNA, 27 nt, Artificial Sequence
  Synthetic oligonucleotide
uaaaaucaaguaauuauagugaguuau

SEQ ID NO: 563 - RNA, 27 nt, Artificial Sequence
  Synthetic oligonucleotide
auaaaaucaaguaauuauagugaguua

SEQ ID NO: 564 - RNA, 27 nt, Artificial Sequence
  Synthetic oligonucleotide
gauaaaaucaaguaauuauagugaguu

SEQ ID NO: 565 - RNA, 27 nt, Artificial Sequence
  Synthetic oligonucleotide
ggauaaaaucaaguaauuauagugagu

SEQ ID NO: 566 - RNA, 27 nt, Artificial Sequence
  Synthetic oligonucleotide
uggauaaaaucaaguaauuauagugag

SEQ ID NO: 567 - RNA, 27 nt, Artificial Sequence
  Synthetic oligonucleotide
uuggauaaaaucaaguaauuauaguga

SEQ ID NO: 568 - RNA, 27 nt, Artificial Sequence
  Synthetic oligonucleotide
cuuggauaaaaucaaguaauuauagug

SEQ ID NO: 569 - RNA, 27 nt, Artificial Sequence
  Synthetic oligonucleotide
ccuuggauaaaaucaaguaauuauagu

SEQ ID NO: 570 - RNA, 27 nt, Artificial Sequence
  Synthetic oligonucleotide
cccuuggauaaaaucaaguaauuauag

SEQ ID NO: 571 - RNA, 27 nt, Artificial Sequence
  Synthetic oligonucleotide
gcccuuggauaaaaucaaguaauuaua

SEQ ID NO: 572 - RNA, 27 nt, Artificial Sequence
  Synthetic oligonucleotide
ugcccuuggauaaaaucaaguaauuau

SEQ ID NO: 573 - RNA, 27 nt, Artificial Sequence
  Synthetic oligonucleotide
uugcccuuggauaaaaucaaguaauua

SEQ ID NO: 574 - RNA, 27 nt, Artificial Sequence
  Synthetic oligonucleotide
aauauuuaaccagacugaaucagacac

SEQ ID NO: 575 - RNA, 27 nt, Artificial Sequence
  Synthetic oligonucleotide
ucaauauuuaaccagacugaaucagac

SEQ ID NO: 576 - RNA, 27 nt, Artificial Sequence
  Synthetic oligonucleotide
uucaauauuuaaccagacugaaucaga

SEQ ID NO: 577 - RNA, 27 nt, Artificial Sequence
  Synthetic oligonucleotide
cuucaauauuuaaccagacugaaucag

SEQ ID NO: 578 - RNA, 27 nt, Artificial Sequence
  Synthetic oligonucleotide
ucuucaauauuuaaccagacugaauca

SEQ ID NO: 579 - RNA, 27 nt, Artificial Sequence
  Synthetic oligonucleotide
uuucuucaauauuuaaccagacugaau

SEQ ID NO: 580 - RNA, 27 nt, Artificial Sequence
  Synthetic oligonucleotide
uuuucuucaauauuuaaccagacugaa

SEQ ID NO: 581 - RNA, 27 nt, Artificial Sequence
  Synthetic oligonucleotide
uuuuucuucaauauuuaaccagacuga

SEQ ID NO: 582 - RNA, 27 nt, Artificial Sequence
  Synthetic oligonucleotide
auuuuucuucaauauuuaaccagacug

SEQ ID NO: 583 - RNA, 27 nt, Artificial Sequence
  Synthetic oligonucleotide
cauuuuucuucaauauuuaaccagacu

SEQ ID NO: 584 - RNA, 27 nt, Artificial Sequence
  Synthetic oligonucleotide
acauuuuucuucaauauuuaaccagac

SEQ ID NO: 585 - RNA, 27 nt, Artificial Sequence
  Synthetic oligonucleotide
cacauuuuucuucaauauuuaaccaga

SEQ ID NO: 586 - RNA, 27 nt, Artificial Sequence
  Synthetic oligonucleotide
ccacauuuuucuucaauauuuaaccag

SEQ ID NO: 587 - RNA, 27 nt, Artificial Sequence
  Synthetic oligonucleotide
gaugaaccuggagcugguugccacauu

SEQ ID NO: 588 - RNA, 27 nt, Artificial Sequence
  Synthetic oligonucleotide
agaugaaccuggagcugguugccacau

SEQ ID NO: 589 - RNA, 27 nt, Artificial Sequence
  Synthetic oligonucleotide
ggccaccaccugccccacagcccagau

SEQ ID NO: 590 - RNA, 27 nt, Artificial Sequence
  Synthetic oligonucleotide
aggccaccaccugccccacagcccaga

SEQ ID NO: 591 - RNA, 27 nt, Artificial Sequence
  Synthetic oligonucleotide
gaggccaccaccugccccacagcccag

SEQ ID NO: 592 - RNA, 27 nt, Artificial Sequence
  Synthetic oligonucleotide
ugaggccaccaccugccccacagccca

SEQ ID NO: 593 - RNA, 27 nt, Artificial Sequence
  Synthetic oligonucleotide
uugaggccaccaccugccccacagccc

SEQ ID NO: 594 - RNA, 27 nt, Artificial Sequence
  Synthetic oligonucleotide
guugaggccaccaccugccccacagcc

SEQ ID NO: 595 - RNA, 27 nt, Artificial Sequence
  Synthetic oligonucleotide
uguugaggccaccaccugccccacagc

SEQ ID NO: 596 - RNA, 27 nt, Artificial Sequence
  Synthetic oligonucleotide
uucuuuacaagguucaucauuuucuug

SEQ ID NO: 597 - RNA, 27 nt, Artificial Sequence
  Synthetic oligonucleotide
agaauuucuuuacaagguucaucauuu

SEQ ID NO: 598 - RNA, 27 nt, Artificial Sequence
  Synthetic oligonucleotide
ugagaauuucuuuacaagguucaucau

SEQ ID NO: 599 - RNA, 27 nt, Artificial Sequence
  Synthetic oligonucleotide
cugagaauuucuuuacaagguucauca

SEQ ID NO: 600 - RNA, 27 nt, Artificial Sequence
  Synthetic oligonucleotide
cuuggccugagaauuucuuuacaaggu

SEQ ID NO: 601 - RNA, 27 nt, Artificial Sequence
  Synthetic oligonucleotide
ucuuggccugagaauuucuuuacaagg

SEQ ID NO: 602 - RNA, 27 nt, Artificial Sequence
  Synthetic oligonucleotide
aucguaacaacauuucuucacuacuga

SEQ ID NO: 603 - RNA, 27 nt, Artificial Sequence
  Synthetic oligonucleotide
caucguaacaacauuucuucacuacug

SEQ ID NO: 604 - RNA, 27 nt, Artificial Sequence
  Synthetic oligonucleotide
cuugcuuacugguaacagggucuucau

SEQ ID NO: 605 - RNA, 27 nt, Artificial Sequence
  Synthetic oligonucleotide
aaaauaacuccgaauuucuggcuugcu

SEQ ID NO: 606 - RNA, 27 nt, Artificial Sequence
  Synthetic oligonucleotide
acaucuuugaacaccuuugccuugaca

SEQ ID NO: 607 - RNA, 27 nt, Artificial Sequence
  Synthetic oligonucleotide
gacaucuuugaacaccuuugccuugac

SEQ ID NO: 608 - RNA, 27 nt, Artificial Sequence
  Synthetic oligonucleotide
agacaucuuugaacaccuuugccuuga

SEQ ID NO: 609 - RNA, 27 nt, Artificial Sequence
  Synthetic oligonucleotide
aagacaucuuugaacaccuuugccuug

SEQ ID NO: 610 - RNA, 27 nt, Artificial Sequence
  Synthetic oligonucleotide
guauauucauuuccaggaagacaucuu

SEQ ID NO: 611 - RNA, 27 nt, Artificial Sequence
  Synthetic oligonucleotide
cagaauaugguauauucauuuccagga

SEQ ID NO: 612 - RNA, 27 nt, Artificial Sequence
  Synthetic oligonucleotide
acagaauaugguauauucauuuccagg

SEQ ID NO: 613 - RNA, 27 nt, Artificial Sequence
  Synthetic oligonucleotide
aacagaauaugguauauucauuuccag

SEQ ID NO: 614 - RNA, 27 nt, Artificial Sequence
  Synthetic oligonucleotide
caacagaauaugguauauucauuucca

SEQ ID NO: 615 - RNA, 27 nt, Artificial Sequence
  Synthetic oligonucleotide
acaacagaauaugguauauucauuucc

SEQ ID NO: 616 - RNA, 27 nt, Artificial Sequence
  Synthetic oligonucleotide
uacaacagaauaugguauauucauuuc

SEQ ID NO: 617 - RNA, 27 nt, Artificial Sequence
  Synthetic oligonucleotide
guacaacagaauaugguauauucauuu

SEQ ID NO: 618 - RNA, 27 nt, Artificial Sequence
  Synthetic oligonucleotide
cguacaacagaauaugguauauucauu

SEQ ID NO: 619 - RNA, 27 nt, Artificial Sequence
  Synthetic oligonucleotide
ucguacaacagaauaugguauauucau

SEQ ID NO: 620 - RNA, 27 nt, Artificial Sequence
  Synthetic oligonucleotide
cucguacaacagaauaugguauauuca

SEQ ID NO: 621 - RNA, 27 nt, Artificial Sequence
  Synthetic oligonucleotide
ccucguacaacagaauaugguauauuc

SEQ ID NO: 622 - RNA, 27 nt, Artificial Sequence
  Synthetic oligonucleotide
cuuucaauuggaucuguucuccucgua

SEQ ID NO: 623 - RNA, 27 nt, Artificial Sequence
  Synthetic oligonucleotide
ccuuucaauuggaucuguucuccucgu

SEQ ID NO: 624 - RNA, 27 nt, Artificial Sequence
  Synthetic oligonucleotide
uccuuucaauuggaucuguucuccucg

SEQ ID NO: 625 - RNA, 27 nt, Artificial Sequence
  Synthetic oligonucleotide
uuccuuucaauuggaucuguucuccuc

SEQ ID NO: 626 - RNA, 27 nt, Artificial Sequence
  Synthetic oligonucleotide
guuccuuucaauuggaucuguucuccu

SEQ ID NO: 627 - RNA, 27 nt, Artificial Sequence
  Synthetic oligonucleotide
aguuccuuucaauuggaucuguucucc

SEQ ID NO: 628 - RNA, 27 nt, Artificial Sequence
  Synthetic oligonucleotide
caguuccuuucaauuggaucuguucuc

SEQ ID NO: 629 - RNA, 27 nt, Artificial Sequence
  Synthetic oligonucleotide
acaguuccuuucaauuggaucuguucu

SEQ ID NO: 630 - RNA, 27 nt, Artificial Sequence
  Synthetic oligonucleotide
aacaguuccuuucaauuggaucuguuc

SEQ ID NO: 631 - RNA, 27 nt, Artificial Sequence
  Synthetic oligonucleotide
aaacaguuccuuucaauuggaucuguu

SEQ ID NO: 632 - RNA, 27 nt, Artificial Sequence
  Synthetic oligonucleotide
uaaacaguuccuuucaauuggaucugu

SEQ ID NO: 633 - RNA, 27 nt, Artificial Sequence
  Synthetic oligonucleotide
guaaacaguuccuuucaauuggaucug

SEQ ID NO: 634 - RNA, 27 nt, Artificial Sequence
  Synthetic oligonucleotide
uguaaacaguuccuuucaauuggaucu

SEQ ID NO: 635 - RNA, 27 nt, Artificial Sequence
  Synthetic oligonucleotide
uuguaaacaguuccuuucaauuggauc

SEQ ID NO: 636 - RNA, 27 nt, Artificial Sequence
  Synthetic oligonucleotide
guuguaaacaguuccuuucaauuggau

SEQ ID NO: 637 - RNA, 27 nt, Artificial Sequence
  Synthetic oligonucleotide
aguuguaaacaguuccuuucaauugga

SEQ ID NO: 638 - RNA, 27 nt, Artificial Sequence
  Synthetic oligonucleotide
uaguuguaaacaguuccuuucaauugg

SEQ ID NO: 639 - RNA, 27 nt, Artificial Sequence
  Synthetic oligonucleotide
auaguuguaaacaguuccuuucaauug

SEQ ID NO: 640 - RNA, 27 nt, Artificial Sequence
  Synthetic oligonucleotide
uauaguuguaaacaguuccuuucaauu

SEQ ID NO: 641 - RNA, 27 nt, Artificial Sequence
  Synthetic oligonucleotide
cuauaguuguaaacaguuccuuucaau

SEQ ID NO: 642 - RNA, 27 nt, Artificial Sequence
  Synthetic oligonucleotide
ccuauaguuguaaacaguuccuuucaa

SEQ ID NO: 643 - RNA, 27 nt, Artificial Sequence
  Synthetic oligonucleotide
uccuauaguuguaaacaguuccuuuca

SEQ ID NO: 644 - RNA, 27 nt, Artificial Sequence
  Synthetic oligonucleotide
guccuauaguuguaaacaguuccuuuc

SEQ ID NO: 645 - RNA, 27 nt, Artificial Sequence
  Synthetic oligonucleotide
aguccuauaguuguaaacaguuccuuu

SEQ ID NO: 646 - RNA, 27 nt, Artificial Sequence
  Synthetic oligonucleotide
aaguccuauaguuguaaacaguuccuu

SEQ ID NO: 647 - RNA, 27 nt, Artificial Sequence
  Synthetic oligonucleotide
uucccuccacagcagacauuuuaacac

SEQ ID NO: 648 - RNA, 27 nt, Artificial Sequence
  Synthetic oligonucleotide
auucccuccacagcagacauuuuaaca

SEQ ID NO: 649 - RNA, 27 nt, Artificial Sequence
  Synthetic oligonucleotide
gauucccuccacagcagacauuuuaac

SEQ ID NO: 650 - RNA, 27 nt, Artificial Sequence
  Synthetic oligonucleotide
agauucccuccacagcagacauuuuaa

SEQ ID NO: 651 - RNA, 27 nt, Artificial Sequence
  Synthetic oligonucleotide
cagauucccuccacagcagacauuuua

SEQ ID NO: 652 - RNA, 27 nt, Artificial Sequence
  Synthetic oligonucleotide
ugaaggccaauuuccagaggaagcaca

SEQ ID NO: 653 - RNA, 27 nt, Artificial Sequence
  Synthetic oligonucleotide
gugaaggccaauuuccagaggaagcac

SEQ ID NO: 654 - RNA, 27 nt, Artificial Sequence
  Synthetic oligonucleotide
ugugaaggccaauuuccagaggaagca

SEQ ID NO: 655 - RNA, 27 nt, Artificial Sequence
  Synthetic oligonucleotide
uugugaaggccaauuuccagaggaagc

SEQ ID NO: 656 - RNA, 27 nt, Artificial Sequence
  Synthetic oligonucleotide
guugugaaggccaauuuccagaggaag

SEQ ID NO: 657 - RNA, 27 nt, Artificial Sequence
  Synthetic oligonucleotide
uguugugaaggccaauuuccagaggaa

SEQ ID NO: 658 - RNA, 27 nt, Artificial Sequence
  Synthetic oligonucleotide
auguugugaaggccaauuuccagagga

SEQ ID NO: 659 - RNA, 27 nt, Artificial Sequence
  Synthetic oligonucleotide
gauguugugaaggccaauuuccagagg

SEQ ID NO: 660 - RNA, 27 nt, Artificial Sequence
  Synthetic oligonucleotide
uacacucaaaauccuuuugauuucugu

SEQ ID NO: 661 - RNA, 27 nt, Artificial Sequence
  Synthetic oligonucleotide
uuacacucaaaauccuuuugauuucug

SEQ ID NO: 662 - RNA, 27 nt, Artificial Sequence
  Synthetic oligonucleotide
uccuuuuacacucaaaauccuuuugau

SEQ ID NO: 663 - RNA, 27 nt, Artificial Sequence
  Synthetic oligonucleotide
ucccuuuggggagguggguuaggauau

SEQ ID NO: 664 - RNA, 27 nt, Artificial Sequence
  Synthetic oligonucleotide
cucccuuuggggagguggguuaggaua

SEQ ID NO: 665 - RNA, 27 nt, Artificial Sequence
  Synthetic oligonucleotide
gguagugaaaaacauagaauacuggga

SEQ ID NO: 666 - RNA, 27 nt, Artificial Sequence
  Synthetic oligonucleotide
augaaaaauguuccaaugauuuccugu

SEQ ID NO: 667 - RNA, 27 nt, Artificial Sequence
  Synthetic oligonucleotide
aaugaaaaauguuccaaugauuuccug

SEQ ID NO: 668 - RNA, 27 nt, Artificial Sequence
  Synthetic oligonucleotide
agcauuucuguaggacauaaugcucaa

SEQ ID NO: 669 - RNA, 27 nt, Artificial Sequence
  Synthetic oligonucleotide
cuuaaagcaaaagcuguuaaccaagug

SEQ ID NO: 670 - RNA, 27 nt, Artificial Sequence
  Synthetic oligonucleotide
acucuuaaagcaaaagcuguuaaccaa

SEQ ID NO: 671 - RNA, 27 nt, Artificial Sequence
  Synthetic oligonucleotide
uacucuuaaagcaaaagcuguuaacca

SEQ ID NO: 672 - RNA, 27 nt, Artificial Sequence
  Synthetic oligonucleotide
uuacuuguccaaguacucuuaaagcaa

SEQ ID NO: 673 - RNA, 27 nt, Artificial Sequence
  Synthetic oligonucleotide
uuuacuuguccaaguacucuuaaagca

SEQ ID NO: 674 - RNA, 27 nt, Artificial Sequence
  Synthetic oligonucleotide
uuauuuacuuguccaaguacucuuaaa

SEQ ID NO: 675 - RNA, 27 nt, Artificial Sequence
  Synthetic oligonucleotide
uuuauuuacuuguccaaguacucuuaa

SEQ ID NO: 676 - RNA, 27 nt, Artificial Sequence
  Synthetic oligonucleotide
caaauugaauuuugguucugcucuacg

SEQ ID NO: 677 - RNA, 27 nt, Artificial Sequence
  Synthetic oligonucleotide
acaaauugaauuuugguucugcucuac

SEQ ID NO: 678 - RNA, 27 nt, Artificial Sequence
  Synthetic oligonucleotide
uacaaauugaauuuugguucugcucua

SEQ ID NO: 679 - RNA, 27 nt, Artificial Sequence
  Synthetic oligonucleotide
uuacaaauugaauuuugguucugcucu

SEQ ID NO: 680 - RNA, 27 nt, Artificial Sequence
  Synthetic oligonucleotide
uguaauuuuauugguugauacugugaa

SEQ ID NO: 681 - RNA, 27 nt, Artificial Sequence
  Synthetic oligonucleotide
caagguacccuguaauuuuauugguug

SEQ ID NO: 682 - RNA, 27 nt, Artificial Sequence
  Synthetic oligonucleotide
gcaagguacccuguaauuuuauugguu

SEQ ID NO: 683 - RNA, 27 nt, Artificial Sequence
  Synthetic oligonucleotide
ggcaagguacccuguaauuuuauuggu

SEQ ID NO: 684 - RNA, 27 nt, Artificial Sequence
  Synthetic oligonucleotide
aaagccuuucuaauuccaaucacagua

SEQ ID NO: 685 - RNA, 27 nt, Artificial Sequence
  Synthetic oligonucleotide
gaaagccuuucuaauuccaaucacagu

SEQ ID NO: 686 - RNA, 27 nt, Artificial Sequence
  Synthetic oligonucleotide
cgaaagccuuucuaauuccaaucacag

SEQ ID NO: 687 - RNA, 27 nt, Artificial Sequence
  Synthetic oligonucleotide
ucgaaagccuuucuaauuccaaucaca

SEQ ID NO: 688 - RNA, 27 nt, Artificial Sequence
  Synthetic oligonucleotide
ucucuucaaagcugaaacaauugaacg

SEQ ID NO: 689 - RNA, 27 nt, Artificial Sequence
  Synthetic oligonucleotide
accuuuaaccaaagcuucucucuucaa

SEQ ID NO: 690 - RNA, 27 nt, Artificial Sequence
  Synthetic oligonucleotide
uaccuuuaaccaaagcuucucucuuca

SEQ ID NO: 691 - RNA, 27 nt, Artificial Sequence
  Synthetic oligonucleotide
uuaccuuuaaccaaagcuucucucuuc

SEQ ID NO: 692 - RNA, 27 nt, Artificial Sequence
  Synthetic oligonucleotide
uggauuaccuuuaaccaaagcuucucu

SEQ ID NO: 693 - RNA, 27 nt, Artificial Sequence
  Synthetic oligonucleotide
guggauuaccuuuaaccaaagcuucuc

SEQ ID NO: 694 - RNA, 27 nt, Artificial Sequence
  Synthetic oligonucleotide
uugucuuuccaaaaacgauaaaugggu

SEQ ID NO: 695 - RNA, 27 nt, Artificial Sequence
  Synthetic oligonucleotide
ucaaguucagacuggugaguaaagcau

SEQ ID NO: 696 - RNA, 27 nt, Artificial Sequence
  Synthetic oligonucleotide
uucaaguucagacuggugaguaaagca

SEQ ID NO: 697 - RNA, 27 nt, Artificial Sequence
  Synthetic oligonucleotide
uaucuuucaaguucagacuggugagua

SEQ ID NO: 698 - RNA, 27 nt, Artificial Sequence
  Synthetic oligonucleotide
uuuauaucuuucaaguucagacuggug

SEQ ID NO: 699 - RNA, 27 nt, Artificial Sequence
  Synthetic oligonucleotide
agccaccuccauaccucugcucuucug

SEQ ID NO: 700 - RNA, 27 nt, Artificial Sequence
  Synthetic oligonucleotide
aagccaccuccauaccucugcucuucu

SEQ ID NO: 701 - RNA, 27 nt, Artificial Sequence
  Synthetic oligonucleotide
guuguuuaaccaggagugaauauuccg

SEQ ID NO: 702 - RNA, 27 nt, Artificial Sequence
  Synthetic oligonucleotide
ucugucauuuuauaauuauguaaggca

SEQ ID NO: 703 - RNA, 27 nt, Artificial Sequence
  Synthetic oligonucleotide
uuuugugaacuacaguuguuacaugua

SEQ ID NO: 704 - RNA, 27 nt, Artificial Sequence
  Synthetic oligonucleotide
ucaaauaaaagcugcaaacuuccucag

SEQ ID NO: 705 - RNA, 27 nt, Artificial Sequence
  Synthetic oligonucleotide
uucaaauaaaagcugcaaacuuccuca

SEQ ID NO: 706 - RNA, 27 nt, Artificial Sequence
  Synthetic oligonucleotide
uuucaaauaaaagcugcaaacuuccuc

SEQ ID NO: 707 - RNA, 27 nt, Artificial Sequence
  Synthetic oligonucleotide
uuuucaaauaaaagcugcaaacuuccu

SEQ ID NO: 708 - RNA, 27 nt, Artificial Sequence
  Synthetic oligonucleotide
auuuucaaauaaaagcugcaaacuucc

SEQ ID NO: 709 - RNA, 27 nt, Artificial Sequence
  Synthetic oligonucleotide
gauuuucaaauaaaagcugcaaacuuc

SEQ ID NO: 710 - RNA, 27 nt, Artificial Sequence
  Synthetic oligonucleotide
cgauuuucaaauaaaagcugcaaacuu

SEQ ID NO: 711 - RNA, 27 nt, Artificial Sequence
  Synthetic oligonucleotide
ucgauuuucaaauaaaagcugcaaacu

SEQ ID NO: 712 - RNA, 27 nt, Artificial Sequence
  Synthetic oligonucleotide
guaucgauuuucaaauaaaagcugcaa

SEQ ID NO: 713 - RNA, 27 nt, Artificial Sequence
  Synthetic oligonucleotide
ugggaugcuucaauauccugaguaucg

SEQ ID NO: 714 - RNA, 27 nt, Artificial Sequence
  Synthetic oligonucleotide
uguagugggaugcuucaauauccugag

SEQ ID NO: 715 - RNA, 27 nt, Artificial Sequence
  Synthetic oligonucleotide
cugggcuuguagcuggcacaugcuacu

SEQ ID NO: 716 - RNA, 27 nt, Artificial Sequence
  Synthetic oligonucleotide
gcugggcuuguagcuggcacaugcuac

SEQ ID NO: 717 - RNA, 27 nt, Artificial Sequence
  Synthetic oligonucleotide
ugcugggcuuguagcuggcacaugcua

SEQ ID NO: 718 - RNA, 27 nt, Artificial Sequence
  Synthetic oligonucleotide
cugcugggcuuguagcuggcacaugcu

SEQ ID NO: 719 - RNA, 27 nt, Artificial Sequence
  Synthetic oligonucleotide
ccugcugggcuuguagcuggcacaugc

SEQ ID NO: 720 - RNA, 27 nt, Artificial Sequence
  Synthetic oligonucleotide
cccugcugggcuuguagcuggcacaug

SEQ ID NO: 721 - RNA, 27 nt, Artificial Sequence
  Synthetic oligonucleotide
ucccugcugggcuuguagcuggcacau

SEQ ID NO: 722 - RNA, 27 nt, Artificial Sequence
  Synthetic oligonucleotide
uucccugcugggcuuguagcuggcaca

SEQ ID NO: 723 - RNA, 27 nt, Artificial Sequence
  Synthetic oligonucleotide
cuucccugcugggcuuguagcuggcac

SEQ ID NO: 724 - RNA, 27 nt, Artificial Sequence
  Synthetic oligonucleotide
ucaguugcagaauaacauguccaucuu

SEQ ID NO: 725 - RNA, 27 nt, Artificial Sequence
  Synthetic oligonucleotide
uucaguugcagaauaacauguccaucu

SEQ ID NO: 726 - RNA, 27 nt, Artificial Sequence
  Synthetic oligonucleotide
aauucaguugcagaauaacauguccau

SEQ ID NO: 727 - RNA, 27 nt, Artificial Sequence
  Synthetic oligonucleotide
cgaauucaguugcagaauaacaugucc

SEQ ID NO: 728 - RNA, 27 nt, Artificial Sequence
  Synthetic oligonucleotide
ucgaauucaguugcagaauaacauguc

SEQ ID NO: 729 - RNA, 27 nt, Artificial Sequence
  Synthetic oligonucleotide
aucgaauucaguugcagaauaacaugu

SEQ ID NO: 730 - RNA, 27 nt, Artificial Sequence
  Synthetic oligonucleotide
agggaaucgaauucaguugcagaauaa

SEQ ID NO: 731 - RNA, 27 nt, Artificial Sequence
  Synthetic oligonucleotide
gagggaaucgaauucaguugcagaaua

SEQ ID NO: 732 - RNA, 27 nt, Artificial Sequence
  Synthetic oligonucleotide
uauaaaacaugguacacuguuuaucug

SEQ ID NO: 733 - RNA, 27 nt, Artificial Sequence
  Synthetic oligonucleotide
cuauaaaacaugguacacuguuuaucu

SEQ ID NO: 734 - RNA, 27 nt, Artificial Sequence
  Synthetic oligonucleotide
ugcuauaaaacaugguacacuguuuau

SEQ ID NO: 735 - RNA, 27 nt, Artificial Sequence
  Synthetic oligonucleotide
agugcuauaaaacaugguacacuguuu

SEQ ID NO: 736 - RNA, 27 nt, Artificial Sequence
  Synthetic oligonucleotide
ugaauuuugauauuggaagugcuauaa

SEQ ID NO: 737 - RNA, 27 nt, Artificial Sequence
  Synthetic oligonucleotide
gcggcuccuucacagacuuucugaauu

SEQ ID NO: 738 - RNA, 27 nt, Artificial Sequence
  Synthetic oligonucleotide
cgcggcuccuucacagacuuucugaau

SEQ ID NO: 739 - RNA, 27 nt, Artificial Sequence
  Synthetic oligonucleotide
acgcggcuccuucacagacuuucugaa

SEQ ID NO: 740 - RNA, 27 nt, Artificial Sequence
  Synthetic oligonucleotide
cacgcggcuccuucacagacuuucuga

SEQ ID NO: 741 - RNA, 27 nt, Artificial Sequence
  Synthetic oligonucleotide
cuuuauaagcauaugcaaucucugguu

SEQ ID NO: 742 - RNA, 27 nt, Artificial Sequence
  Synthetic oligonucleotide
acuuuauaagcauaugcaaucucuggu

SEQ ID NO: 743 - RNA, 27 nt, Artificial Sequence
  Synthetic oligonucleotide
aacuuuauaagcauaugcaaucucugg

SEQ ID NO: 744 - RNA, 27 nt, Artificial Sequence
  Synthetic oligonucleotide
uaacuuuauaagcauaugcaaucucug

SEQ ID NO: 745 - RNA, 27 nt, Artificial Sequence
  Synthetic oligonucleotide
cuaacuuuauaagcauaugcaaucucu

SEQ ID NO: 746 - RNA, 27 nt, Artificial Sequence
  Synthetic oligonucleotide
cuuguacuugacaaaaacauuuucuac

SEQ ID NO: 747 - RNA, 27 nt, Artificial Sequence
  Synthetic oligonucleotide
ccuuguacuugacaaaaacauuuucua

SEQ ID NO: 748 - RNA, 27 nt, Artificial Sequence
  Synthetic oligonucleotide
gccuuguacuugacaaaaacauuuucu

SEQ ID NO: 749 - RNA, 27 nt, Artificial Sequence
  Synthetic oligonucleotide
ugccuuguacuugacaaaaacauuuuc

SEQ ID NO: 750 - RNA, 27 nt, Artificial Sequence
  Synthetic oligonucleotide
uugccuuguacuugacaaaaacauuuu

SEQ ID NO: 751 - RNA, 27 nt, Artificial Sequence
  Synthetic oligonucleotide
gaaacugaaauuguauuuuaucuggag

SEQ ID NO: 752 - RNA, 27 nt, Artificial Sequence
  Synthetic oligonucleotide
uaaaaaugcuugacacgaugaacaugu

SEQ ID NO: 753 - RNA, 27 nt, Artificial Sequence
  Synthetic oligonucleotide
uuagcuaaaaaugcuugacacgaugaa

SEQ ID NO: 754 - RNA, 27 nt, Artificial Sequence
  Synthetic oligonucleotide
uaaauuagcuaaaaaugcuugacacga

SEQ ID NO: 755 - RNA, 27 nt, Artificial Sequence
  Synthetic oligonucleotide
ucaucuaaauuagcuaaaaaugcuuga

SEQ ID NO: 756 - RNA, 27 nt, Artificial Sequence
  Synthetic oligonucleotide
ugaacuucaggaauuuuagcauccauu

SEQ ID NO: 757 - RNA, 27 nt, Artificial Sequence
  Synthetic oligonucleotide
acgaacuucaacaacaggaguccauaa

SEQ ID NO: 758 - RNA, 27 nt, Artificial Sequence
  Synthetic oligonucleotide
aaacgaacuucaacaacaggaguccau

SEQ ID NO: 759 - RNA, 27 nt, Artificial Sequence
  Synthetic oligonucleotide
aaaacgaacuucaacaacaggagucca

SEQ ID NO: 760 - RNA, 27 nt, Artificial Sequence
  Synthetic oligonucleotide
ugaaaucauucucuaauaaaagcaagu

SEQ ID NO: 761 - RNA, 27 nt, Artificial Sequence
  Synthetic oligonucleotide
uugaaaucauucucuaauaaaagcaag

SEQ ID NO: 762 - RNA, 27 nt, Artificial Sequence
  Synthetic oligonucleotide
uuugaaaucauucucuaauaaaagcaa

SEQ ID NO: 763 - RNA, 27 nt, Artificial Sequence
  Synthetic oligonucleotide
auuugaaaucauucucuaauaaaagca

SEQ ID NO: 764 - RNA, 27 nt, Artificial Sequence
  Synthetic oligonucleotide
uccaauaaccuuggaggaguaucuguc

SEQ ID NO: 765 - RNA, 27 nt, Artificial Sequence
  Synthetic oligonucleotide
uugaaagcaaacucaggcuuuaaugau

SEQ ID NO: 766 - RNA, 27 nt, Artificial Sequence
  Synthetic oligonucleotide
uuugaaagcaaacucaggcuuuaauga

SEQ ID NO: 767 - RNA, 27 nt, Artificial Sequence
  Synthetic oligonucleotide
uuuuuugaaagcaaacucaggcuuuaa

SEQ ID NO: 768 - RNA, 27 nt, Artificial Sequence
  Synthetic oligonucleotide
uuuuuuugaaagcaaacucaggcuuua

SEQ ID NO: 769 - DNA, 27 bp, Artificial Sequence
  Synthetic oligonucleotide
acatatgtcatttcagcaccaaaaata

SEQ ID NO: 770 - DNA, 27 bp, Artificial Sequence
  Synthetic oligonucleotide
atattgtgattcaagtttatggataca

SEQ ID NO: 771 - DNA, 27 bp, Artificial Sequence
  Synthetic oligonucleotide
tattgtgattcaagtttatggatacac

SEQ ID NO: 772 - DNA, 27 bp, Artificial Sequence
  Synthetic oligonucleotide
attgtgattcaagtttatggatacact

SEQ ID NO: 773 - DNA, 27 bp, Artificial Sequence
  Synthetic oligonucleotide
ttgtgattcaagtttatggatacactg

SEQ ID NO: 774 - DNA, 27 bp, Artificial Sequence
  Synthetic oligonucleotide
tgtgattcaagtttatggatacactga

SEQ ID NO: 775 - DNA, 27 bp, Artificial Sequence
  Synthetic oligonucleotide
gtgattcaagtttatggatacactgaa

SEQ ID NO: 776 - DNA, 27 bp, Artificial Sequence
  Synthetic oligonucleotide
tgattcaagtttatggatacactgaag

SEQ ID NO: 777 - DNA, 27 bp, Artificial Sequence
  Synthetic oligonucleotide
gattcaagtttatggatacactgaagc

SEQ ID NO: 778 - DNA, 27 bp, Artificial Sequence
  Synthetic oligonucleotide
attcaagtttatggatacactgaagca

SEQ ID NO: 779 - DNA, 27 bp, Artificial Sequence
  Synthetic oligonucleotide
ttcaagtttatggatacactgaagcat

SEQ ID NO: 780 - DNA, 27 bp, Artificial Sequence
  Synthetic oligonucleotide
tcaagtttatggatacactgaagcatt

SEQ ID NO: 781 - DNA, 27 bp, Artificial Sequence
  Synthetic oligonucleotide
caagtttatggatacactgaagcattt

SEQ ID NO: 782 - DNA, 27 bp, Artificial Sequence
  Synthetic oligonucleotide
agtttatggatacactgaagcatttga

SEQ ID NO: 783 - DNA, 27 bp, Artificial Sequence
  Synthetic oligonucleotide
gtttatggatacactgaagcatttgat

SEQ ID NO: 784 - DNA, 27 bp, Artificial Sequence
  Synthetic oligonucleotide
ttatggatacactgaagcatttgatgc

SEQ ID NO: 785 - DNA, 27 bp, Artificial Sequence
  Synthetic oligonucleotide
atggatacactgaagcatttgatgcaa

SEQ ID NO: 786 - DNA, 27 bp, Artificial Sequence
  Synthetic oligonucleotide
tggatacactgaagcatttgatgcaac

SEQ ID NO: 787 - DNA, 27 bp, Artificial Sequence
  Synthetic oligonucleotide
ggatacactgaagcatttgatgcaaca

SEQ ID NO: 788 - DNA, 27 bp, Artificial Sequence
  Synthetic oligonucleotide
gatacactgaagcatttgatgcaacaa

SEQ ID NO: 789 - DNA, 27 bp, Artificial Sequence
  Synthetic oligonucleotide
atacactgaagcatttgatgcaacaat

SEQ ID NO: 790 - DNA, 27 bp, Artificial Sequence
  Synthetic oligonucleotide
tacactgaagcatttgatgcaacaatc

SEQ ID NO: 791 - DNA, 27 bp, Artificial Sequence
  Synthetic oligonucleotide
acactgaagcatttgatgcaacaatct

SEQ ID NO: 792 - DNA, 27 bp, Artificial Sequence
  Synthetic oligonucleotide
cactgaagcatttgatgcaacaatctc

SEQ ID NO: 793 - DNA, 27 bp, Artificial Sequence
  Synthetic oligonucleotide
ctgaagcatttgatgcaacaatctcta

SEQ ID NO: 794 - DNA, 27 bp, Artificial Sequence
  Synthetic oligonucleotide
gaagcatttgatgcaacaatctctatt

SEQ ID NO: 795 - DNA, 27 bp, Artificial Sequence
  Synthetic oligonucleotide
agcatttgatgcaacaatctctattaa

SEQ ID NO: 796 - DNA, 27 bp, Artificial Sequence
  Synthetic oligonucleotide
tttgatgcaacaatctctattaaaagt

SEQ ID NO: 797 - DNA, 27 bp, Artificial Sequence
  Synthetic oligonucleotide
ttgatgcaacaatctctattaaaagtt

SEQ ID NO: 798 - DNA, 27 bp, Artificial Sequence
  Synthetic oligonucleotide
tgatgcaacaatctctattaaaagtta

SEQ ID NO: 799 - DNA, 27 bp, Artificial Sequence
  Synthetic oligonucleotide
gatgcaacaatctctattaaaagttat

SEQ ID NO: 800 - DNA, 27 bp, Artificial Sequence
  Synthetic oligonucleotide
caacaatctctattaaaagttatcctg

SEQ ID NO: 801 - DNA, 27 bp, Artificial Sequence
  Synthetic oligonucleotide
aacaatctctattaaaagttatcctga

SEQ ID NO: 802 - DNA, 27 bp, Artificial Sequence
  Synthetic oligonucleotide
ctctattaaaagttatcctgataaaaa

SEQ ID NO: 803 - DNA, 27 bp, Artificial Sequence
  Synthetic oligonucleotide
ctattaaaagttatcctgataaaaaat

SEQ ID NO: 804 - DNA, 27 bp, Artificial Sequence
  Synthetic oligonucleotide
ttaaaagttatcctgataaaaaattta

SEQ ID NO: 805 - DNA, 27 bp, Artificial Sequence
  Synthetic oligonucleotide
taaaagttatcctgataaaaaatttag

SEQ ID NO: 806 - DNA, 27 bp, Artificial Sequence
  Synthetic oligonucleotide
aagttatcctgataaaaaatttagtta

SEQ ID NO: 807 - DNA, 27 bp, Artificial Sequence
  Synthetic oligonucleotide
agttatcctgataaaaaatttagttac

SEQ ID NO: 808 - DNA, 27 bp, Artificial Sequence
  Synthetic oligonucleotide
atgttcatttatcctcagagaataaat

SEQ ID NO: 809 - DNA, 27 bp, Artificial Sequence
  Synthetic oligonucleotide
tgttcatttatcctcagagaataaatt

SEQ ID NO: 810 - DNA, 27 bp, Artificial Sequence
  Synthetic oligonucleotide
gtgtatttggaagttgtatcaaagcat

SEQ ID NO: 811 - DNA, 27 bp, Artificial Sequence
  Synthetic oligonucleotide
tgtatttggaagttgtatcaaagcatt

SEQ ID NO: 812 - DNA, 27 bp, Artificial Sequence
  Synthetic oligonucleotide
atttggaagttgtatcaaagcattttt

SEQ ID NO: 813 - DNA, 27 bp, Artificial Sequence
  Synthetic oligonucleotide
tttggaagttgtatcaaagcatttttc

SEQ ID NO: 814 - DNA, 27 bp, Artificial Sequence
  Synthetic oligonucleotide
ttggaagttgtatcaaagcatttttca

SEQ ID NO: 815 - DNA, 27 bp, Artificial Sequence
  Synthetic oligonucleotide
tggaagttgtatcaaagcatttttcaa

SEQ ID NO: 816 - DNA, 27 bp, Artificial Sequence
  Synthetic oligonucleotide
ggaagttgtatcaaagcatttttcaaa

SEQ ID NO: 817 - DNA, 27 bp, Artificial Sequence
  Synthetic oligonucleotide
gaagttgtatcaaagcatttttcaaaa

SEQ ID NO: 818 - DNA, 27 bp, Artificial Sequence
  Synthetic oligonucleotide
aagttgtatcaaagcatttttcaaaat

SEQ ID NO: 819 - DNA, 27 bp, Artificial Sequence
  Synthetic oligonucleotide
agttgtatcaaagcatttttcaaaatc

SEQ ID NO: 820 - DNA, 27 bp, Artificial Sequence
  Synthetic oligonucleotide
gttgtatcaaagcatttttcaaaatca

SEQ ID NO: 821 - DNA, 27 bp, Artificial Sequence
  Synthetic oligonucleotide
ttgtatcaaagcatttttcaaaatcaa

SEQ ID NO: 822 - DNA, 27 bp, Artificial Sequence
  Synthetic oligonucleotide
ccaataacctatgacaatggatttctc

SEQ ID NO: 823 - DNA, 27 bp, Artificial Sequence
  Synthetic oligonucleotide
acctatgacaatggatttctcttcatt

SEQ ID NO: 824 - DNA, 27 bp, Artificial Sequence
  Synthetic oligonucleotide
atgacaatggatttctcttcattcata

SEQ ID NO: 825 - DNA, 27 bp, Artificial Sequence
  Synthetic oligonucleotide
tgacaatggatttctcttcattcatac

SEQ ID NO: 826 - DNA, 27 bp, Artificial Sequence
  Synthetic oligonucleotide
gacaatggatttctcttcattcataca

SEQ ID NO: 827 - DNA, 27 bp, Artificial Sequence
  Synthetic oligonucleotide
caatggatttctcttcattcatacaga

SEQ ID NO: 828 - DNA, 27 bp, Artificial Sequence
  Synthetic oligonucleotide
aatggatttctcttcattcatacagac

SEQ ID NO: 829 - DNA, 27 bp, Artificial Sequence
  Synthetic oligonucleotide
tggatttctcttcattcatacagacaa

SEQ ID NO: 830 - DNA, 27 bp, Artificial Sequence
  Synthetic oligonucleotide
tcattcatacagacaaacctgtttata

SEQ ID NO: 831 - DNA, 27 bp, Artificial Sequence
  Synthetic oligonucleotide
attcatacagacaaacctgtttatact

SEQ ID NO: 832 - DNA, 27 bp, Artificial Sequence
  Synthetic oligonucleotide
ttcatacagacaaacctgtttatactc

SEQ ID NO: 833 - DNA, 27 bp, Artificial Sequence
  Synthetic oligonucleotide
tcatacagacaaacctgtttatactcc

SEQ ID NO: 834 - DNA, 27 bp, Artificial Sequence
  Synthetic oligonucleotide
aagttagagtttattcgttgaatgacg

SEQ ID NO: 835 - DNA, 27 bp, Artificial Sequence
  Synthetic oligonucleotide
aatgacgacttgaagccagccaaaaga

SEQ ID NO: 836 - DNA, 27 bp, Artificial Sequence
  Synthetic oligonucleotide
atgacgacttgaagccagccaaaagag

SEQ ID NO: 837 - DNA, 27 bp, Artificial Sequence
  Synthetic oligonucleotide
tgacgacttgaagccagccaaaagaga

SEQ ID NO: 838 - DNA, 27 bp, Artificial Sequence
  Synthetic oligonucleotide
gacgacttgaagccagccaaaagagaa

SEQ ID NO: 839 - DNA, 27 bp, Artificial Sequence
  Synthetic oligonucleotide
agagaaactgtcttaactttcatagat

SEQ ID NO: 840 - DNA, 27 bp, Artificial Sequence
  Synthetic oligonucleotide
aaactgtcttaactttcatagatcctg

SEQ ID NO: 841 - DNA, 27 bp, Artificial Sequence
  Synthetic oligonucleotide
aactgtcttaactttcatagatcctga

SEQ ID NO: 842 - DNA, 27 bp, Artificial Sequence
  Synthetic oligonucleotide
ctgaaggatcagaagttgacatggtag

SEQ ID NO: 843 - DNA, 27 bp, Artificial Sequence
  Synthetic oligonucleotide
tgaaggatcagaagttgacatggtaga

SEQ ID NO: 844 - DNA, 27 bp, Artificial Sequence
  Synthetic oligonucleotide
ttgacatggtagaagaaattgatcata

SEQ ID NO: 845 - DNA, 27 bp, Artificial Sequence
  Synthetic oligonucleotide
tgacatggtagaagaaattgatcatat

SEQ ID NO: 846 - DNA, 27 bp, Artificial Sequence
  Synthetic oligonucleotide
atggtagaagaaattgatcatattgga

SEQ ID NO: 847 - DNA, 27 bp, Artificial Sequence
  Synthetic oligonucleotide
tggtagaagaaattgatcatattggaa

SEQ ID NO: 848 - DNA, 27 bp, Artificial Sequence
  Synthetic oligonucleotide
agaagaaattgatcatattggaattat

SEQ ID NO: 849 - DNA, 27 bp, Artificial Sequence
  Synthetic oligonucleotide
gaagaaattgatcatattggaattatc

SEQ ID NO: 850 - DNA, 27 bp, Artificial Sequence
  Synthetic oligonucleotide
ttggaattatctcttttcctgacttca

SEQ ID NO: 851 - DNA, 27 bp, Artificial Sequence
  Synthetic oligonucleotide
tggaattatctcttttcctgacttcaa

SEQ ID NO: 852 - DNA, 27 bp, Artificial Sequence
  Synthetic oligonucleotide
ggaattatctcttttcctgacttcaag

SEQ ID NO: 853 - DNA, 27 bp, Artificial Sequence
  Synthetic oligonucleotide
gaattatctcttttcctgacttcaaga

SEQ ID NO: 854 - DNA, 27 bp, Artificial Sequence
  Synthetic oligonucleotide
aattatctcttttcctgacttcaagat

SEQ ID NO: 855 - DNA, 27 bp, Artificial Sequence
  Synthetic oligonucleotide
attatctcttttcctgacttcaagatt

SEQ ID NO: 856 - DNA, 27 bp, Artificial Sequence
  Synthetic oligonucleotide
ttatctcttttcctgacttcaagattc

SEQ ID NO: 857 - DNA, 27 bp, Artificial Sequence
  Synthetic oligonucleotide
tatctcttttcctgacttcaagattcc

SEQ ID NO: 858 - DNA, 27 bp, Artificial Sequence
  Synthetic oligonucleotide
atctcttttcctgacttcaagattccg

SEQ ID NO: 859 - DNA, 27 bp, Artificial Sequence
  Synthetic oligonucleotide
tctcttttcctgacttcaagattccgt

SEQ ID NO: 860 - DNA, 27 bp, Artificial Sequence
  Synthetic oligonucleotide
ctcttttcctgacttcaagattccgtc

SEQ ID NO: 861 - DNA, 27 bp, Artificial Sequence
  Synthetic oligonucleotide
tcttttcctgacttcaagattccgtct

SEQ ID NO: 862 - DNA, 27 bp, Artificial Sequence
  Synthetic oligonucleotide
cttttcctgacttcaagattccgtcta

SEQ ID NO: 863 - DNA, 27 bp, Artificial Sequence
  Synthetic oligonucleotide
ttttcctgacttcaagattccgtctaa

SEQ ID NO: 864 - DNA, 27 bp, Artificial Sequence
  Synthetic oligonucleotide
agttaaagaatatgtcttgccacattt

SEQ ID NO: 865 - DNA, 27 bp, Artificial Sequence
  Synthetic oligonucleotide
gttaaagaatatgtcttgccacatttt

SEQ ID NO: 866 - DNA, 27 bp, Artificial Sequence
  Synthetic oligonucleotide
ttaaagaatatgtcttgccacattttt

SEQ ID NO: 867 - DNA, 27 bp, Artificial Sequence
  Synthetic oligonucleotide
acaagaactttaagaattttgaaatta

SEQ ID NO: 868 - DNA, 27 bp, Artificial Sequence
  Synthetic oligonucleotide
caagaactttaagaattttgaaattac

SEQ ID NO: 869 - DNA, 27 bp, Artificial Sequence
  Synthetic oligonucleotide
aactttaagaattttgaaattactata

SEQ ID NO: 870 - DNA, 27 bp, Artificial Sequence
  Synthetic oligonucleotide
aagaattttgaaattactataaaagca

SEQ ID NO: 871 - DNA, 27 bp, Artificial Sequence
  Synthetic oligonucleotide
agaattttgaaattactataaaagcaa

SEQ ID NO: 872 - DNA, 27 bp, Artificial Sequence
  Synthetic oligonucleotide
gaattttgaaattactataaaagcaag

SEQ ID NO: 873 - DNA, 27 bp, Artificial Sequence
  Synthetic oligonucleotide
ttttgaaattactataaaagcaagata

SEQ ID NO: 874 - DNA, 27 bp, Artificial Sequence
  Synthetic oligonucleotide
tttgaaattactataaaagcaagatat

SEQ ID NO: 875 - DNA, 27 bp, Artificial Sequence
  Synthetic oligonucleotide
ttgaaattactataaaagcaagatatt

SEQ ID NO: 876 - DNA, 27 bp, Artificial Sequence
  Synthetic oligonucleotide
taaaagcaagatatttttataataaag

SEQ ID NO: 877 - DNA, 27 bp, Artificial Sequence
  Synthetic oligonucleotide
aaaagcaagatatttttataataaagt

SEQ ID NO: 878 - DNA, 27 bp, Artificial Sequence
  Synthetic oligonucleotide
aaagcaagatatttttataataaagta

SEQ ID NO: 879 - DNA, 27 bp, Artificial Sequence
  Synthetic oligonucleotide
aagcaagatatttttataataaagtag

SEQ ID NO: 880 - DNA, 27 bp, Artificial Sequence
  Synthetic oligonucleotide
agcaagatatttttataataaagtagt

SEQ ID NO: 881 - DNA, 27 bp, Artificial Sequence
  Synthetic oligonucleotide
gcaagatatttttataataaagtagtc

SEQ ID NO: 882 - DNA, 27 bp, Artificial Sequence
  Synthetic oligonucleotide
caagatatttttataataaagtagtca

SEQ ID NO: 883 - DNA, 27 bp, Artificial Sequence
  Synthetic oligonucleotide
aagatatttttataataaagtagtcac

SEQ ID NO: 884 - DNA, 27 bp, Artificial Sequence
  Synthetic oligonucleotide
cacaatgttgataaatggaattgctca

SEQ ID NO: 885 - DNA, 27 bp, Artificial Sequence
  Synthetic oligonucleotide
acaatgttgataaatggaattgctcaa

SEQ ID NO: 886 - DNA, 27 bp, Artificial Sequence
  Synthetic oligonucleotide
aatgttgataaatggaattgctcaagt

SEQ ID NO: 887 - DNA, 27 bp, Artificial Sequence
  Synthetic oligonucleotide
atgttgataaatggaattgctcaagtc

SEQ ID NO: 888 - DNA, 27 bp, Artificial Sequence
  Synthetic oligonucleotide
tgttgataaatggaattgctcaagtca

SEQ ID NO: 889 - DNA, 27 bp, Artificial Sequence
  Synthetic oligonucleotide
tgataaatggaattgctcaagtcacat

SEQ ID NO: 890 - DNA, 27 bp, Artificial Sequence
  Synthetic oligonucleotide
aaatggaattgctcaagtcacatttga

SEQ ID NO: 891 - DNA, 27 bp, Artificial Sequence
  Synthetic oligonucleotide
tgctcaagtcacatttgattctgaaac

SEQ ID NO: 892 - DNA, 27 bp, Artificial Sequence
  Synthetic oligonucleotide
ctcaagtcacatttgattctgaaacag

SEQ ID NO: 893 - DNA, 27 bp, Artificial Sequence
  Synthetic oligonucleotide
tcaagtcacatttgattctgaaacagc

SEQ ID NO: 894 - DNA, 27 bp, Artificial Sequence
  Synthetic oligonucleotide
caagtcacatttgattctgaaacagca

SEQ ID NO: 895 - DNA, 27 bp, Artificial Sequence
  Synthetic oligonucleotide
cacatttgattctgaaacagcagtcaa

SEQ ID NO: 896 - DNA, 27 bp, Artificial Sequence
  Synthetic oligonucleotide
catttgattctgaaacagcagtcaaag

SEQ ID NO: 897 - DNA, 27 bp, Artificial Sequence
  Synthetic oligonucleotide
atttgattctgaaacagcagtcaaaga

SEQ ID NO: 898 - DNA, 27 bp, Artificial Sequence
  Synthetic oligonucleotide
aacagcagtcaaagaactgtcatacta

SEQ ID NO: 899 - DNA, 27 bp, Artificial Sequence
  Synthetic oligonucleotide
cagcagtcaaagaactgtcatactaca

SEQ ID NO: 900 - DNA, 27 bp, Artificial Sequence
  Synthetic oligonucleotide
cagtcaaagaactgtcatactacagtt

SEQ ID NO: 901 - DNA, 27 bp, Artificial Sequence
  Synthetic oligonucleotide
caaagaactgtcatactacagtttaga

SEQ ID NO: 902 - DNA, 27 bp, Artificial Sequence
  Synthetic oligonucleotide
aaagaactgtcatactacagtttagaa

SEQ ID NO: 903 - DNA, 27 bp, Artificial Sequence
  Synthetic oligonucleotide
agaactgtcatactacagtttagaaga

SEQ ID NO: 904 - DNA, 27 bp, Artificial Sequence
  Synthetic oligonucleotide
atttaaacaacaagtacctttatattg

SEQ ID NO: 905 - DNA, 27 bp, Artificial Sequence
  Synthetic oligonucleotide
tttaaacaacaagtacctttatattgc

SEQ ID NO: 906 - DNA, 27 bp, Artificial Sequence
  Synthetic oligonucleotide
ttaaacaacaagtacctttatattgct

SEQ ID NO: 907 - DNA, 27 bp, Artificial Sequence
  Synthetic oligonucleotide
taaacaacaagtacctttatattgctg

SEQ ID NO: 908 - DNA, 27 bp, Artificial Sequence
  Synthetic oligonucleotide
aaacaacaagtacctttatattgctgt

SEQ ID NO: 909 - DNA, 27 bp, Artificial Sequence
  Synthetic oligonucleotide
aacaacaagtacctttatattgctgta

SEQ ID NO: 910 - DNA, 27 bp, Artificial Sequence
  Synthetic oligonucleotide
acaacaagtacctttatattgctgtaa

SEQ ID NO: 911 - DNA, 27 bp, Artificial Sequence
  Synthetic oligonucleotide
caacaagtacctttatattgctgtaac

SEQ ID NO: 912 - DNA, 27 bp, Artificial Sequence
  Synthetic oligonucleotide
aacaagtacctttatattgctgtaaca

SEQ ID NO: 913 - DNA, 27 bp, Artificial Sequence
  Synthetic oligonucleotide
acaagtacctttatattgctgtaacag

SEQ ID NO: 914 - DNA, 27 bp, Artificial Sequence
  Synthetic oligonucleotide
caagtacctttatattgctgtaacagt

SEQ ID NO: 915 - DNA, 27 bp, Artificial Sequence
  Synthetic oligonucleotide
aagtacctttatattgctgtaacagtc

SEQ ID NO: 916 - DNA, 27 bp, Artificial Sequence
  Synthetic oligonucleotide
gtacctttatattgctgtaacagtcat

SEQ ID NO: 917 - DNA, 27 bp, Artificial Sequence
  Synthetic oligonucleotide
catcaaatatgtcctctctccctacaa

SEQ ID NO: 918 - DNA, 27 bp, Artificial Sequence
  Synthetic oligonucleotide
ctccctacaaactgaatttggttgcta

SEQ ID NO: 919 - DNA, 27 bp, Artificial Sequence
  Synthetic oligonucleotide
ctacaaactgaatttggttgctactcc

SEQ ID NO: 920 - DNA, 27 bp, Artificial Sequence
  Synthetic oligonucleotide
tacaaactgaatttggttgctactcct

SEQ ID NO: 921 - DNA, 27 bp, Artificial Sequence
  Synthetic oligonucleotide
cactgaatgcacaaacaattgatgtaa

SEQ ID NO: 922 - DNA, 27 bp, Artificial Sequence
  Synthetic oligonucleotide
actgaatgcacaaacaattgatgtaaa

SEQ ID NO: 923 - DNA, 27 bp, Artificial Sequence
  Synthetic oligonucleotide
accaagagacatctgacttggatccaa

SEQ ID NO: 924 - DNA, 27 bp, Artificial Sequence
  Synthetic oligonucleotide
ccaagagacatctgacttggatccaag

SEQ ID NO: 925 - DNA, 27 bp, Artificial Sequence
  Synthetic oligonucleotide
aaggttaccgagcaatagcatactcat

SEQ ID NO: 926 - DNA, 27 bp, Artificial Sequence
  Synthetic oligonucleotide
tctcagccaaagttacctttatattga

SEQ ID NO: 927 - DNA, 27 bp, Artificial Sequence
  Synthetic oligonucleotide
ctcagccaaagttacctttatattgat

SEQ ID NO: 928 - DNA, 27 bp, Artificial Sequence
  Synthetic oligonucleotide
tcagccaaagttacctttatattgatt

SEQ ID NO: 929 - DNA, 27 bp, Artificial Sequence
  Synthetic oligonucleotide
cagccaaagttacctttatattgattg

SEQ ID NO: 930 - DNA, 27 bp, Artificial Sequence
  Synthetic oligonucleotide
ccaaaagcccatatattgacaaaataa

SEQ ID NO: 931 - DNA, 27 bp, Artificial Sequence
  Synthetic oligonucleotide
aagcccatatattgacaaaataactca

SEQ ID NO: 932 - DNA, 27 bp, Artificial Sequence
  Synthetic oligonucleotide
agcccatatattgacaaaataactcac

SEQ ID NO: 933 - DNA, 27 bp, Artificial Sequence
  Synthetic oligonucleotide
cccatatattgacaaaataactcacta

SEQ ID NO: 934 - DNA, 27 bp, Artificial Sequence
  Synthetic oligonucleotide
ccatatattgacaaaataactcactat

SEQ ID NO: 935 - DNA, 27 bp, Artificial Sequence
  Synthetic oligonucleotide
catatattgacaaaataactcactata

SEQ ID NO: 936 - DNA, 27 bp, Artificial Sequence
  Synthetic oligonucleotide
atattgacaaaataactcactataatt

SEQ ID NO: 937 - DNA, 27 bp, Artificial Sequence
  Synthetic oligonucleotide
attgacaaaataactcactataattac

SEQ ID NO: 938 - DNA, 27 bp, Artificial Sequence
  Synthetic oligonucleotide
ttgacaaaataactcactataattact

SEQ ID NO: 939 - DNA, 27 bp, Artificial Sequence
  Synthetic oligonucleotide
tgacaaaataactcactataattactt

SEQ ID NO: 940 - DNA, 27 bp, Artificial Sequence
  Synthetic oligonucleotide
gacaaaataactcactataattacttg

SEQ ID NO: 941 - DNA, 27 bp, Artificial Sequence
  Synthetic oligonucleotide
acaaaataactcactataattacttga

SEQ ID NO: 942 - DNA, 27 bp, Artificial Sequence
  Synthetic oligonucleotide
caaaataactcactataattacttgat

SEQ ID NO: 943 - DNA, 27 bp, Artificial Sequence
  Synthetic oligonucleotide
aaaataactcactataattacttgatt

SEQ ID NO: 944 - DNA, 27 bp, Artificial Sequence
  Synthetic oligonucleotide
aaataactcactataattacttgattt

SEQ ID NO: 945 - DNA, 27 bp, Artificial Sequence
  Synthetic oligonucleotide
aataactcactataattacttgatttt

SEQ ID NO: 946 - DNA, 27 bp, Artificial Sequence
  Synthetic oligonucleotide
ataactcactataattacttgatttta

SEQ ID NO: 947 - DNA, 27 bp, Artificial Sequence
  Synthetic oligonucleotide
taactcactataattacttgattttat

SEQ ID NO: 948 - DNA, 27 bp, Artificial Sequence
  Synthetic oligonucleotide
aactcactataattacttgattttatc

SEQ ID NO: 949 - DNA, 27 bp, Artificial Sequence
  Synthetic oligonucleotide
actcactataattacttgattttatcc

SEQ ID NO: 950 - DNA, 27 bp, Artificial Sequence
  Synthetic oligonucleotide
ctcactataattacttgattttatcca

SEQ ID NO: 951 - DNA, 27 bp, Artificial Sequence
  Synthetic oligonucleotide
tcactataattacttgattttatccaa

SEQ ID NO: 952 - DNA, 27 bp, Artificial Sequence
  Synthetic oligonucleotide
cactataattacttgattttatccaag

SEQ ID NO: 953 - DNA, 27 bp, Artificial Sequence
  Synthetic oligonucleotide
actataattacttgattttatccaagg

SEQ ID NO: 954 - DNA, 27 bp, Artificial Sequence
  Synthetic oligonucleotide
ctataattacttgattttatccaaggg

SEQ ID NO: 955 - DNA, 27 bp, Artificial Sequence
  Synthetic oligonucleotide
tataattacttgattttatccaagggc

SEQ ID NO: 956 - DNA, 27 bp, Artificial Sequence
  Synthetic oligonucleotide
ataattacttgattttatccaagggca

SEQ ID NO: 957 - DNA, 27 bp, Artificial Sequence
  Synthetic oligonucleotide
taattacttgattttatccaagggcaa

SEQ ID NO: 958 - DNA, 27 bp, Artificial Sequence
  Synthetic oligonucleotide
gtgtctgattcagtctggttaaatatt

SEQ ID NO: 959 - DNA, 27 bp, Artificial Sequence
  Synthetic oligonucleotide
gtctgattcagtctggttaaatattga

SEQ ID NO: 960 - DNA, 27 bp, Artificial Sequence
  Synthetic oligonucleotide
tctgattcagtctggttaaatattgaa

SEQ ID NO: 961 - DNA, 27 bp, Artificial Sequence
  Synthetic oligonucleotide
ctgattcagtctggttaaatattgaag

SEQ ID NO: 962 - DNA, 27 bp, Artificial Sequence
  Synthetic oligonucleotide
tgattcagtctggttaaatattgaaga

SEQ ID NO: 963 - DNA, 27 bp, Artificial Sequence
  Synthetic oligonucleotide
attcagtctggttaaatattgaagaaa

SEQ ID NO: 964 - DNA, 27 bp, Artificial Sequence
  Synthetic oligonucleotide
ttcagtctggttaaatattgaagaaaa

SEQ ID NO: 965 - DNA, 27 bp, Artificial Sequence
  Synthetic oligonucleotide
tcagtctggttaaatattgaagaaaaa

SEQ ID NO: 966 - DNA, 27 bp, Artificial Sequence
  Synthetic oligonucleotide
cagtctggttaaatattgaagaaaaat

SEQ ID NO: 967 - DNA, 27 bp, Artificial Sequence
  Synthetic oligonucleotide
agtctggttaaatattgaagaaaaatg

SEQ ID NO: 968 - DNA, 27 bp, Artificial Sequence
  Synthetic oligonucleotide
gtctggttaaatattgaagaaaaatgt

SEQ ID NO: 969 - DNA, 27 bp, Artificial Sequence
  Synthetic oligonucleotide
tctggttaaatattgaagaaaaatgtg

SEQ ID NO: 970 - DNA, 27 bp, Artificial Sequence
  Synthetic oligonucleotide
ctggttaaatattgaagaaaaatgtgg

SEQ ID NO: 971 - DNA, 27 bp, Artificial Sequence
  Synthetic oligonucleotide
aatgtggcaaccagctccaggttcatc

SEQ ID NO: 972 - DNA, 27 bp, Artificial Sequence
  Synthetic oligonucleotide
atgtggcaaccagctccaggttcatct

SEQ ID NO: 973 - DNA, 27 bp, Artificial Sequence
  Synthetic oligonucleotide
atctgggctgtggggcaggtggtggcc

SEQ ID NO: 974 - DNA, 27 bp, Artificial Sequence
  Synthetic oligonucleotide
tctgggctgtggggcaggtggtggcct

SEQ ID NO: 975 - DNA, 27 bp, Artificial Sequence
  Synthetic oligonucleotide
ctgggctgtggggcaggtggtggcctc

SEQ ID NO: 976 - DNA, 27 bp, Artificial Sequence
  Synthetic oligonucleotide
tgggctgtggggcaggtggtggcctca

SEQ ID NO: 977 - DNA, 27 bp, Artificial Sequence
  Synthetic oligonucleotide
gggctgtggggcaggtggtggcctcaa

SEQ ID NO: 978 - DNA, 27 bp, Artificial Sequence
  Synthetic oligonucleotide
ggctgtggggcaggtggtggcctcaac

SEQ ID NO: 979 - DNA, 27 bp, Artificial Sequence
  Synthetic oligonucleotide
gctgtggggcaggtggtggcctcaaca

SEQ ID NO: 980 - DNA, 27 bp, Artificial Sequence
  Synthetic oligonucleotide
caagaaaatgatgaaccttgtaaagaa

SEQ ID NO: 981 - DNA, 27 bp, Artificial Sequence
  Synthetic oligonucleotide
aaatgatgaaccttgtaaagaaattct

SEQ ID NO: 982 - DNA, 27 bp, Artificial Sequence
  Synthetic oligonucleotide
atgatgaaccttgtaaagaaattctca

SEQ ID NO: 983 - DNA, 27 bp, Artificial Sequence
  Synthetic oligonucleotide
tgatgaaccttgtaaagaaattctcag

SEQ ID NO: 984 - DNA, 27 bp, Artificial Sequence
  Synthetic oligonucleotide
accttgtaaagaaattctcaggccaag

SEQ ID NO: 985 - DNA, 27 bp, Artificial Sequence
  Synthetic oligonucleotide
ccttgtaaagaaattctcaggccaaga

SEQ ID NO: 986 - DNA, 27 bp, Artificial Sequence
  Synthetic oligonucleotide
tcagtagtgaagaaatgttgttacgat

SEQ ID NO: 987 - DNA, 27 bp, Artificial Sequence
  Synthetic oligonucleotide
cagtagtgaagaaatgttgttacgatg

SEQ ID NO: 988 - DNA, 27 bp, Artificial Sequence
  Synthetic oligonucleotide
atgaagaccctgttaccagtaagcaag

SEQ ID NO: 989 - DNA, 27 bp, Artificial Sequence
  Synthetic oligonucleotide
agcaagccagaaattcggagttatttt

SEQ ID NO: 990 - DNA, 27 bp, Artificial Sequence
  Synthetic oligonucleotide
tgtcaaggcaaaggtgttcaaagatgt

SEQ ID NO: 991 - DNA, 27 bp, Artificial Sequence
  Synthetic oligonucleotide
gtcaaggcaaaggtgttcaaagatgtc

SEQ ID NO: 992 - DNA, 27 bp, Artificial Sequence
  Synthetic oligonucleotide
tcaaggcaaaggtgttcaaagatgtct

SEQ ID NO: 993 - DNA, 27 bp, Artificial Sequence
  Synthetic oligonucleotide
caaggcaaaggtgttcaaagatgtctt

SEQ ID NO: 994 - DNA, 27 bp, Artificial Sequence
  Synthetic oligonucleotide
aagatgtcttcctggaaatgaatatac

SEQ ID NO: 995 - DNA, 27 bp, Artificial Sequence
  Synthetic oligonucleotide
tcctggaaatgaatataccatattctg

SEQ ID NO: 996 - DNA, 27 bp, Artificial Sequence
  Synthetic oligonucleotide
cctggaaatgaatataccatattctgt

SEQ ID NO: 997 - DNA, 27 bp, Artificial Sequence
  Synthetic oligonucleotide
ctggaaatgaatataccatattctgtt

SEQ ID NO: 998 - DNA, 27 bp, Artificial Sequence
  Synthetic oligonucleotide
tggaaatgaatataccatattctgttg

SEQ ID NO: 999 - DNA, 27 bp, Artificial Sequence
  Synthetic oligonucleotide
ggaaatgaatataccatattctgttgt

SEQ ID NO: 1000 - DNA, 27 bp, Artificial Sequence
  Synthetic oligonucleotide
gaaatgaatataccatattctgttgta

SEQ ID NO: 1001 - DNA, 27 bp, Artificial Sequence
  Synthetic oligonucleotide
aaatgaatataccatattctgttgtac

SEQ ID NO: 1002 - DNA, 27 bp, Artificial Sequence
  Synthetic oligonucleotide
aatgaatataccatattctgttgtacg

SEQ ID NO: 1003 - DNA, 27 bp, Artificial Sequence
  Synthetic oligonucleotide
atgaatataccatattctgttgtacga

SEQ ID NO: 1004 - DNA, 27 bp, Artificial Sequence
  Synthetic oligonucleotide
tgaatataccatattctgttgtacgag

SEQ ID NO: 1005 - DNA, 27 bp, Artificial Sequence
  Synthetic oligonucleotide
gaatataccatattctgttgtacgagg

SEQ ID NO: 1006 - DNA, 27 bp, Artificial Sequence
  Synthetic oligonucleotide
tacgaggagaacagatccaattgaaag

SEQ ID NO: 1007 - DNA, 27 bp, Artificial Sequence
  Synthetic oligonucleotide
acgaggagaacagatccaattgaaagg

SEQ ID NO: 1008 - DNA, 27 bp, Artificial Sequence
  Synthetic oligonucleotide
cgaggagaacagatccaattgaaagga

SEQ ID NO: 1009 - DNA, 27 bp, Artificial Sequence
  Synthetic oligonucleotide
gaggagaacagatccaattgaaaggaa

SEQ ID NO: 1010 - DNA, 27 bp, Artificial Sequence
  Synthetic oligonucleotide
aggagaacagatccaattgaaaggaac

SEQ ID NO: 1011 - DNA, 27 bp, Artificial Sequence
  Synthetic oligonucleotide
ggagaacagatccaattgaaaggaact

SEQ ID NO: 1012 - DNA, 27 bp, Artificial Sequence
  Synthetic oligonucleotide
gagaacagatccaattgaaaggaactg

SEQ ID NO: 1013 - DNA, 27 bp, Artificial Sequence
  Synthetic oligonucleotide
agaacagatccaattgaaaggaactgt

SEQ ID NO: 1014 - DNA, 27 bp, Artificial Sequence
  Synthetic oligonucleotide
gaacagatccaattgaaaggaactgtt

SEQ ID NO: 1015 - DNA, 27 bp, Artificial Sequence
  Synthetic oligonucleotide
aacagatccaattgaaaggaactgttt

SEQ ID NO: 1016 - DNA, 27 bp, Artificial Sequence
  Synthetic oligonucleotide
acagatccaattgaaaggaactgttta

SEQ ID NO: 1017 - DNA, 27 bp, Artificial Sequence
  Synthetic oligonucleotide
cagatccaattgaaaggaactgtttac

SEQ ID NO: 1018 - DNA, 27 bp, Artificial Sequence
  Synthetic oligonucleotide
agatccaattgaaaggaactgtttaca

SEQ ID NO: 1019 - DNA, 27 bp, Artificial Sequence
  Synthetic oligonucleotide
gatccaattgaaaggaactgtttacaa

SEQ ID NO: 1020 - DNA, 27 bp, Artificial Sequence
  Synthetic oligonucleotide
atccaattgaaaggaactgtttacaac

SEQ ID NO: 1021 - DNA, 27 bp, Artificial Sequence
  Synthetic oligonucleotide
tccaattgaaaggaactgtttacaact

SEQ ID NO: 1022 - DNA, 27 bp, Artificial Sequence
  Synthetic oligonucleotide
ccaattgaaaggaactgtttacaacta

SEQ ID NO: 1023 - DNA, 27 bp, Artificial Sequence
  Synthetic oligonucleotide
caattgaaaggaactgtttacaactat

SEQ ID NO: 1024 - DNA, 27 bp, Artificial Sequence
  Synthetic oligonucleotide
aattgaaaggaactgtttacaactata

SEQ ID NO: 1025 - DNA, 27 bp, Artificial Sequence
  Synthetic oligonucleotide
attgaaaggaactgtttacaactatag

SEQ ID NO: 1026 - DNA, 27 bp, Artificial Sequence
  Synthetic oligonucleotide
ttgaaaggaactgtttacaactatagg

SEQ ID NO: 1027 - DNA, 27 bp, Artificial Sequence
  Synthetic oligonucleotide
tgaaaggaactgtttacaactatagga

SEQ ID NO: 1028 - DNA, 27 bp, Artificial Sequence
  Synthetic oligonucleotide
gaaaggaactgtttacaactataggac

SEQ ID NO: 1029 - DNA, 27 bp, Artificial Sequence
  Synthetic oligonucleotide
aaaggaactgtttacaactataggact

SEQ ID NO: 1030 - DNA, 27 bp, Artificial Sequence
  Synthetic oligonucleotide
aaggaactgtttacaactataggactt

SEQ ID NO: 1031 - DNA, 27 bp, Artificial Sequence
  Synthetic oligonucleotide
gtgttaaaatgtctgctgtggagggaa

SEQ ID NO: 1032 - DNA, 27 bp, Artificial Sequence
  Synthetic oligonucleotide
tgttaaaatgtctgctgtggagggaat

SEQ ID NO: 1033 - DNA, 27 bp, Artificial Sequence
  Synthetic oligonucleotide
gttaaaatgtctgctgtggagggaatc

SEQ ID NO: 1034 - DNA, 27 bp, Artificial Sequence
  Synthetic oligonucleotide
ttaaaatgtctgctgtggagggaatct

SEQ ID NO: 1035 - DNA, 27 bp, Artificial Sequence
  Synthetic oligonucleotide
taaaatgtctgctgtggagggaatctg

SEQ ID NO: 1036 - DNA, 27 bp, Artificial Sequence
  Synthetic oligonucleotide
tgtgcttcctctggaaattggccttca

SEQ ID NO: 1037 - DNA, 27 bp, Artificial Sequence
  Synthetic oligonucleotide
gtgcttcctctggaaattggccttcac

SEQ ID NO: 1038 - DNA, 27 bp, Artificial Sequence
  Synthetic oligonucleotide
tgcttcctctggaaattggccttcaca

SEQ ID NO: 1039 - DNA, 27 bp, Artificial Sequence
  Synthetic oligonucleotide
gcttcctctggaaattggccttcacaa

SEQ ID NO: 1040 - DNA, 27 bp, Artificial Sequence
  Synthetic oligonucleotide
cttcctctggaaattggccttcacaac

SEQ ID NO: 1041 - DNA, 27 bp, Artificial Sequence
  Synthetic oligonucleotide
ttcctctggaaattggccttcacaaca

SEQ ID NO: 1042 - DNA, 27 bp, Artificial Sequence
  Synthetic oligonucleotide
tcctctggaaattggccttcacaacat

SEQ ID NO: 1043 - DNA, 27 bp, Artificial Sequence
  Synthetic oligonucleotide
cctctggaaattggccttcacaacatc

SEQ ID NO: 1044 - DNA, 27 bp, Artificial Sequence
  Synthetic oligonucleotide
acagaaatcaaaaggattttgagtgta

SEQ ID NO: 1045 - DNA, 27 bp, Artificial Sequence
  Synthetic oligonucleotide
cagaaatcaaaaggattttgagtgtaa

SEQ ID NO: 1046 - DNA, 27 bp, Artificial Sequence
  Synthetic oligonucleotide
atcaaaaggattttgagtgtaaaagga

SEQ ID NO: 1047 - DNA, 27 bp, Artificial Sequence
  Synthetic oligonucleotide
atatcctaacccacctccccaaaggga

SEQ ID NO: 1048 - DNA, 27 bp, Artificial Sequence
  Synthetic oligonucleotide
tatcctaacccacctccccaaagggag

SEQ ID NO: 1049 - DNA, 27 bp, Artificial Sequence
  Synthetic oligonucleotide
tcccagtattctatgtttttcactacc

SEQ ID NO: 1050 - DNA, 27 bp, Artificial Sequence
  Synthetic oligonucleotide
acaggaaatcattggaacatttttcat

SEQ ID NO: 1051 - DNA, 27 bp, Artificial Sequence
  Synthetic oligonucleotide
caggaaatcattggaacatttttcatt

SEQ ID NO: 1052 - DNA, 27 bp, Artificial Sequence
  Synthetic oligonucleotide
ttgagcattatgtcctacagaaatgct

SEQ ID NO: 1053 - DNA, 27 bp, Artificial Sequence
  Synthetic oligonucleotide
cacttggttaacagcttttgctttaag

SEQ ID NO: 1054 - DNA, 27 bp, Artificial Sequence
  Synthetic oligonucleotide
ttggttaacagcttttgctttaagagt

SEQ ID NO: 1055 - DNA, 27 bp, Artificial Sequence
  Synthetic oligonucleotide
tggttaacagcttttgctttaagagta

SEQ ID NO: 1056 - DNA, 27 bp, Artificial Sequence
  Synthetic oligonucleotide
ttgctttaagagtacttggacaagtaa

SEQ ID NO: 1057 - DNA, 27 bp, Artificial Sequence
  Synthetic oligonucleotide
tgctttaagagtacttggacaagtaaa

SEQ ID NO: 1058 - DNA, 27 bp, Artificial Sequence
  Synthetic oligonucleotide
tttaagagtacttggacaagtaaataa

SEQ ID NO: 1059 - DNA, 27 bp, Artificial Sequence
  Synthetic oligonucleotide
ttaagagtacttggacaagtaaataaa

SEQ ID NO: 1060 - DNA, 27 bp, Artificial Sequence
  Synthetic oligonucleotide
cgtagagcagaaccaaaattcaatttg

SEQ ID NO: 1061 - DNA, 27 bp, Artificial Sequence
  Synthetic oligonucleotide
gtagagcagaaccaaaattcaatttgt

SEQ ID NO: 1062 - DNA, 27 bp, Artificial Sequence
  Synthetic oligonucleotide
tagagcagaaccaaaattcaatttgta

SEQ ID NO: 1063 - DNA, 27 bp, Artificial Sequence
  Synthetic oligonucleotide
agagcagaaccaaaattcaatttgtaa

SEQ ID NO: 1064 - DNA, 27 bp, Artificial Sequence
  Synthetic oligonucleotide
ttcacagtatcaaccaataaaattaca

SEQ ID NO: 1065 - DNA, 27 bp, Artificial Sequence
  Synthetic oligonucleotide
caaccaataaaattacagggtaccttg

SEQ ID NO: 1066 - DNA, 27 bp, Artificial Sequence
  Synthetic oligonucleotide
aaccaataaaattacagggtaccttgc

SEQ ID NO: 1067 - DNA, 27 bp, Artificial Sequence
  Synthetic oligonucleotide
accaataaaattacagggtaccttgcc

SEQ ID NO: 1068 - DNA, 27 bp, Artificial Sequence
  Synthetic oligonucleotide
tactgtgattggaattagaaaggcttt

SEQ ID NO: 1069 - DNA, 27 bp, Artificial Sequence
  Synthetic oligonucleotide
actgtgattggaattagaaaggctttc

SEQ ID NO: 1070 - DNA, 27 bp, Artificial Sequence
  Synthetic oligonucleotide
ctgtgattggaattagaaaggctttcg

SEQ ID NO: 1071 - DNA, 27 bp, Artificial Sequence
  Synthetic oligonucleotide
tgtgattggaattagaaaggctttcga

SEQ ID NO: 1072 - DNA, 27 bp, Artificial Sequence
  Synthetic oligonucleotide
cgttcaattgtttcagctttgaagaga

SEQ ID NO: 1073 - DNA, 27 bp, Artificial Sequence
  Synthetic oligonucleotide
ttgaagagagaagctttggttaaaggt

SEQ ID NO: 1074 - DNA, 27 bp, Artificial Sequence
  Synthetic oligonucleotide
tgaagagagaagctttggttaaaggta

SEQ ID NO: 1075 - DNA, 27 bp, Artificial Sequence
  Synthetic oligonucleotide
gaagagagaagctttggttaaaggtaa

SEQ ID NO: 1076 - DNA, 27 bp, Artificial Sequence
  Synthetic oligonucleotide
agagaagctttggttaaaggtaatcca

SEQ ID NO: 1077 - DNA, 27 bp, Artificial Sequence
  Synthetic oligonucleotide
gagaagctttggttaaaggtaatccac

SEQ ID NO: 1078 - DNA, 27 bp, Artificial Sequence
  Synthetic oligonucleotide
acccatttatcgtttttggaaagacaa

SEQ ID NO: 1079 - DNA, 27 bp, Artificial Sequence
  Synthetic oligonucleotide
atgctttactcaccagtctgaacttga

SEQ ID NO: 1080 - DNA, 27 bp, Artificial Sequence
  Synthetic oligonucleotide
tgctttactcaccagtctgaacttgaa

SEQ ID NO: 1081 - DNA, 27 bp, Artificial Sequence
  Synthetic oligonucleotide
tactcaccagtctgaacttgaaagata

SEQ ID NO: 1082 - DNA, 27 bp, Artificial Sequence
  Synthetic oligonucleotide
caccagtctgaacttgaaagatataaa

SEQ ID NO: 1083 - DNA, 27 bp, Artificial Sequence
  Synthetic oligonucleotide
cagaagagcagaggtatggaggtggct

SEQ ID NO: 1084 - DNA, 27 bp, Artificial Sequence
  Synthetic oligonucleotide
agaagagcagaggtatggaggtggctt

SEQ ID NO: 1085 - DNA, 27 bp, Artificial Sequence
  Synthetic oligonucleotide
cggaatattcactcctggttaaacaac

SEQ ID NO: 1086 - DNA, 27 bp, Artificial Sequence
  Synthetic oligonucleotide
tgccttacataattataaaatgacaga

SEQ ID NO: 1087 - DNA, 27 bp, Artificial Sequence
  Synthetic oligonucleotide
tacatgtaacaactgtagttcacaaaa

SEQ ID NO: 1088 - DNA, 27 bp, Artificial Sequence
  Synthetic oligonucleotide
ctgaggaagtttgcagcttttatttga

SEQ ID NO: 1089 - DNA, 27 bp, Artificial Sequence
  Synthetic oligonucleotide
tgaggaagtttgcagcttttatttgaa

SEQ ID NO: 1090 - DNA, 27 bp, Artificial Sequence
  Synthetic oligonucleotide
gaggaagtttgcagcttttatttgaaa

SEQ ID NO: 1091 - DNA, 27 bp, Artificial Sequence
  Synthetic oligonucleotide
aggaagtttgcagcttttatttgaaaa

SEQ ID NO: 1092 - DNA, 27 bp, Artificial Sequence
  Synthetic oligonucleotide
ggaagtttgcagcttttatttgaaaat

SEQ ID NO: 1093 - DNA, 27 bp, Artificial Sequence
  Synthetic oligonucleotide
gaagtttgcagcttttatttgaaaatc

SEQ ID NO: 1094 - DNA, 27 bp, Artificial Sequence
  Synthetic oligonucleotide
aagtttgcagcttttatttgaaaatcg

SEQ ID NO: 1095 - DNA, 27 bp, Artificial Sequence
  Synthetic oligonucleotide
agtttgcagcttttatttgaaaatcga

SEQ ID NO: 1096 - DNA, 27 bp, Artificial Sequence
  Synthetic oligonucleotide
ttgcagcttttatttgaaaatcgatac

SEQ ID NO: 1097 - DNA, 27 bp, Artificial Sequence
  Synthetic oligonucleotide
cgatactcaggatattgaagcatccca

SEQ ID NO: 1098 - DNA, 27 bp, Artificial Sequence
  Synthetic oligonucleotide
ctcaggatattgaagcatcccactaca

SEQ ID NO: 1099 - DNA, 27 bp, Artificial Sequence
  Synthetic oligonucleotide
agtagcatgtgccagctacaagcccag

SEQ ID NO: 1100 - DNA, 27 bp, Artificial Sequence
  Synthetic oligonucleotide
gtagcatgtgccagctacaagcccagc

SEQ ID NO: 1101 - DNA, 27 bp, Artificial Sequence
  Synthetic oligonucleotide
tagcatgtgccagctacaagcccagca

SEQ ID NO: 1102 - DNA, 27 bp, Artificial Sequence
  Synthetic oligonucleotide
agcatgtgccagctacaagcccagcag

SEQ ID NO: 1103 - DNA, 27 bp, Artificial Sequence
  Synthetic oligonucleotide
gcatgtgccagctacaagcccagcagg

SEQ ID NO: 1104 - DNA, 27 bp, Artificial Sequence
  Synthetic oligonucleotide
catgtgccagctacaagcccagcaggg

SEQ ID NO: 1105 - DNA, 27 bp, Artificial Sequence
  Synthetic oligonucleotide
atgtgccagctacaagcccagcaggga

SEQ ID NO: 1106 - DNA, 27 bp, Artificial Sequence
  Synthetic oligonucleotide
tgtgccagctacaagcccagcagggaa

SEQ ID NO: 1107 - DNA, 27 bp, Artificial Sequence
  Synthetic oligonucleotide
gtgccagctacaagcccagcagggaag

SEQ ID NO: 1108 - DNA, 27 bp, Artificial Sequence
  Synthetic oligonucleotide
aagatggacatgttattctgcaactga

SEQ ID NO: 1109 - DNA, 27 bp, Artificial Sequence
  Synthetic oligonucleotide
agatggacatgttattctgcaactgaa

SEQ ID NO: 1110 - DNA, 27 bp, Artificial Sequence
  Synthetic oligonucleotide
atggacatgttattctgcaactgaatt

SEQ ID NO: 1111 - DNA, 27 bp, Artificial Sequence
  Synthetic oligonucleotide
ggacatgttattctgcaactgaattcg

SEQ ID NO: 1112 - DNA, 27 bp, Artificial Sequence
  Synthetic oligonucleotide
gacatgttattctgcaactgaattcga

SEQ ID NO: 1113 - DNA, 27 bp, Artificial Sequence
  Synthetic oligonucleotide
acatgttattctgcaactgaattcgat

SEQ ID NO: 1114 - DNA, 27 bp, Artificial Sequence
  Synthetic oligonucleotide
ttattctgcaactgaattcgattccct

SEQ ID NO: 1115 - DNA, 27 bp, Artificial Sequence
  Synthetic oligonucleotide
tattctgcaactgaattcgattccctc

SEQ ID NO: 1116 - DNA, 27 bp, Artificial Sequence
  Synthetic oligonucleotide
cagataaacagtgtaccatgttttata

SEQ ID NO: 1117 - DNA, 27 bp, Artificial Sequence
  Synthetic oligonucleotide
agataaacagtgtaccatgttttatag

SEQ ID NO: 1118 - DNA, 27 bp, Artificial Sequence
  Synthetic oligonucleotide
ataaacagtgtaccatgttttatagca

SEQ ID NO: 1119 - DNA, 27 bp, Artificial Sequence
  Synthetic oligonucleotide
aaacagtgtaccatgttttatagcact

SEQ ID NO: 1120 - DNA, 27 bp, Artificial Sequence
  Synthetic oligonucleotide
ttatagcacttccaatatcaaaattca

SEQ ID NO: 1121 - DNA, 27 bp, Artificial Sequence
  Synthetic oligonucleotide
aattcagaaagtctgtgaaggagccgc

SEQ ID NO: 1122 - DNA, 27 bp, Artificial Sequence
  Synthetic oligonucleotide
attcagaaagtctgtgaaggagccgcg

SEQ ID NO: 1123 - DNA, 27 bp, Artificial Sequence
  Synthetic oligonucleotide
ttcagaaagtctgtgaaggagccgcgt

SEQ ID NO: 1124 - DNA, 27 bp, Artificial Sequence
  Synthetic oligonucleotide
tcagaaagtctgtgaaggagccgcgtg

SEQ ID NO: 1125 - DNA, 27 bp, Artificial Sequence
  Synthetic oligonucleotide
aaccagagattgcatatgcttataaag

SEQ ID NO: 1126 - DNA, 27 bp, Artificial Sequence
  Synthetic oligonucleotide
accagagattgcatatgcttataaagt

SEQ ID NO: 1127 - DNA, 27 bp, Artificial Sequence
  Synthetic oligonucleotide
ccagagattgcatatgcttataaagtt

SEQ ID NO: 1128 - DNA, 27 bp, Artificial Sequence
  Synthetic oligonucleotide
cagagattgcatatgcttataaagtta

SEQ ID NO: 1129 - DNA, 27 bp, Artificial Sequence
  Synthetic oligonucleotide
agagattgcatatgcttataaagttag

SEQ ID NO: 1130 - DNA, 27 bp, Artificial Sequence
  Synthetic oligonucleotide
gtagaaaatgtttttgtcaagtacaag

SEQ ID NO: 1131 - DNA, 27 bp, Artificial Sequence
  Synthetic oligonucleotide
tagaaaatgtttttgtcaagtacaagg

SEQ ID NO: 1132 - DNA, 27 bp, Artificial Sequence
  Synthetic oligonucleotide
agaaaatgtttttgtcaagtacaaggc

SEQ ID NO: 1133 - DNA, 27 bp, Artificial Sequence
  Synthetic oligonucleotide
gaaaatgtttttgtcaagtacaaggca

SEQ ID NO: 1134 - DNA, 27 bp, Artificial Sequence
  Synthetic oligonucleotide
aaaatgtttttgtcaagtacaaggcaa

SEQ ID NO: 1135 - DNA, 27 bp, Artificial Sequence
  Synthetic oligonucleotide
ctccagataaaatacaatttcagtttc

SEQ ID NO: 1136 - DNA, 27 bp, Artificial Sequence
  Synthetic oligonucleotide
acatgttcatcgtgtcaagcattttta

SEQ ID NO: 1137 - DNA, 27 bp, Artificial Sequence
  Synthetic oligonucleotide
ttcatcgtgtcaagcatttttagctaa

SEQ ID NO: 1138 - DNA, 27 bp, Artificial Sequence
  Synthetic oligonucleotide
tcgtgtcaagcatttttagctaattta

SEQ ID NO: 1139 - DNA, 27 bp, Artificial Sequence
  Synthetic oligonucleotide
tcaagcatttttagctaatttagatga

SEQ ID NO: 1140 - DNA, 27 bp, Artificial Sequence
  Synthetic oligonucleotide
aatggatgctaaaattcctgaagttca

SEQ ID NO: 1141 - DNA, 27 bp, Artificial Sequence
  Synthetic oligonucleotide
ttatggactcctgttgttgaagttcgt

SEQ ID NO: 1142 - DNA, 27 bp, Artificial Sequence
  Synthetic oligonucleotide
atggactcctgttgttgaagttcgttt

SEQ ID NO: 1143 - DNA, 27 bp, Artificial Sequence
  Synthetic oligonucleotide
tggactcctgttgttgaagttcgtttt

SEQ ID NO: 1144 - DNA, 27 bp, Artificial Sequence
  Synthetic oligonucleotide
acttgcttttattagagaatgatttca

SEQ ID NO: 1145 - DNA, 27 bp, Artificial Sequence
  Synthetic oligonucleotide
cttgcttttattagagaatgatttcaa

SEQ ID NO: 1146 - DNA, 27 bp, Artificial Sequence
  Synthetic oligonucleotide
ttgcttttattagagaatgatttcaaa

SEQ ID NO: 1147 - DNA, 27 bp, Artificial Sequence
  Synthetic oligonucleotide
tgcttttattagagaatgatttcaaat

SEQ ID NO: 1148 - DNA, 27 bp, Artificial Sequence
  Synthetic oligonucleotide
gacagatactcctccaaggttattgga

SEQ ID NO: 1149 - DNA, 27 bp, Artificial Sequence
  Synthetic oligonucleotide
atcattaaagcctgagtttgctttcaa

SEQ ID NO: 1150 - DNA, 27 bp, Artificial Sequence
  Synthetic oligonucleotide
tcattaaagcctgagtttgctttcaaa

SEQ ID NO: 1151 - DNA, 27 bp, Artificial Sequence
  Synthetic oligonucleotide
ttaaagcctgagtttgctttcaaaaaa

SEQ ID NO: 1152 - DNA, 27 bp, Artificial Sequence
  Synthetic oligonucleotide
taaagcctgagtttgctttcaaaaaaa

SEQ ID NO: 1153 - RNA, 25 nt, Artificial Sequence
  Synthetic oligonucleotide
auaugucauuucagcaccaaaaaua

SEQ ID NO: 1154 - RNA, 25 nt, Artificial Sequence
  Synthetic oligonucleotide
auugugauucaaguuuauggauaca

SEQ ID NO: 1155 - RNA, 25 nt, Artificial Sequence
  Synthetic oligonucleotide
uugugauucaaguuuauggauacac

SEQ ID NO: 1156 - RNA, 25 nt, Artificial Sequence
  Synthetic oligonucleotide
ugugauucaaguuuauggauacacu

SEQ ID NO: 1157 - RNA, 25 nt, Artificial Sequence
  Synthetic oligonucleotide
gugauucaaguuuauggauacacug

SEQ ID NO: 1158 - RNA, 25 nt, Artificial Sequence
  Synthetic oligonucleotide
ugauucaaguuuauggauacacuga

SEQ ID NO: 1159 - RNA, 25 nt, Artificial Sequence
  Synthetic oligonucleotide
gauucaaguuuauggauacacugaa

SEQ ID NO: 1160 - RNA, 25 nt, Artificial Sequence
  Synthetic oligonucleotide
auucaaguuuauggauacacugaag

SEQ ID NO: 1161 - RNA, 25 nt, Artificial Sequence
  Synthetic oligonucleotide
uucaaguuuauggauacacugaagc

SEQ ID NO: 1162 - RNA, 25 nt, Artificial Sequence
  Synthetic oligonucleotide
ucaaguuuauggauacacugaagca

SEQ ID NO: 1163 - RNA, 25 nt, Artificial Sequence
  Synthetic oligonucleotide
caaguuuauggauacacugaagcau

SEQ ID NO: 1164 - RNA, 25 nt, Artificial Sequence
  Synthetic oligonucleotide
aaguuuauggauacacugaagcauu

SEQ ID NO: 1165 - RNA, 25 nt, Artificial Sequence
  Synthetic oligonucleotide
aguuuauggauacacugaagcauuu

SEQ ID NO: 1166 - RNA, 25 nt, Artificial Sequence
  Synthetic oligonucleotide
uuuauggauacacugaagcauuuga

SEQ ID NO: 1167 - RNA, 25 nt, Artificial Sequence
  Synthetic oligonucleotide
uuauggauacacugaagcauuugau

SEQ ID NO: 1168 - RNA, 25 nt, Artificial Sequence
  Synthetic oligonucleotide
auggauacacugaagcauuugaugc

SEQ ID NO: 1169 - RNA, 25 nt, Artificial Sequence
  Synthetic oligonucleotide
ggauacacugaagcauuugaugcaa

SEQ ID NO: 1170 - RNA, 25 nt, Artificial Sequence
  Synthetic oligonucleotide
gauacacugaagcauuugaugcaac

SEQ ID NO: 1171 - RNA, 25 nt, Artificial Sequence
  Synthetic oligonucleotide
auacacugaagcauuugaugcaaca

SEQ ID NO: 1172 - RNA, 25 nt, Artificial Sequence
  Synthetic oligonucleotide
uacacugaagcauuugaugcaacaa

SEQ ID NO: 1173 - RNA, 25 nt, Artificial Sequence
  Synthetic oligonucleotide
acacugaagcauuugaugcaacaau

SEQ ID NO: 1174 - RNA, 25 nt, Artificial Sequence
  Synthetic oligonucleotide
cacugaagcauuugaugcaacaauc

SEQ ID NO: 1175 - RNA, 25 nt, Artificial Sequence
  Synthetic oligonucleotide
acugaagcauuugaugcaacaaucu

SEQ ID NO: 1176 - RNA, 25 nt, Artificial Sequence
  Synthetic oligonucleotide
cugaagcauuugaugcaacaaucuc

SEQ ID NO: 1177 - RNA, 25 nt, Artificial Sequence
  Synthetic oligonucleotide
gaagcauuugaugcaacaaucucua

SEQ ID NO: 1178 - RNA, 25 nt, Artificial Sequence
  Synthetic oligonucleotide
agcauuugaugcaacaaucucuauu

SEQ ID NO: 1179 - RNA, 25 nt, Artificial Sequence
  Synthetic oligonucleotide
cauuugaugcaacaaucucuauuaa

SEQ ID NO: 1180 - RNA, 25 nt, Artificial Sequence
  Synthetic oligonucleotide
ugaugcaacaaucucuauuaaaagu

SEQ ID NO: 1181 - RNA, 25 nt, Artificial Sequence
  Synthetic oligonucleotide
gaugcaacaaucucuauuaaaaguu

SEQ ID NO: 1182 - RNA, 25 nt, Artificial Sequence
  Synthetic oligonucleotide
augcaacaaucucuauuaaaaguua

SEQ ID NO: 1183 - RNA, 25 nt, Artificial Sequence
  Synthetic oligonucleotide
ugcaacaaucucuauuaaaaguuau

SEQ ID NO: 1184 - RNA, 25 nt, Artificial Sequence
  Synthetic oligonucleotide
acaaucucuauuaaaaguuauccug

SEQ ID NO: 1185 - RNA, 25 nt, Artificial Sequence
  Synthetic oligonucleotide
caaucucuauuaaaaguuauccuga

SEQ ID NO: 1186 - RNA, 25 nt, Artificial Sequence
  Synthetic oligonucleotide
cuauuaaaaguuauccugauaaaaa

SEQ ID NO: 1187 - RNA, 25 nt, Artificial Sequence
  Synthetic oligonucleotide
auuaaaaguuauccugauaaaaaau

SEQ ID NO: 1188 - RNA, 25 nt, Artificial Sequence
  Synthetic oligonucleotide
aaaaguuauccugauaaaaaauuua

SEQ ID NO: 1189 - RNA, 25 nt, Artificial Sequence
  Synthetic oligonucleotide
aaaguuauccugauaaaaaauuuag

SEQ ID NO: 1190 - RNA, 25 nt, Artificial Sequence
  Synthetic oligonucleotide
guuauccugauaaaaaauuuaguua

SEQ ID NO: 1191 - RNA, 25 nt, Artificial Sequence
  Synthetic oligonucleotide
uuauccugauaaaaaauuuaguuac

SEQ ID NO: 1192 - RNA, 25 nt, Artificial Sequence
  Synthetic oligonucleotide
guucauuuauccucagagaauaaau

SEQ ID NO: 1193 - RNA, 25 nt, Artificial Sequence
  Synthetic oligonucleotide
uucauuuauccucagagaauaaauu

SEQ ID NO: 1194 - RNA, 25 nt, Artificial Sequence
  Synthetic oligonucleotide
guauuuggaaguuguaucaaagcau

SEQ ID NO: 1195 - RNA, 25 nt, Artificial Sequence
  Synthetic oligonucleotide
uauuuggaaguuguaucaaagcauu

SEQ ID NO: 1196 - RNA, 25 nt, Artificial Sequence
  Synthetic oligonucleotide
uuggaaguuguaucaaagcauuuuu

SEQ ID NO: 1197 - RNA, 25 nt, Artificial Sequence
  Synthetic oligonucleotide
uggaaguuguaucaaagcauuuuuc

SEQ ID NO: 1198 - RNA, 25 nt, Artificial Sequence
  Synthetic oligonucleotide
ggaaguuguaucaaagcauuuuuca

SEQ ID NO: 1199 - RNA, 25 nt, Artificial Sequence
  Synthetic oligonucleotide
gaaguuguaucaaagcauuuuucaa

SEQ ID NO: 1200 - RNA, 25 nt, Artificial Sequence
  Synthetic oligonucleotide
aaguuguaucaaagcauuuuucaaa

SEQ ID NO: 1201 - RNA, 25 nt, Artificial Sequence
  Synthetic oligonucleotide
aguuguaucaaagcauuuuucaaaa

SEQ ID NO: 1202 - RNA, 25 nt, Artificial Sequence
  Synthetic oligonucleotide
guuguaucaaagcauuuuucaaaau

SEQ ID NO: 1203 - RNA, 25 nt, Artificial Sequence
  Synthetic oligonucleotide
uuguaucaaagcauuuuucaaaauc

SEQ ID NO: 1204 - RNA, 25 nt, Artificial Sequence
  Synthetic oligonucleotide
uguaucaaagcauuuuucaaaauca

SEQ ID NO: 1205 - RNA, 25 nt, Artificial Sequence
  Synthetic oligonucleotide
guaucaaagcauuuuucaaaaucaa

SEQ ID NO: 1206 - RNA, 25 nt, Artificial Sequence
  Synthetic oligonucleotide
aauaaccuaugacaauggauuucuc

SEQ ID NO: 1207 - RNA, 25 nt, Artificial Sequence
  Synthetic oligonucleotide
cuaugacaauggauuucucuucauu

SEQ ID NO: 1208 - RNA, 25 nt, Artificial Sequence
  Synthetic oligonucleotide
gacaauggauuucucuucauucaua

SEQ ID NO: 1209 - RNA, 25 nt, Artificial Sequence
  Synthetic oligonucleotide
acaauggauuucucuucauucauac

SEQ ID NO: 1210 - RNA, 25 nt, Artificial Sequence
  Synthetic oligonucleotide
caauggauuucucuucauucauaca

SEQ ID NO: 1211 - RNA, 25 nt, Artificial Sequence
  Synthetic oligonucleotide
auggauuucucuucauucauacaga

SEQ ID NO: 1212 - RNA, 25 nt, Artificial Sequence
  Synthetic oligonucleotide
uggauuucucuucauucauacagac

SEQ ID NO: 1213 - RNA, 25 nt, Artificial Sequence
  Synthetic oligonucleotide
gauuucucuucauucauacagacaa

SEQ ID NO: 1214 - RNA, 25 nt, Artificial Sequence
  Synthetic oligonucleotide
auucauacagacaaaccuguuuaua

SEQ ID NO: 1215 - RNA, 25 nt, Artificial Sequence
  Synthetic oligonucleotide
ucauacagacaaaccuguuuauacu

SEQ ID NO: 1216 - RNA, 25 nt, Artificial Sequence
  Synthetic oligonucleotide
cauacagacaaaccuguuuauacuc

SEQ ID NO: 1217 - RNA, 25 nt, Artificial Sequence
  Synthetic oligonucleotide
auacagacaaaccuguuuauacucc

SEQ ID NO: 1218 - RNA, 25 nt, Artificial Sequence
  Synthetic oligonucleotide
guuagaguuuauucguugaaugacg

SEQ ID NO: 1219 - RNA, 25 nt, Artificial Sequence
  Synthetic oligonucleotide
ugacgacuugaagccagccaaaaga

SEQ ID NO: 1220 - RNA, 25 nt, Artificial Sequence
  Synthetic oligonucleotide
gacgacuugaagccagccaaaagag

SEQ ID NO: 1221 - RNA, 25 nt, Artificial Sequence
  Synthetic oligonucleotide
acgacuugaagccagccaaaagaga

SEQ ID NO: 1222 - RNA, 25 nt, Artificial Sequence
  Synthetic oligonucleotide
cgacuugaagccagccaaaagagaa

SEQ ID NO: 1223 - RNA, 25 nt, Artificial Sequence
  Synthetic oligonucleotide
agaaacugucuuaacuuucauagau

SEQ ID NO: 1224 - RNA, 25 nt, Artificial Sequence
  Synthetic oligonucleotide
acugucuuaacuuucauagauccug

SEQ ID NO: 1225 - RNA, 25 nt, Artificial Sequence
  Synthetic oligonucleotide
cugucuuaacuuucauagauccuga

SEQ ID NO: 1226 - RNA, 25 nt, Artificial Sequence
  Synthetic oligonucleotide
gaaggaucagaaguugacaugguag

SEQ ID NO: 1227 - RNA, 25 nt, Artificial Sequence
  Synthetic oligonucleotide
aaggaucagaaguugacaugguaga

SEQ ID NO: 1228 - RNA, 25 nt, Artificial Sequence
  Synthetic oligonucleotide
gacaugguagaagaaauugaucaua

SEQ ID NO: 1229 - RNA, 25 nt, Artificial Sequence
  Synthetic oligonucleotide
acaugguagaagaaauugaucauau

SEQ ID NO: 1230 - RNA, 25 nt, Artificial Sequence
  Synthetic oligonucleotide
gguagaagaaauugaucauauugga

SEQ ID NO: 1231 - RNA, 25 nt, Artificial Sequence
  Synthetic oligonucleotide
guagaagaaauugaucauauuggaa

SEQ ID NO: 1232 - RNA, 25 nt, Artificial Sequence
  Synthetic oligonucleotide
aagaaauugaucauauuggaauuau

SEQ ID NO: 1233 - RNA, 25 nt, Artificial Sequence
  Synthetic oligonucleotide
agaaauugaucauauuggaauuauc

SEQ ID NO: 1234 - RNA, 25 nt, Artificial Sequence
  Synthetic oligonucleotide
ggaauuaucucuuuuccugacuuca

SEQ ID NO: 1235 - RNA, 25 nt, Artificial Sequence
  Synthetic oligonucleotide
gaauuaucucuuuuccugacuucaa

SEQ ID NO: 1236 - RNA, 25 nt, Artificial Sequence
  Synthetic oligonucleotide
aauuaucucuuuuccugacuucaag

SEQ ID NO: 1237 - RNA, 25 nt, Artificial Sequence
  Synthetic oligonucleotide
auuaucucuuuuccugacuucaaga

SEQ ID NO: 1238 - RNA, 25 nt, Artificial Sequence
  Synthetic oligonucleotide
uuaucucuuuuccugacuucaagau

SEQ ID NO: 1239 - RNA, 25 nt, Artificial Sequence
  Synthetic oligonucleotide
uaucucuuuuccugacuucaagauu

SEQ ID NO: 1240 - RNA, 25 nt, Artificial Sequence
  Synthetic oligonucleotide
aucucuuuuccugacuucaagauuc

SEQ ID NO: 1241 - RNA, 25 nt, Artificial Sequence
  Synthetic oligonucleotide
ucucuuuuccugacuucaagauucc

SEQ ID NO: 1242 - RNA, 25 nt, Artificial Sequence
  Synthetic oligonucleotide
cucuuuuccugacuucaagauuccg

SEQ ID NO: 1243 - RNA, 25 nt, Artificial Sequence
  Synthetic oligonucleotide
ucuuuuccugacuucaagauuccgu

SEQ ID NO: 1244 - RNA, 25 nt, Artificial Sequence
  Synthetic oligonucleotide
cuuuuccugacuucaagauuccguc

SEQ ID NO: 1245 - RNA, 25 nt, Artificial Sequence
  Synthetic oligonucleotide
uuuuccugacuucaagauuccgucu

SEQ ID NO: 1246 - RNA, 25 nt, Artificial Sequence
  Synthetic oligonucleotide
uuuccugacuucaagauuccgucua

SEQ ID NO: 1247 - RNA, 25 nt, Artificial Sequence
  Synthetic oligonucleotide
uuccugacuucaagauuccgucuaa

SEQ ID NO: 1248 - RNA, 25 nt, Artificial Sequence
  Synthetic oligonucleotide
uuaaagaauaugucuugccacauuu

SEQ ID NO: 1249 - RNA, 25 nt, Artificial Sequence
  Synthetic oligonucleotide
uaaagaauaugucuugccacauuuu

SEQ ID NO: 1250 - RNA, 25 nt, Artificial Sequence
  Synthetic oligonucleotide
aaagaauaugucuugccacauuuuu

SEQ ID NO: 1251 - RNA, 25 nt, Artificial Sequence
  Synthetic oligonucleotide
aagaacuuuaagaauuuugaaauua

SEQ ID NO: 1252 - RNA, 25 nt, Artificial Sequence
  Synthetic oligonucleotide
agaacuuuaagaauuuugaaauuac

SEQ ID NO: 1253 - RNA, 25 nt, Artificial Sequence
  Synthetic oligonucleotide
cuuuaagaauuuugaaauuacuaua

SEQ ID NO: 1254 - RNA, 25 nt, Artificial Sequence
  Synthetic oligonucleotide
gaauuuugaaauuacuauaaaagca

SEQ ID NO: 1255 - RNA, 25 nt, Artificial Sequence
  Synthetic oligonucleotide
aauuuugaaauuacuauaaaagcaa

SEQ ID NO: 1256 - RNA, 25 nt, Artificial Sequence
  Synthetic oligonucleotide
auuuugaaauuacuauaaaagcaag

SEQ ID NO: 1257 - RNA, 25 nt, Artificial Sequence
  Synthetic oligonucleotide
uugaaauuacuauaaaagcaagaua

SEQ ID NO: 1258 - RNA, 25 nt, Artificial Sequence
  Synthetic oligonucleotide
ugaaauuacuauaaaagcaagauau

SEQ ID NO: 1259 - RNA, 25 nt, Artificial Sequence
  Synthetic oligonucleotide
gaaauuacuauaaaagcaagauauu

SEQ ID NO: 1260 - RNA, 25 nt, Artificial Sequence
  Synthetic oligonucleotide
aaagcaagauauuuuuauaauaaag

SEQ ID NO: 1261 - RNA, 25 nt, Artificial Sequence
  Synthetic oligonucleotide
aagcaagauauuuuuauaauaaagu

SEQ ID NO: 1262 - RNA, 25 nt, Artificial Sequence
  Synthetic oligonucleotide
agcaagauauuuuuauaauaaagua

SEQ ID NO: 1263 - RNA, 25 nt, Artificial Sequence
  Synthetic oligonucleotide
gcaagauauuuuuauaauaaaguag

SEQ ID NO: 1264 - RNA, 25 nt, Artificial Sequence
  Synthetic oligonucleotide
caagauauuuuuauaauaaaguagu

SEQ ID NO: 1265 - RNA, 25 nt, Artificial Sequence
  Synthetic oligonucleotide
aagauauuuuuauaauaaaguaguc

SEQ ID NO: 1266 - RNA, 25 nt, Artificial Sequence
  Synthetic oligonucleotide
agauauuuuuauaauaaaguaguca

SEQ ID NO: 1267 - RNA, 25 nt, Artificial Sequence
  Synthetic oligonucleotide
gauauuuuuauaauaaaguagucac

SEQ ID NO: 1268 - RNA, 25 nt, Artificial Sequence
  Synthetic oligonucleotide
caauguugauaaauggaauugcuca

SEQ ID NO: 1269 - RNA, 25 nt, Artificial Sequence
  Synthetic oligonucleotide
aauguugauaaauggaauugcucaa

SEQ ID NO: 1270 - RNA, 25 nt, Artificial Sequence
  Synthetic oligonucleotide
uguugauaaauggaauugcucaagu

SEQ ID NO: 1271 - RNA, 25 nt, Artificial Sequence
  Synthetic oligonucleotide
guugauaaauggaauugcucaaguc

SEQ ID NO: 1272 - RNA, 25 nt, Artificial Sequence
  Synthetic oligonucleotide
uugauaaauggaauugcucaaguca

SEQ ID NO: 1273 - RNA, 25 nt, Artificial Sequence
  Synthetic oligonucleotide
auaaauggaauugcucaagucacau

SEQ ID NO: 1274 - RNA, 25 nt, Artificial Sequence
  Synthetic oligonucleotide
auggaauugcucaagucacauuuga

SEQ ID NO: 1275 - RNA, 25 nt, Artificial Sequence
  Synthetic oligonucleotide
cucaagucacauuugauucugaaac

SEQ ID NO: 1276 - RNA, 25 nt, Artificial Sequence
  Synthetic oligonucleotide
caagucacauuugauucugaaacag

SEQ ID NO: 1277 - RNA, 25 nt, Artificial Sequence
  Synthetic oligonucleotide
aagucacauuugauucugaaacagc

SEQ ID NO: 1278 - RNA, 25 nt, Artificial Sequence
  Synthetic oligonucleotide
agucacauuugauucugaaacagca

SEQ ID NO: 1279 - RNA, 25 nt, Artificial Sequence
  Synthetic oligonucleotide
cauuugauucugaaacagcagucaa

SEQ ID NO: 1280 - RNA, 25 nt, Artificial Sequence
  Synthetic oligonucleotide
uuugauucugaaacagcagucaaag

SEQ ID NO: 1281 - RNA, 25 nt, Artificial Sequence
  Synthetic oligonucleotide
uugauucugaaacagcagucaaaga

SEQ ID NO: 1282 - RNA, 25 nt, Artificial Sequence
  Synthetic oligonucleotide
cagcagucaaagaacugucauacua

SEQ ID NO: 1283 - RNA, 25 nt, Artificial Sequence
  Synthetic oligonucleotide
gcagucaaagaacugucauacuaca

SEQ ID NO: 1284 - RNA, 25 nt, Artificial Sequence
  Synthetic oligonucleotide
gucaaagaacugucauacuacaguu

SEQ ID NO: 1285 - RNA, 25 nt, Artificial Sequence
  Synthetic oligonucleotide
aagaacugucauacuacaguuuaga

SEQ ID NO: 1286 - RNA, 25 nt, Artificial Sequence
  Synthetic oligonucleotide
agaacugucauacuacaguuuagaa

SEQ ID NO: 1287 - RNA, 25 nt, Artificial Sequence
  Synthetic oligonucleotide
aacugucauacuacaguuuagaaga

SEQ ID NO: 1288 - RNA, 25 nt, Artificial Sequence
  Synthetic oligonucleotide
uuaaacaacaaguaccuuuauauug

SEQ ID NO: 1289 - RNA, 25 nt, Artificial Sequence
  Synthetic oligonucleotide
uaaacaacaaguaccuuuauauugc

SEQ ID NO: 1290 - RNA, 25 nt, Artificial Sequence
  Synthetic oligonucleotide
aaacaacaaguaccuuuauauugcu

SEQ ID NO: 1291 - RNA, 25 nt, Artificial Sequence
  Synthetic oligonucleotide
aacaacaaguaccuuuauauugcug

SEQ ID NO: 1292 - RNA, 25 nt, Artificial Sequence
  Synthetic oligonucleotide
acaacaaguaccuuuauauugcugu

SEQ ID NO: 1293 - RNA, 25 nt, Artificial Sequence
  Synthetic oligonucleotide
caacaaguaccuuuauauugcugua

SEQ ID NO: 1294 - RNA, 25 nt, Artificial Sequence
  Synthetic oligonucleotide
aacaaguaccuuuauauugcuguaa

SEQ ID NO: 1295 - RNA, 25 nt, Artificial Sequence
  Synthetic oligonucleotide
acaaguaccuuuauauugcuguaac

SEQ ID NO: 1296 - RNA, 25 nt, Artificial Sequence
  Synthetic oligonucleotide
caaguaccuuuauauugcuguaaca

SEQ ID NO: 1297 - RNA, 25 nt, Artificial Sequence
  Synthetic oligonucleotide
aaguaccuuuauauugcuguaacag

SEQ ID NO: 1298 - RNA, 25 nt, Artificial Sequence
  Synthetic oligonucleotide
aguaccuuuauauugcuguaacagu

SEQ ID NO: 1299 - RNA, 25 nt, Artificial Sequence
  Synthetic oligonucleotide
guaccuuuauauugcuguaacaguc

SEQ ID NO: 1300 - RNA, 25 nt, Artificial Sequence
  Synthetic oligonucleotide
accuuuauauugcuguaacagucau

SEQ ID NO: 1301 - RNA, 25 nt, Artificial Sequence
  Synthetic oligonucleotide
ucaaauauguccucucucccuacaa

SEQ ID NO: 1302 - RNA, 25 nt, Artificial Sequence
  Synthetic oligonucleotide
cccuacaaacugaauuugguugcua

SEQ ID NO: 1303 - RNA, 25 nt, Artificial Sequence
  Synthetic oligonucleotide
acaaacugaauuugguugcuacucc

SEQ ID NO: 1304 - RNA, 25 nt, Artificial Sequence
  Synthetic oligonucleotide
caaacugaauuugguugcuacuccu

SEQ ID NO: 1305 - RNA, 25 nt, Artificial Sequence
  Synthetic oligonucleotide
cugaaugcacaaacaauugauguaa

SEQ ID NO: 1306 - RNA, 25 nt, Artificial Sequence
  Synthetic oligonucleotide
ugaaugcacaaacaauugauguaaa

SEQ ID NO: 1307 - RNA, 25 nt, Artificial Sequence
  Synthetic oligonucleotide
caagagacaucugacuuggauccaa

SEQ ID NO: 1308 - RNA, 25 nt, Artificial Sequence
  Synthetic oligonucleotide
aagagacaucugacuuggauccaag

SEQ ID NO: 1309 - RNA, 25 nt, Artificial Sequence
  Synthetic oligonucleotide
gguuaccgagcaauagcauacucau

SEQ ID NO: 1310 - RNA, 25 nt, Artificial Sequence
  Synthetic oligonucleotide
ucagccaaaguuaccuuuauauuga

SEQ ID NO: 1311 - RNA, 25 nt, Artificial Sequence
  Synthetic oligonucleotide
cagccaaaguuaccuuuauauugau

SEQ ID NO: 1312 - RNA, 25 nt, Artificial Sequence
  Synthetic oligonucleotide
agccaaaguuaccuuuauauugauu

SEQ ID NO: 1313 - RNA, 25 nt, Artificial Sequence
  Synthetic oligonucleotide
gccaaaguuaccuuuauauugauug

SEQ ID NO: 1314 - RNA, 25 nt, Artificial Sequence
  Synthetic oligonucleotide
aaaagcccauauauugacaaaauaa

SEQ ID NO: 1315 - RNA, 25 nt, Artificial Sequence
  Synthetic oligonucleotide
gcccauauauugacaaaauaacuca

SEQ ID NO: 1316 - RNA, 25 nt, Artificial Sequence
  Synthetic oligonucleotide
cccauauauugacaaaauaacucac

SEQ ID NO: 1317 - RNA, 25 nt, Artificial Sequence
  Synthetic oligonucleotide
cauauauugacaaaauaacucacua

SEQ ID NO: 1318 - RNA, 25 nt, Artificial Sequence
  Synthetic oligonucleotide
auauauugacaaaauaacucacuau

SEQ ID NO: 1319 - RNA, 25 nt, Artificial Sequence
  Synthetic oligonucleotide
uauauugacaaaauaacucacuaua

SEQ ID NO: 1320 - RNA, 25 nt, Artificial Sequence
  Synthetic oligonucleotide
auugacaaaauaacucacuauaauu

SEQ ID NO: 1321 - RNA, 25 nt, Artificial Sequence
  Synthetic oligonucleotide
ugacaaaauaacucacuauaauuac

SEQ ID NO: 1322 - RNA, 25 nt, Artificial Sequence
  Synthetic oligonucleotide
gacaaaauaacucacuauaauuacu

SEQ ID NO: 1323 - RNA, 25 nt, Artificial Sequence
  Synthetic oligonucleotide
acaaaauaacucacuauaauuacuu

SEQ ID NO: 1324 - RNA, 25 nt, Artificial Sequence
  Synthetic oligonucleotide
caaaauaacucacuauaauuacuug

SEQ ID NO: 1325 - RNA, 25 nt, Artificial Sequence
  Synthetic oligonucleotide
aaaauaacucacuauaauuacuuga

SEQ ID NO: 1326 - RNA, 25 nt, Artificial Sequence
  Synthetic oligonucleotide
aaauaacucacuauaauuacuugau

SEQ ID NO: 1327 - RNA, 25 nt, Artificial Sequence
  Synthetic oligonucleotide
aauaacucacuauaauuacuugauu

SEQ ID NO: 1328 - RNA, 25 nt, Artificial Sequence
  Synthetic oligonucleotide
auaacucacuauaauuacuugauuu

SEQ ID NO: 1329 - RNA, 25 nt, Artificial Sequence
  Synthetic oligonucleotide
uaacucacuauaauuacuugauuuu

SEQ ID NO: 1330 - RNA, 25 nt, Artificial Sequence
  Synthetic oligonucleotide
aacucacuauaauuacuugauuuua

SEQ ID NO: 1331 - RNA, 25 nt, Artificial Sequence
  Synthetic oligonucleotide
acucacuauaauuacuugauuuuau

SEQ ID NO: 1332 - RNA, 25 nt, Artificial Sequence
  Synthetic oligonucleotide
cucacuauaauuacuugauuuuauc

SEQ ID NO: 1333 - RNA, 25 nt, Artificial Sequence
  Synthetic oligonucleotide
ucacuauaauuacuugauuuuaucc

SEQ ID NO: 1334 - RNA, 25 nt, Artificial Sequence
  Synthetic oligonucleotide
cacuauaauuacuugauuuuaucca

SEQ ID NO: 1335 - RNA, 25 nt, Artificial Sequence
  Synthetic oligonucleotide
acuauaauuacuugauuuuauccaa

SEQ ID NO: 1336 - RNA, 25 nt, Artificial Sequence
  Synthetic oligonucleotide
cuauaauuacuugauuuuauccaag

SEQ ID NO: 1337 - RNA, 25 nt, Artificial Sequence
  Synthetic oligonucleotide
uauaauuacuugauuuuauccaagg

SEQ ID NO: 1338 - RNA, 25 nt, Artificial Sequence
  Synthetic oligonucleotide
auaauuacuugauuuuauccaaggg

SEQ ID NO: 1339 - RNA, 25 nt, Artificial Sequence
  Synthetic oligonucleotide
uaauuacuugauuuuauccaagggc

SEQ ID NO: 1340 - RNA, 25 nt, Artificial Sequence
  Synthetic oligonucleotide
aauuacuugauuuuauccaagggca

SEQ ID NO: 1341 - RNA, 25 nt, Artificial Sequence
  Synthetic oligonucleotide
auuacuugauuuuauccaagggcaa

SEQ ID NO: 1342 - RNA, 25 nt, Artificial Sequence
  Synthetic oligonucleotide
gucugauucagucugguuaaauauu

SEQ ID NO: 1343 - RNA, 25 nt, Artificial Sequence
  Synthetic oligonucleotide
cugauucagucugguuaaauauuga

SEQ ID NO: 1344 - RNA, 25 nt, Artificial Sequence
  Synthetic oligonucleotide
ugauucagucugguuaaauauugaa

SEQ ID NO: 1345 - RNA, 25 nt, Artificial Sequence
  Synthetic oligonucleotide
gauucagucugguuaaauauugaag

SEQ ID NO: 1346 - RNA, 25 nt, Artificial Sequence
  Synthetic oligonucleotide
auucagucugguuaaauauugaaga

SEQ ID NO: 1347 - RNA, 25 nt, Artificial Sequence
  Synthetic oligonucleotide
ucagucugguuaaauauugaagaaa

SEQ ID NO: 1348 - RNA, 25 nt, Artificial Sequence
  Synthetic oligonucleotide
cagucugguuaaauauugaagaaaa

SEQ ID NO: 1349 - RNA, 25 nt, Artificial Sequence
  Synthetic oligonucleotide
agucugguuaaauauugaagaaaaa

SEQ ID NO: 1350 - RNA, 25 nt, Artificial Sequence
  Synthetic oligonucleotide
gucugguuaaauauugaagaaaaau

SEQ ID NO: 1351 - RNA, 25 nt, Artificial Sequence
  Synthetic oligonucleotide
ucugguuaaauauugaagaaaaaug

SEQ ID NO: 1352 - RNA, 25 nt, Artificial Sequence
  Synthetic oligonucleotide
cugguuaaauauugaagaaaaaugu

SEQ ID NO: 1353 - RNA, 25 nt, Artificial Sequence
  Synthetic oligonucleotide
ugguuaaauauugaagaaaaaugug

SEQ ID NO: 1354 - RNA, 25 nt, Artificial Sequence
  Synthetic oligonucleotide
gguuaaauauugaagaaaaaugugg

SEQ ID NO: 1355 - RNA, 25 nt, Artificial Sequence
  Synthetic oligonucleotide
uguggcaaccagcuccagguucauc

SEQ ID NO: 1356 - RNA, 25 nt, Artificial Sequence
  Synthetic oligonucleotide
guggcaaccagcuccagguucaucu

SEQ ID NO: 1357 - RNA, 25 nt, Artificial Sequence
  Synthetic oligonucleotide
cugggcuguggggcaggugguggcc

SEQ ID NO: 1358 - RNA, 25 nt, Artificial Sequence
  Synthetic oligonucleotide
ugggcuguggggcaggugguggccu

SEQ ID NO: 1359 - RNA, 25 nt, Artificial Sequence
  Synthetic oligonucleotide
gggcuguggggcaggugguggccuc

SEQ ID NO: 1360 - RNA, 25 nt, Artificial Sequence
  Synthetic oligonucleotide
ggcuguggggcaggugguggccuca

SEQ ID NO: 1361 - RNA, 25 nt, Artificial Sequence
  Synthetic oligonucleotide
gcuguggggcaggugguggccucaa

SEQ ID NO: 1362 - RNA, 25 nt, Artificial Sequence
  Synthetic oligonucleotide
cuguggggcaggugguggccucaac

SEQ ID NO: 1363 - RNA, 25 nt, Artificial Sequence
  Synthetic oligonucleotide
uguggggcaggugguggccucaaca

SEQ ID NO: 1364 - RNA, 25 nt, Artificial Sequence
  Synthetic oligonucleotide
agaaaaugaugaaccuuguaaagaa

SEQ ID NO: 1365 - RNA, 25 nt, Artificial Sequence
  Synthetic oligonucleotide
augaugaaccuuguaaagaaauucu

SEQ ID NO: 1366 - RNA, 25 nt, Artificial Sequence
  Synthetic oligonucleotide
gaugaaccuuguaaagaaauucuca

SEQ ID NO: 1367 - RNA, 25 nt, Artificial Sequence
  Synthetic oligonucleotide
augaaccuuguaaagaaauucucag

SEQ ID NO: 1368 - RNA, 25 nt, Artificial Sequence
  Synthetic oligonucleotide
cuuguaaagaaauucucaggccaag

SEQ ID NO: 1369 - RNA, 25 nt, Artificial Sequence
  Synthetic oligonucleotide
uuguaaagaaauucucaggccaaga

SEQ ID NO: 1370 - RNA, 25 nt, Artificial Sequence
  Synthetic oligonucleotide
aguagugaagaaauguuguuacgau

SEQ ID NO: 1371 - RNA, 25 nt, Artificial Sequence
  Synthetic oligonucleotide
guagugaagaaauguuguuacgaug

SEQ ID NO: 1372 - RNA, 25 nt, Artificial Sequence
  Synthetic oligonucleotide
gaagacccuguuaccaguaagcaag

SEQ ID NO: 1373 - RNA, 25 nt, Artificial Sequence
  Synthetic oligonucleotide
caagccagaaauucggaguuauuuu

SEQ ID NO: 1374 - RNA, 25 nt, Artificial Sequence
  Synthetic oligonucleotide
ucaaggcaaagguguucaaagaugu

SEQ ID NO: 1375 - RNA, 25 nt, Artificial Sequence
  Synthetic oligonucleotide
caaggcaaagguguucaaagauguc

SEQ ID NO: 1376 - RNA, 25 nt, Artificial Sequence
  Synthetic oligonucleotide
aaggcaaagguguucaaagaugucu

SEQ ID NO: 1377 - RNA, 25 nt, Artificial Sequence
  Synthetic oligonucleotide
aggcaaagguguucaaagaugucuu

SEQ ID NO: 1378 - RNA, 25 nt, Artificial Sequence
  Synthetic oligonucleotide
gaugucuuccuggaaaugaauauac

SEQ ID NO: 1379 - RNA, 25 nt, Artificial Sequence
  Synthetic oligonucleotide
cuggaaaugaauauaccauauucug

SEQ ID NO: 1380 - RNA, 25 nt, Artificial Sequence
  Synthetic oligonucleotide
uggaaaugaauauaccauauucugu

SEQ ID NO: 1381 - RNA, 25 nt, Artificial Sequence
  Synthetic oligonucleotide
ggaaaugaauauaccauauucuguu

SEQ ID NO: 1382 - RNA, 25 nt, Artificial Sequence
  Synthetic oligonucleotide
gaaaugaauauaccauauucuguug

SEQ ID NO: 1383 - RNA, 25 nt, Artificial Sequence
  Synthetic oligonucleotide
aaaugaauauaccauauucuguugu

SEQ ID NO: 1384 - RNA, 25 nt, Artificial Sequence
  Synthetic oligonucleotide
aaugaauauaccauauucuguugua

SEQ ID NO: 1385 - RNA, 25 nt, Artificial Sequence
  Synthetic oligonucleotide
augaauauaccauauucuguuguac

SEQ ID NO: 1386 - RNA, 25 nt, Artificial Sequence
  Synthetic oligonucleotide
ugaauauaccauauucuguuguacg

SEQ ID NO: 1387 - RNA, 25 nt, Artificial Sequence
  Synthetic oligonucleotide
gaauauaccauauucuguuguacga

SEQ ID NO: 1388 - RNA, 25 nt, Artificial Sequence
  Synthetic oligonucleotide
aauauaccauauucuguuguacgag

SEQ ID NO: 1389 - RNA, 25 nt, Artificial Sequence
  Synthetic oligonucleotide
auauaccauauucuguuguacgagg

SEQ ID NO: 1390 - RNA, 25 nt, Artificial Sequence
  Synthetic oligonucleotide
cgaggagaacagauccaauugaaag

SEQ ID NO: 1391 - RNA, 25 nt, Artificial Sequence
  Synthetic oligonucleotide
gaggagaacagauccaauugaaagg

SEQ ID NO: 1392 - RNA, 25 nt, Artificial Sequence
  Synthetic oligonucleotide
aggagaacagauccaauugaaagga

SEQ ID NO: 1393 - RNA, 25 nt, Artificial Sequence
  Synthetic oligonucleotide
ggagaacagauccaauugaaaggaa

SEQ ID NO: 1394 - RNA, 25 nt, Artificial Sequence
  Synthetic oligonucleotide
gagaacagauccaauugaaaggaac

SEQ ID NO: 1395 - RNA, 25 nt, Artificial Sequence
  Synthetic oligonucleotide
agaacagauccaauugaaaggaacu

SEQ ID NO: 1396 - RNA, 25 nt, Artificial Sequence
  Synthetic oligonucleotide
gaacagauccaauugaaaggaacug

SEQ ID NO: 1397 - RNA, 25 nt, Artificial Sequence
  Synthetic oligonucleotide
aacagauccaauugaaaggaacugu

SEQ ID NO: 1398 - RNA, 25 nt, Artificial Sequence
  Synthetic oligonucleotide
acagauccaauugaaaggaacuguu

SEQ ID NO: 1399 - RNA, 25 nt, Artificial Sequence
  Synthetic oligonucleotide
cagauccaauugaaaggaacuguuu

SEQ ID NO: 1400 - RNA, 25 nt, Artificial Sequence
  Synthetic oligonucleotide
agauccaauugaaaggaacuguuua

SEQ ID NO: 1401 - RNA, 25 nt, Artificial Sequence
  Synthetic oligonucleotide
gauccaauugaaaggaacuguuuac

SEQ ID NO: 1402 - RNA, 25 nt, Artificial Sequence
  Synthetic oligonucleotide
auccaauugaaaggaacuguuuaca

SEQ ID NO: 1403 - RNA, 25 nt, Artificial Sequence
  Synthetic oligonucleotide
uccaauugaaaggaacuguuuacaa

SEQ ID NO: 1404 - RNA, 25 nt, Artificial Sequence
  Synthetic oligonucleotide
ccaauugaaaggaacuguuuacaac

SEQ ID NO: 1405 - RNA, 25 nt, Artificial Sequence
  Synthetic oligonucleotide
caauugaaaggaacuguuuacaacu

SEQ ID NO: 1406 - RNA, 25 nt, Artificial Sequence
  Synthetic oligonucleotide
aauugaaaggaacuguuuacaacua

SEQ ID NO: 1407 - RNA, 25 nt, Artificial Sequence
  Synthetic oligonucleotide
auugaaaggaacuguuuacaacuau

SEQ ID NO: 1408 - RNA, 25 nt, Artificial Sequence
  Synthetic oligonucleotide
uugaaaggaacuguuuacaacuaua

SEQ ID NO: 1409 - RNA, 25 nt, Artificial Sequence
  Synthetic oligonucleotide
ugaaaggaacuguuuacaacuauag

SEQ ID NO: 1410 - RNA, 25 nt, Artificial Sequence
  Synthetic oligonucleotide
gaaaggaacuguuuacaacuauagg

SEQ ID NO: 1411 - RNA, 25 nt, Artificial Sequence
  Synthetic oligonucleotide
aaaggaacuguuuacaacuauagga

SEQ ID NO: 1412 - RNA, 25 nt, Artificial Sequence
  Synthetic oligonucleotide
aaggaacuguuuacaacuauaggac

SEQ ID NO: 1413 - RNA, 25 nt, Artificial Sequence
  Synthetic oligonucleotide
aggaacuguuuacaacuauaggacu

SEQ ID NO: 1414 - RNA, 25 nt, Artificial Sequence
  Synthetic oligonucleotide
ggaacuguuuacaacuauaggacuu

SEQ ID NO: 1415 - RNA, 25 nt, Artificial Sequence
  Synthetic oligonucleotide
guuaaaaugucugcuguggagggaa

SEQ ID NO: 1416 - RNA, 25 nt, Artificial Sequence
  Synthetic oligonucleotide
uuaaaaugucugcuguggagggaau

SEQ ID NO: 1417 - RNA, 25 nt, Artificial Sequence
  Synthetic oligonucleotide
uaaaaugucugcuguggagggaauc

SEQ ID NO: 1418 - RNA, 25 nt, Artificial Sequence
  Synthetic oligonucleotide
aaaaugucugcuguggagggaaucu

SEQ ID NO: 1419 - RNA, 25 nt, Artificial Sequence
  Synthetic oligonucleotide
aaaugucugcuguggagggaaucug

SEQ ID NO: 1420 - RNA, 25 nt, Artificial Sequence
  Synthetic oligonucleotide
ugcuuccucuggaaauuggccuuca

SEQ ID NO: 1421 - RNA, 25 nt, Artificial Sequence
  Synthetic oligonucleotide
gcuuccucuggaaauuggccuucac

SEQ ID NO: 1422 - RNA, 25 nt, Artificial Sequence
  Synthetic oligonucleotide
cuuccucuggaaauuggccuucaca

SEQ ID NO: 1423 - RNA, 25 nt, Artificial Sequence
  Synthetic oligonucleotide
uuccucuggaaauuggccuucacaa

SEQ ID NO: 1424 - RNA, 25 nt, Artificial Sequence
  Synthetic oligonucleotide
uccucuggaaauuggccuucacaac

SEQ ID NO: 1425 - RNA, 25 nt, Artificial Sequence
  Synthetic oligonucleotide
ccucuggaaauuggccuucacaaca

SEQ ID NO: 1426 - RNA, 25 nt, Artificial Sequence
  Synthetic oligonucleotide
cucuggaaauuggccuucacaacau

SEQ ID NO: 1427 - RNA, 25 nt, Artificial Sequence
  Synthetic oligonucleotide
ucuggaaauuggccuucacaacauc

SEQ ID NO: 1428 - RNA, 25 nt, Artificial Sequence
  Synthetic oligonucleotide
agaaaucaaaaggauuuugagugua

SEQ ID NO: 1429 - RNA, 25 nt, Artificial Sequence
  Synthetic oligonucleotide
gaaaucaaaaggauuuugaguguaa

SEQ ID NO: 1430 - RNA, 25 nt, Artificial Sequence
  Synthetic oligonucleotide
caaaaggauuuugaguguaaaagga

SEQ ID NO: 1431 - RNA, 25 nt, Artificial Sequence
  Synthetic oligonucleotide
auccuaacccaccuccccaaaggga

SEQ ID NO: 1432 - RNA, 25 nt, Artificial Sequence
  Synthetic oligonucleotide
uccuaacccaccuccccaaagggag

SEQ ID NO: 1433 - RNA, 25 nt, Artificial Sequence
  Synthetic oligonucleotide
ccaguauucuauguuuuucacuacc

SEQ ID NO: 1434 - RNA, 25 nt, Artificial Sequence
  Synthetic oligonucleotide
aggaaaucauuggaacauuuuucau

SEQ ID NO: 1435 - RNA, 25 nt, Artificial Sequence
  Synthetic oligonucleotide
ggaaaucauuggaacauuuuucauu

SEQ ID NO: 1436 - RNA, 25 nt, Artificial Sequence
  Synthetic oligonucleotide
gagcauuauguccuacagaaaugcu

SEQ ID NO: 1437 - RNA, 25 nt, Artificial Sequence
  Synthetic oligonucleotide
cuugguuaacagcuuuugcuuuaag

SEQ ID NO: 1438 - RNA, 25 nt, Artificial Sequence
  Synthetic oligonucleotide
gguuaacagcuuuugcuuuaagagu

SEQ ID NO: 1439 - RNA, 25 nt, Artificial Sequence
  Synthetic oligonucleotide
guuaacagcuuuugcuuuaagagua

SEQ ID NO: 1440 - RNA, 25 nt, Artificial Sequence
  Synthetic oligonucleotide
gcuuuaagaguacuuggacaaguaa

SEQ ID NO: 1441 - RNA, 25 nt, Artificial Sequence
  Synthetic oligonucleotide
cuuuaagaguacuuggacaaguaaa

SEQ ID NO: 1442 - RNA, 25 nt, Artificial Sequence
  Synthetic oligonucleotide
uaagaguacuuggacaaguaaauaa

SEQ ID NO: 1443 - RNA, 25 nt, Artificial Sequence
  Synthetic oligonucleotide
aagaguacuuggacaaguaaauaaa

SEQ ID NO: 1444 - RNA, 25 nt, Artificial Sequence
  Synthetic oligonucleotide
uagagcagaaccaaaauucaauuug

SEQ ID NO: 1445 - RNA, 25 nt, Artificial Sequence
  Synthetic oligonucleotide
agagcagaaccaaaauucaauuugu

SEQ ID NO: 1446 - RNA, 25 nt, Artificial Sequence
  Synthetic oligonucleotide
gagcagaaccaaaauucaauuugua

SEQ ID NO: 1447 - RNA, 25 nt, Artificial Sequence
  Synthetic oligonucleotide
agcagaaccaaaauucaauuuguaa

SEQ ID NO: 1448 - RNA, 25 nt, Artificial Sequence
  Synthetic oligonucleotide
cacaguaucaaccaauaaaauuaca

SEQ ID NO: 1449 - RNA, 25 nt, Artificial Sequence
  Synthetic oligonucleotide
accaauaaaauuacaggguaccuug

SEQ ID NO: 1450 - RNA, 25 nt, Artificial Sequence
  Synthetic oligonucleotide
ccaauaaaauuacaggguaccuugc

SEQ ID NO: 1451 - RNA, 25 nt, Artificial Sequence
  Synthetic oligonucleotide
caauaaaauuacaggguaccuugcc

SEQ ID NO: 1452 - RNA, 25 nt, Artificial Sequence
  Synthetic oligonucleotide
cugugauuggaauuagaaaggcuuu

SEQ ID NO: 1453 - RNA, 25 nt, Artificial Sequence
  Synthetic oligonucleotide
ugugauuggaauuagaaaggcuuuc

SEQ ID NO: 1454 - RNA, 25 nt, Artificial Sequence
  Synthetic oligonucleotide
gugauuggaauuagaaaggcuuucg

SEQ ID NO: 1455 - RNA, 25 nt, Artificial Sequence
  Synthetic oligonucleotide
ugauuggaauuagaaaggcuuucga

SEQ ID NO: 1456 - RNA, 25 nt, Artificial Sequence
  Synthetic oligonucleotide
uucaauuguuucagcuuugaagaga

SEQ ID NO: 1457 - RNA, 25 nt, Artificial Sequence
  Synthetic oligonucleotide
gaagagagaagcuuugguuaaaggu

SEQ ID NO: 1458 - RNA, 25 nt, Artificial Sequence
  Synthetic oligonucleotide
aagagagaagcuuugguuaaaggua

SEQ ID NO: 1459 - RNA, 25 nt, Artificial Sequence
  Synthetic oligonucleotide
agagagaagcuuugguuaaagguaa

SEQ ID NO: 1460 - RNA, 25 nt, Artificial Sequence
  Synthetic oligonucleotide
agaagcuuugguuaaagguaaucca

SEQ ID NO: 1461 - RNA, 25 nt, Artificial Sequence
  Synthetic oligonucleotide
gaagcuuugguuaaagguaauccac

SEQ ID NO: 1462 - RNA, 25 nt, Artificial Sequence
  Synthetic oligonucleotide
ccauuuaucguuuuuggaaagacaa

SEQ ID NO: 1463 - RNA, 25 nt, Artificial Sequence
  Synthetic oligonucleotide
gcuuuacucaccagucugaacuuga

SEQ ID NO: 1464 - RNA, 25 nt, Artificial Sequence
  Synthetic oligonucleotide
cuuuacucaccagucugaacuugaa

SEQ ID NO: 1465 - RNA, 25 nt, Artificial Sequence
  Synthetic oligonucleotide
cucaccagucugaacuugaaagaua

SEQ ID NO: 1466 - RNA, 25 nt, Artificial Sequence
  Synthetic oligonucleotide
ccagucugaacuugaaagauauaaa

SEQ ID NO: 1467 - RNA, 25 nt, Artificial Sequence
  Synthetic oligonucleotide
gaagagcagagguauggagguggcu

SEQ ID NO: 1468 - RNA, 25 nt, Artificial Sequence
  Synthetic oligonucleotide
aagagcagagguauggagguggcuu

SEQ ID NO: 1469 - RNA, 25 nt, Artificial Sequence
  Synthetic oligonucleotide
gaauauucacuccugguuaaacaac

SEQ ID NO: 1470 - RNA, 25 nt, Artificial Sequence
  Synthetic oligonucleotide
ccuuacauaauuauaaaaugacaga

SEQ ID NO: 1471 - RNA, 25 nt, Artificial Sequence
  Synthetic oligonucleotide
cauguaacaacuguaguucacaaaa

SEQ ID NO: 1472 - RNA, 25 nt, Artificial Sequence
  Synthetic oligonucleotide
gaggaaguuugcagcuuuuauuuga

SEQ ID NO: 1473 - RNA, 25 nt, Artificial Sequence
  Synthetic oligonucleotide
aggaaguuugcagcuuuuauuugaa

SEQ ID NO: 1474 - RNA, 25 nt, Artificial Sequence
  Synthetic oligonucleotide
ggaaguuugcagcuuuuauuugaaa

SEQ ID NO: 1475 - RNA, 25 nt, Artificial Sequence
  Synthetic oligonucleotide
gaaguuugcagcuuuuauuugaaaa

SEQ ID NO: 1476 - RNA, 25 nt, Artificial Sequence
  Synthetic oligonucleotide
aaguuugcagcuuuuauuugaaaau

SEQ ID NO: 1477 - RNA, 25 nt, Artificial Sequence
  Synthetic oligonucleotide
aguuugcagcuuuuauuugaaaauc

SEQ ID NO: 1478 - RNA, 25 nt, Artificial Sequence
  Synthetic oligonucleotide
guuugcagcuuuuauuugaaaaucg

SEQ ID NO: 1479 - RNA, 25 nt, Artificial Sequence
  Synthetic oligonucleotide
uuugcagcuuuuauuugaaaaucga

SEQ ID NO: 1480 - RNA, 25 nt, Artificial Sequence
  Synthetic oligonucleotide
gcagcuuuuauuugaaaaucgauac

SEQ ID NO: 1481 - RNA, 25 nt, Artificial Sequence
  Synthetic oligonucleotide
auacucaggauauugaagcauccca

SEQ ID NO: 1482 - RNA, 25 nt, Artificial Sequence
  Synthetic oligonucleotide
caggauauugaagcaucccacuaca

SEQ ID NO: 1483 - RNA, 25 nt, Artificial Sequence
  Synthetic oligonucleotide
uagcaugugccagcuacaagcccag

SEQ ID NO: 1484 - RNA, 25 nt, Artificial Sequence
  Synthetic oligonucleotide
agcaugugccagcuacaagcccagc

SEQ ID NO: 1485 - RNA, 25 nt, Artificial Sequence
  Synthetic oligonucleotide
gcaugugccagcuacaagcccagca

SEQ ID NO: 1486 - RNA, 25 nt, Artificial Sequence
  Synthetic oligonucleotide
caugugccagcuacaagcccagcag

SEQ ID NO: 1487 - RNA, 25 nt, Artificial Sequence
  Synthetic oligonucleotide
augugccagcuacaagcccagcagg

SEQ ID NO: 1488 - RNA, 25 nt, Artificial Sequence
  Synthetic oligonucleotide
ugugccagcuacaagcccagcaggg

SEQ ID NO: 1489 - RNA, 25 nt, Artificial Sequence
  Synthetic oligonucleotide
gugccagcuacaagcccagcaggga

SEQ ID NO: 1490 - RNA, 25 nt, Artificial Sequence
  Synthetic oligonucleotide
ugccagcuacaagcccagcagggaa

SEQ ID NO: 1491 - RNA, 25 nt, Artificial Sequence
  Synthetic oligonucleotide
gccagcuacaagcccagcagggaag

SEQ ID NO: 1492 - RNA, 25 nt, Artificial Sequence
  Synthetic oligonucleotide
gauggacauguuauucugcaacuga

SEQ ID NO: 1493 - RNA, 25 nt, Artificial Sequence
  Synthetic oligonucleotide
auggacauguuauucugcaacugaa

SEQ ID NO: 1494 - RNA, 25 nt, Artificial Sequence
  Synthetic oligonucleotide
ggacauguuauucugcaacugaauu

SEQ ID NO: 1495 - RNA, 25 nt, Artificial Sequence
  Synthetic oligonucleotide
acauguuauucugcaacugaauucg

SEQ ID NO: 1496 - RNA, 25 nt, Artificial Sequence
  Synthetic oligonucleotide
cauguuauucugcaacugaauucga

SEQ ID NO: 1497 - RNA, 25 nt, Artificial Sequence
  Synthetic oligonucleotide
auguuauucugcaacugaauucgau

SEQ ID NO: 1498 - RNA, 25 nt, Artificial Sequence
  Synthetic oligonucleotide
auucugcaacugaauucgauucccu

SEQ ID NO: 1499 - RNA, 25 nt, Artificial Sequence
  Synthetic oligonucleotide
uucugcaacugaauucgauucccuc

SEQ ID NO: 1500 - RNA, 25 nt, Artificial Sequence
  Synthetic oligonucleotide
gauaaacaguguaccauguuuuaua

SEQ ID NO: 1501 - RNA, 25 nt, Artificial Sequence
  Synthetic oligonucleotide
auaaacaguguaccauguuuuauag

SEQ ID NO: 1502 - RNA, 25 nt, Artificial Sequence
  Synthetic oligonucleotide
aaacaguguaccauguuuuauagca

SEQ ID NO: 1503 - RNA, 25 nt, Artificial Sequence
  Synthetic oligonucleotide
acaguguaccauguuuuauagcacu

SEQ ID NO: 1504 - RNA, 25 nt, Artificial Sequence
  Synthetic oligonucleotide
auagcacuuccaauaucaaaauuca

SEQ ID NO: 1505 - RNA, 25 nt, Artificial Sequence
  Synthetic oligonucleotide
uucagaaagucugugaaggagccgc

SEQ ID NO: 1506 - RNA, 25 nt, Artificial Sequence
  Synthetic oligonucleotide
ucagaaagucugugaaggagccgcg

SEQ ID NO: 1507 - RNA, 25 nt, Artificial Sequence
  Synthetic oligonucleotide
cagaaagucugugaaggagccgcgu

SEQ ID NO: 1508 - RNA, 25 nt, Artificial Sequence
  Synthetic oligonucleotide
agaaagucugugaaggagccgcgug

SEQ ID NO: 1509 - RNA, 25 nt, Artificial Sequence
  Synthetic oligonucleotide
ccagagauugcauaugcuuauaaag

SEQ ID NO: 1510 - RNA, 25 nt, Artificial Sequence
  Synthetic oligonucleotide
cagagauugcauaugcuuauaaagu

SEQ ID NO: 1511 - RNA, 25 nt, Artificial Sequence
  Synthetic oligonucleotide
agagauugcauaugcuuauaaaguu

SEQ ID NO: 1512 - RNA, 25 nt, Artificial Sequence
  Synthetic oligonucleotide
gagauugcauaugcuuauaaaguua

SEQ ID NO: 1513 - RNA, 25 nt, Artificial Sequence
  Synthetic oligonucleotide
agauugcauaugcuuauaaaguuag

SEQ ID NO: 1514 - RNA, 25 nt, Artificial Sequence
  Synthetic oligonucleotide
agaaaauguuuuugucaaguacaag

SEQ ID NO: 1515 - RNA, 25 nt, Artificial Sequence
  Synthetic oligonucleotide
gaaaauguuuuugucaaguacaagg

SEQ ID NO: 1516 - RNA, 25 nt, Artificial Sequence
  Synthetic oligonucleotide
aaaauguuuuugucaaguacaaggc

SEQ ID NO: 1517 - RNA, 25 nt, Artificial Sequence
  Synthetic oligonucleotide
aaauguuuuugucaaguacaaggca

SEQ ID NO: 1518 - RNA, 25 nt, Artificial Sequence
  Synthetic oligonucleotide
aauguuuuugucaaguacaaggcaa

SEQ ID NO: 1519 - RNA, 25 nt, Artificial Sequence
  Synthetic oligonucleotide
ccagauaaaauacaauuucaguuuc

SEQ ID NO: 1520 - RNA, 25 nt, Artificial Sequence
  Synthetic oligonucleotide
auguucaucgugucaagcauuuuua

SEQ ID NO: 1521 - RNA, 25 nt, Artificial Sequence
  Synthetic oligonucleotide
caucgugucaagcauuuuuagcuaa

SEQ ID NO: 1522 - RNA, 25 nt, Artificial Sequence
  Synthetic oligonucleotide
gugucaagcauuuuuagcuaauuua

SEQ ID NO: 1523 - RNA, 25 nt, Artificial Sequence
  Synthetic oligonucleotide
aagcauuuuuagcuaauuuagauga

SEQ ID NO: 1524 - RNA, 25 nt, Artificial Sequence
  Synthetic oligonucleotide
uggaugcuaaaauuccugaaguuca

SEQ ID NO: 1525 - RNA, 25 nt, Artificial Sequence
  Synthetic oligonucleotide
auggacuccuguuguugaaguucgu

SEQ ID NO: 1526 - RNA, 25 nt, Artificial Sequence
  Synthetic oligonucleotide
ggacuccuguuguugaaguucguuu

SEQ ID NO: 1527 - RNA, 25 nt, Artificial Sequence
  Synthetic oligonucleotide
gacuccuguuguugaaguucguuuu

SEQ ID NO: 1528 - RNA, 25 nt, Artificial Sequence
  Synthetic oligonucleotide
uugcuuuuauuagagaaugauuuca

SEQ ID NO: 1529 - RNA, 25 nt, Artificial Sequence
  Synthetic oligonucleotide
ugcuuuuauuagagaaugauuucaa

SEQ ID NO: 1530 - RNA, 25 nt, Artificial Sequence
  Synthetic oligonucleotide
gcuuuuauuagagaaugauuucaaa

SEQ ID NO: 1531 - RNA, 25 nt, Artificial Sequence
  Synthetic oligonucleotide
cuuuuauuagagaaugauuucaaau

SEQ ID NO: 1532 - RNA, 25 nt, Artificial Sequence
  Synthetic oligonucleotide
cagauacuccuccaagguuauugga

SEQ ID NO: 1533 - RNA, 25 nt, Artificial Sequence
  Synthetic oligonucleotide
cauuaaagccugaguuugcuuucaa

SEQ ID NO: 1534 - RNA, 25 nt, Artificial Sequence
  Synthetic oligonucleotide
auuaaagccugaguuugcuuucaaa

SEQ ID NO: 1535 - RNA, 25 nt, Artificial Sequence
  Synthetic oligonucleotide
aaagccugaguuugcuuucaaaaaa

SEQ ID NO: 1536 - RNA, 25 nt, Artificial Sequence
  Synthetic oligonucleotide
aagccugaguuugcuuucaaaaaaa

SEQ ID NO: 1537 - RNA, 21 nt, Artificial Sequence
  Synthetic oligonucleotide
acauaugucauuucagcacca

SEQ ID NO: 1538 - RNA, 21 nt, Artificial Sequence
  Synthetic oligonucleotide
auauugugauucaaguuuaug

SEQ ID NO: 1539 - RNA, 21 nt, Artificial Sequence
  Synthetic oligonucleotide
uauugugauucaaguuuaugg

SEQ ID NO: 1540 - RNA, 21 nt, Artificial Sequence
  Synthetic oligonucleotide
auugugauucaaguuuaugga

SEQ ID NO: 1541 - RNA, 21 nt, Artificial Sequence
  Synthetic oligonucleotide
uugugauucaaguuuauggau

SEQ ID NO: 1542 - RNA, 21 nt, Artificial Sequence
  Synthetic oligonucleotide
ugugauucaaguuuauggaua

SEQ ID NO: 1543 - RNA, 21 nt, Artificial Sequence
  Synthetic oligonucleotide
gugauucaaguuuauggauac

SEQ ID NO: 1544 - RNA, 21 nt, Artificial Sequence
  Synthetic oligonucleotide
ugauucaaguuuauggauaca

SEQ ID NO: 1545 - RNA, 21 nt, Artificial Sequence
  Synthetic oligonucleotide
gauucaaguuuauggauacac

SEQ ID NO: 1546 - RNA, 21 nt, Artificial Sequence
  Synthetic oligonucleotide
auucaaguuuauggauacacu

SEQ ID NO: 1547 - RNA, 21 nt, Artificial Sequence
  Synthetic oligonucleotide
uucaaguuuauggauacacug

SEQ ID NO: 1548 - RNA, 21 nt, Artificial Sequence
  Synthetic oligonucleotide
ucaaguuuauggauacacuga

SEQ ID NO: 1549 - RNA, 21 nt, Artificial Sequence
  Synthetic oligonucleotide
caaguuuauggauacacugaa

SEQ ID NO: 1550 - RNA, 21 nt, Artificial Sequence
  Synthetic oligonucleotide
aguuuauggauacacugaagc

SEQ ID NO: 1551 - RNA, 21 nt, Artificial Sequence
  Synthetic oligonucleotide
guuuauggauacacugaagca

SEQ ID NO: 1552 - RNA, 21 nt, Artificial Sequence
  Synthetic oligonucleotide
uuauggauacacugaagcauu

SEQ ID NO: 1553 - RNA, 21 nt, Artificial Sequence
  Synthetic oligonucleotide
auggauacacugaagcauuug

SEQ ID NO: 1554 - RNA, 21 nt, Artificial Sequence
  Synthetic oligonucleotide
uggauacacugaagcauuuga

SEQ ID NO: 1555 - RNA, 21 nt, Artificial Sequence
  Synthetic oligonucleotide
ggauacacugaagcauuugau

SEQ ID NO: 1556 - RNA, 21 nt, Artificial Sequence
  Synthetic oligonucleotide
gauacacugaagcauuugaug

SEQ ID NO: 1557 - RNA, 21 nt, Artificial Sequence
  Synthetic oligonucleotide
auacacugaagcauuugaugc

SEQ ID NO: 1558 - RNA, 21 nt, Artificial Sequence
  Synthetic oligonucleotide
uacacugaagcauuugaugca

SEQ ID NO: 1559 - RNA, 21 nt, Artificial Sequence
  Synthetic oligonucleotide
acacugaagcauuugaugcaa

SEQ ID NO: 1560 - RNA, 21 nt, Artificial Sequence
  Synthetic oligonucleotide
cacugaagcauuugaugcaac

SEQ ID NO: 1561 - RNA, 21 nt, Artificial Sequence
  Synthetic oligonucleotide
cugaagcauuugaugcaacaa

SEQ ID NO: 1562 - RNA, 21 nt, Artificial Sequence
  Synthetic oligonucleotide
gaagcauuugaugcaacaauc

SEQ ID NO: 1563 - RNA, 21 nt, Artificial Sequence
  Synthetic oligonucleotide
agcauuugaugcaacaaucuc

SEQ ID NO: 1564 - RNA, 21 nt, Artificial Sequence
  Synthetic oligonucleotide
uuugaugcaacaaucucuauu

SEQ ID NO: 1565 - RNA, 21 nt, Artificial Sequence
  Synthetic oligonucleotide
uugaugcaacaaucucuauua

SEQ ID NO: 1566 - RNA, 21 nt, Artificial Sequence
  Synthetic oligonucleotide
ugaugcaacaaucucuauuaa

SEQ ID NO: 1567 - RNA, 21 nt, Artificial Sequence
  Synthetic oligonucleotide
gaugcaacaaucucuauuaaa

SEQ ID NO: 1568 - RNA, 21 nt, Artificial Sequence
  Synthetic oligonucleotide
caacaaucucuauuaaaaguu

SEQ ID NO: 1569 - RNA, 21 nt, Artificial Sequence
  Synthetic oligonucleotide
aacaaucucuauuaaaaguua

SEQ ID NO: 1570 - RNA, 21 nt, Artificial Sequence
  Synthetic oligonucleotide
cucuauuaaaaguuauccuga

SEQ ID NO: 1571 - RNA, 21 nt, Artificial Sequence
  Synthetic oligonucleotide
cuauuaaaaguuauccugaua

SEQ ID NO: 1572 - RNA, 21 nt, Artificial Sequence
  Synthetic oligonucleotide
uuaaaaguuauccugauaaaa

SEQ ID NO: 1573 - RNA, 21 nt, Artificial Sequence
  Synthetic oligonucleotide
uaaaaguuauccugauaaaaa

SEQ ID NO: 1574 - RNA, 21 nt, Artificial Sequence
  Synthetic oligonucleotide
aaguuauccugauaaaaaauu

SEQ ID NO: 1575 - RNA, 21 nt, Artificial Sequence
  Synthetic oligonucleotide
aguuauccugauaaaaaauuu

SEQ ID NO: 1576 - RNA, 21 nt, Artificial Sequence
  Synthetic oligonucleotide
auguucauuuauccucagaga

SEQ ID NO: 1577 - RNA, 21 nt, Artificial Sequence
  Synthetic oligonucleotide
uguucauuuauccucagagaa

SEQ ID NO: 1578 - RNA, 21 nt, Artificial Sequence
  Synthetic oligonucleotide
guguauuuggaaguuguauca

SEQ ID NO: 1579 - RNA, 21 nt, Artificial Sequence
  Synthetic oligonucleotide
uguauuuggaaguuguaucaa

SEQ ID NO: 1580 - RNA, 21 nt, Artificial Sequence
  Synthetic oligonucleotide
auuuggaaguuguaucaaagc

SEQ ID NO: 1581 - RNA, 21 nt, Artificial Sequence
  Synthetic oligonucleotide
uuuggaaguuguaucaaagca

SEQ ID NO: 1582 - RNA, 21 nt, Artificial Sequence
  Synthetic oligonucleotide
uuggaaguuguaucaaagcau

SEQ ID NO: 1583 - RNA, 21 nt, Artificial Sequence
  Synthetic oligonucleotide
uggaaguuguaucaaagcauu

SEQ ID NO: 1584 - RNA, 21 nt, Artificial Sequence
  Synthetic oligonucleotide
ggaaguuguaucaaagcauuu

SEQ ID NO: 1585 - RNA, 21 nt, Artificial Sequence
  Synthetic oligonucleotide
gaaguuguaucaaagcauuuu

SEQ ID NO: 1586 - RNA, 21 nt, Artificial Sequence
  Synthetic oligonucleotide
aaguuguaucaaagcauuuuu

SEQ ID NO: 1587 - RNA, 21 nt, Artificial Sequence
  Synthetic oligonucleotide
aguuguaucaaagcauuuuuc

SEQ ID NO: 1588 - RNA, 21 nt, Artificial Sequence
  Synthetic oligonucleotide
guuguaucaaagcauuuuuca

SEQ ID NO: 1589 - RNA, 21 nt, Artificial Sequence
  Synthetic oligonucleotide
uuguaucaaagcauuuuucaa

SEQ ID NO: 1590 - RNA, 21 nt, Artificial Sequence
  Synthetic oligonucleotide
ccaauaaccuaugacaaugga

SEQ ID NO: 1591 - RNA, 21 nt, Artificial Sequence
  Synthetic oligonucleotide
accuaugacaauggauuucuc

SEQ ID NO: 1592 - RNA, 21 nt, Artificial Sequence
  Synthetic oligonucleotide
augacaauggauuucucuuca

SEQ ID NO: 1593 - RNA, 21 nt, Artificial Sequence
  Synthetic oligonucleotide
ugacaauggauuucucuucau

SEQ ID NO: 1594 - RNA, 21 nt, Artificial Sequence
  Synthetic oligonucleotide
gacaauggauuucucuucauu

SEQ ID NO: 1595 - RNA, 21 nt, Artificial Sequence
  Synthetic oligonucleotide
caauggauuucucuucauuca

SEQ ID NO: 1596 - RNA, 21 nt, Artificial Sequence
  Synthetic oligonucleotide
aauggauuucucuucauucau

SEQ ID NO: 1597 - RNA, 21 nt, Artificial Sequence
  Synthetic oligonucleotide
uggauuucucuucauucauac

SEQ ID NO: 1598 - RNA, 21 nt, Artificial Sequence
  Synthetic oligonucleotide
ucauucauacagacaaaccug

SEQ ID NO: 1599 - RNA, 21 nt, Artificial Sequence
  Synthetic oligonucleotide
auucauacagacaaaccuguu

SEQ ID NO: 1600 - RNA, 21 nt, Artificial Sequence
  Synthetic oligonucleotide
uucauacagacaaaccuguuu

SEQ ID NO: 1601 - RNA, 21 nt, Artificial Sequence
  Synthetic oligonucleotide
ucauacagacaaaccuguuua

SEQ ID NO: 1602 - RNA, 21 nt, Artificial Sequence
  Synthetic oligonucleotide
aaguuagaguuuauucguuga

SEQ ID NO: 1603 - RNA, 21 nt, Artificial Sequence
  Synthetic oligonucleotide
aaugacgacuugaagccagcc

SEQ ID NO: 1604 - RNA, 21 nt, Artificial Sequence
  Synthetic oligonucleotide
augacgacuugaagccagcca

SEQ ID NO: 1605 - RNA, 21 nt, Artificial Sequence
  Synthetic oligonucleotide
ugacgacuugaagccagccaa

SEQ ID NO: 1606 - RNA, 21 nt, Artificial Sequence
  Synthetic oligonucleotide
gacgacuugaagccagccaaa

SEQ ID NO: 1607 - RNA, 21 nt, Artificial Sequence
  Synthetic oligonucleotide
agagaaacugucuuaacuuuc

SEQ ID NO: 1608 - RNA, 21 nt, Artificial Sequence
  Synthetic oligonucleotide
aaacugucuuaacuuucauag

SEQ ID NO: 1609 - RNA, 21 nt, Artificial Sequence
  Synthetic oligonucleotide
aacugucuuaacuuucauaga

SEQ ID NO: 1610 - RNA, 21 nt, Artificial Sequence
  Synthetic oligonucleotide
cugaaggaucagaaguugaca

SEQ ID NO: 1611 - RNA, 21 nt, Artificial Sequence
  Synthetic oligonucleotide
ugaaggaucagaaguugacau

SEQ ID NO: 1612 - RNA, 21 nt, Artificial Sequence
  Synthetic oligonucleotide
uugacaugguagaagaaauug

SEQ ID NO: 1613 - RNA, 21 nt, Artificial Sequence
  Synthetic oligonucleotide
ugacaugguagaagaaauuga

SEQ ID NO: 1614 - RNA, 21 nt, Artificial Sequence
  Synthetic oligonucleotide
augguagaagaaauugaucau

SEQ ID NO: 1615 - RNA, 21 nt, Artificial Sequence
  Synthetic oligonucleotide
ugguagaagaaauugaucaua

SEQ ID NO: 1616 - RNA, 21 nt, Artificial Sequence
  Synthetic oligonucleotide
agaagaaauugaucauauugg

SEQ ID NO: 1617 - RNA, 21 nt, Artificial Sequence
  Synthetic oligonucleotide
gaagaaauugaucauauugga

SEQ ID NO: 1618 - RNA, 21 nt, Artificial Sequence
  Synthetic oligonucleotide
uuggaauuaucucuuuuccug

SEQ ID NO: 1619 - RNA, 21 nt, Artificial Sequence
  Synthetic oligonucleotide
uggaauuaucucuuuuccuga

SEQ ID NO: 1620 - RNA, 21 nt, Artificial Sequence
  Synthetic oligonucleotide
ggaauuaucucuuuuccugac

SEQ ID NO: 1621 - RNA, 21 nt, Artificial Sequence
  Synthetic oligonucleotide
gaauuaucucuuuuccugacu

SEQ ID NO: 1622 - RNA, 21 nt, Artificial Sequence
  Synthetic oligonucleotide
aauuaucucuuuuccugacuu

SEQ ID NO: 1623 - RNA, 21 nt, Artificial Sequence
  Synthetic oligonucleotide
auuaucucuuuuccugacuuc

SEQ ID NO: 1624 - RNA, 21 nt, Artificial Sequence
  Synthetic oligonucleotide
uuaucucuuuuccugacuuca

SEQ ID NO: 1625 - RNA, 21 nt, Artificial Sequence
  Synthetic oligonucleotide
uaucucuuuuccugacuucaa

SEQ ID NO: 1626 - RNA, 21 nt, Artificial Sequence
  Synthetic oligonucleotide
aucucuuuuccugacuucaag

SEQ ID NO: 1627 - RNA, 21 nt, Artificial Sequence
  Synthetic oligonucleotide
ucucuuuuccugacuucaaga

SEQ ID NO: 1628 - RNA, 21 nt, Artificial Sequence
  Synthetic oligonucleotide
cucuuuuccugacuucaagau

SEQ ID NO: 1629 - RNA, 21 nt, Artificial Sequence
  Synthetic oligonucleotide
ucuuuuccugacuucaagauu

SEQ ID NO: 1630 - RNA, 21 nt, Artificial Sequence
  Synthetic oligonucleotide
cuuuuccugacuucaagauuc

SEQ ID NO: 1631 - RNA, 21 nt, Artificial Sequence
  Synthetic oligonucleotide
uuuuccugacuucaagauucc

SEQ ID NO: 1632 - RNA, 21 nt, Artificial Sequence
  Synthetic oligonucleotide
aguuaaagaauaugucuugcc

SEQ ID NO: 1633 - RNA, 21 nt, Artificial Sequence
  Synthetic oligonucleotide
guuaaagaauaugucuugcca

SEQ ID NO: 1634 - RNA, 21 nt, Artificial Sequence
  Synthetic oligonucleotide
uuaaagaauaugucuugccac

SEQ ID NO: 1635 - RNA, 21 nt, Artificial Sequence
  Synthetic oligonucleotide
acaagaacuuuaagaauuuug

SEQ ID NO: 1636 - RNA, 21 nt, Artificial Sequence
  Synthetic oligonucleotide
caagaacuuuaagaauuuuga

SEQ ID NO: 1637 - RNA, 21 nt, Artificial Sequence
  Synthetic oligonucleotide
aacuuuaagaauuuugaaauu

SEQ ID NO: 1638 - RNA, 21 nt, Artificial Sequence
  Synthetic oligonucleotide
aagaauuuugaaauuacuaua

SEQ ID NO: 1639 - RNA, 21 nt, Artificial Sequence
  Synthetic oligonucleotide
agaauuuugaaauuacuauaa

SEQ ID NO: 1640 - RNA, 21 nt, Artificial Sequence
  Synthetic oligonucleotide
gaauuuugaaauuacuauaaa

SEQ ID NO: 1641 - RNA, 21 nt, Artificial Sequence
  Synthetic oligonucleotide
uuuugaaauuacuauaaaagc

SEQ ID NO: 1642 - RNA, 21 nt, Artificial Sequence
  Synthetic oligonucleotide
uuugaaauuacuauaaaagca

SEQ ID NO: 1643 - RNA, 21 nt, Artificial Sequence
  Synthetic oligonucleotide
uugaaauuacuauaaaagcaa

SEQ ID NO: 1644 - RNA, 21 nt, Artificial Sequence
  Synthetic oligonucleotide
uaaaagcaagauauuuuuaua

SEQ ID NO: 1645 - RNA, 21 nt, Artificial Sequence
  Synthetic oligonucleotide
aaaagcaagauauuuuuauaa

SEQ ID NO: 1646 - RNA, 21 nt, Artificial Sequence
  Synthetic oligonucleotide
aaagcaagauauuuuuauaau

SEQ ID NO: 1647 - RNA, 21 nt, Artificial Sequence
  Synthetic oligonucleotide
aagcaagauauuuuuauaaua

SEQ ID NO: 1648 - RNA, 21 nt, Artificial Sequence
  Synthetic oligonucleotide
agcaagauauuuuuauaauaa

SEQ ID NO: 1649 - RNA, 21 nt, Artificial Sequence
  Synthetic oligonucleotide
gcaagauauuuuuauaauaaa

SEQ ID NO: 1650 - RNA, 21 nt, Artificial Sequence
  Synthetic oligonucleotide
caagauauuuuuauaauaaag

SEQ ID NO: 1651 - RNA, 21 nt, Artificial Sequence
  Synthetic oligonucleotide
aagauauuuuuauaauaaagu

SEQ ID NO: 1652 - RNA, 21 nt, Artificial Sequence
  Synthetic oligonucleotide
cacaauguugauaaauggaau

SEQ ID NO: 1653 - RNA, 21 nt, Artificial Sequence
  Synthetic oligonucleotide
acaauguugauaaauggaauu

SEQ ID NO: 1654 - RNA, 21 nt, Artificial Sequence
  Synthetic oligonucleotide
aauguugauaaauggaauugc

SEQ ID NO: 1655 - RNA, 21 nt, Artificial Sequence
  Synthetic oligonucleotide
auguugauaaauggaauugcu

SEQ ID NO: 1656 - RNA, 21 nt, Artificial Sequence
  Synthetic oligonucleotide
uguugauaaauggaauugcuc

SEQ ID NO: 1657 - RNA, 21 nt, Artificial Sequence
  Synthetic oligonucleotide
ugauaaauggaauugcucaag

SEQ ID NO: 1658 - RNA, 21 nt, Artificial Sequence
  Synthetic oligonucleotide
aaauggaauugcucaagucac

SEQ ID NO: 1659 - RNA, 21 nt, Artificial Sequence
  Synthetic oligonucleotide
ugcucaagucacauuugauuc

SEQ ID NO: 1660 - RNA, 21 nt, Artificial Sequence
  Synthetic oligonucleotide
cucaagucacauuugauucug

SEQ ID NO: 1661 - RNA, 21 nt, Artificial Sequence
  Synthetic oligonucleotide
ucaagucacauuugauucuga

SEQ ID NO: 1662 - RNA, 21 nt, Artificial Sequence
  Synthetic oligonucleotide
caagucacauuugauucugaa

SEQ ID NO: 1663 - RNA, 21 nt, Artificial Sequence
  Synthetic oligonucleotide
cacauuugauucugaaacagc

SEQ ID NO: 1664 - RNA, 21 nt, Artificial Sequence
  Synthetic oligonucleotide
cauuugauucugaaacagcag

SEQ ID NO: 1665 - RNA, 21 nt, Artificial Sequence
  Synthetic oligonucleotide
auuugauucugaaacagcagu

SEQ ID NO: 1666 - RNA, 21 nt, Artificial Sequence
  Synthetic oligonucleotide
aacagcagucaaagaacuguc

SEQ ID NO: 1667 - RNA, 21 nt, Artificial Sequence
  Synthetic oligonucleotide
cagcagucaaagaacugucau

SEQ ID NO: 1668 - RNA, 21 nt, Artificial Sequence
  Synthetic oligonucleotide
cagucaaagaacugucauacu

SEQ ID NO: 1669 - RNA, 21 nt, Artificial Sequence
  Synthetic oligonucleotide
caaagaacugucauacuacag

SEQ ID NO: 1670 - RNA, 21 nt, Artificial Sequence
  Synthetic oligonucleotide
aaagaacugucauacuacagu

SEQ ID NO: 1671 - RNA, 21 nt, Artificial Sequence
  Synthetic oligonucleotide
agaacugucauacuacaguuu

SEQ ID NO: 1672 - RNA, 21 nt, Artificial Sequence
  Synthetic oligonucleotide
auuuaaacaacaaguaccuuu

SEQ ID NO: 1673 - RNA, 21 nt, Artificial Sequence
  Synthetic oligonucleotide
uuuaaacaacaaguaccuuua

SEQ ID NO: 1674 - RNA, 21 nt, Artificial Sequence
  Synthetic oligonucleotide
uuaaacaacaaguaccuuuau

SEQ ID NO: 1675 - RNA, 21 nt, Artificial Sequence
  Synthetic oligonucleotide
uaaacaacaaguaccuuuaua

SEQ ID NO: 1676 - RNA, 21 nt, Artificial Sequence
  Synthetic oligonucleotide
aaacaacaaguaccuuuauau

SEQ ID NO: 1677 - RNA, 21 nt, Artificial Sequence
  Synthetic oligonucleotide
aacaacaaguaccuuuauauu

SEQ ID NO: 1678 - RNA, 21 nt, Artificial Sequence
  Synthetic oligonucleotide
acaacaaguaccuuuauauug

SEQ ID NO: 1679 - RNA, 21 nt, Artificial Sequence
  Synthetic oligonucleotide
caacaaguaccuuuauauugc

SEQ ID NO: 1680 - RNA, 21 nt, Artificial Sequence
  Synthetic oligonucleotide
aacaaguaccuuuauauugcu

SEQ ID NO: 1681 - RNA, 21 nt, Artificial Sequence
  Synthetic oligonucleotide
acaaguaccuuuauauugcug

SEQ ID NO: 1682 - RNA, 21 nt, Artificial Sequence
  Synthetic oligonucleotide
caaguaccuuuauauugcugu

SEQ ID NO: 1683 - RNA, 21 nt, Artificial Sequence
  Synthetic oligonucleotide
aaguaccuuuauauugcugua

SEQ ID NO: 1684 - RNA, 21 nt, Artificial Sequence
  Synthetic oligonucleotide
guaccuuuauauugcuguaac

SEQ ID NO: 1685 - RNA, 21 nt, Artificial Sequence
  Synthetic oligonucleotide
caucaaauauguccucucucc

SEQ ID NO: 1686 - RNA, 21 nt, Artificial Sequence
  Synthetic oligonucleotide
cucccuacaaacugaauuugg

SEQ ID NO: 1687 - RNA, 21 nt, Artificial Sequence
  Synthetic oligonucleotide
cuacaaacugaauuugguugc

SEQ ID NO: 1688 - RNA, 21 nt, Artificial Sequence
  Synthetic oligonucleotide
uacaaacugaauuugguugcu

SEQ ID NO: 1689 - RNA, 21 nt, Artificial Sequence
  Synthetic oligonucleotide
cacugaaugcacaaacaauug

SEQ ID NO: 1690 - RNA, 21 nt, Artificial Sequence
  Synthetic oligonucleotide
acugaaugcacaaacaauuga

SEQ ID NO: 1691 - RNA, 21 nt, Artificial Sequence
  Synthetic oligonucleotide
accaagagacaucugacuugg

SEQ ID NO: 1692 - RNA, 21 nt, Artificial Sequence
  Synthetic oligonucleotide
ccaagagacaucugacuugga

SEQ ID NO: 1693 - RNA, 21 nt, Artificial Sequence
  Synthetic oligonucleotide
aagguuaccgagcaauagcau

SEQ ID NO: 1694 - RNA, 21 nt, Artificial Sequence
  Synthetic oligonucleotide
ucucagccaaaguuaccuuua

SEQ ID NO: 1695 - RNA, 21 nt, Artificial Sequence
  Synthetic oligonucleotide
cucagccaaaguuaccuuuau

SEQ ID NO: 1696 - RNA, 21 nt, Artificial Sequence
  Synthetic oligonucleotide
ucagccaaaguuaccuuuaua

SEQ ID NO: 1697 - RNA, 21 nt, Artificial Sequence
  Synthetic oligonucleotide
cagccaaaguuaccuuuauau

SEQ ID NO: 1698 - RNA, 21 nt, Artificial Sequence
  Synthetic oligonucleotide
ccaaaagcccauauauugaca

SEQ ID NO: 1699 - RNA, 21 nt, Artificial Sequence
  Synthetic oligonucleotide
aagcccauauauugacaaaau

SEQ ID NO: 1700 - RNA, 21 nt, Artificial Sequence
  Synthetic oligonucleotide
agcccauauauugacaaaaua

SEQ ID NO: 1701 - RNA, 21 nt, Artificial Sequence
  Synthetic oligonucleotide
cccauauauugacaaaauaac

SEQ ID NO: 1702 - RNA, 21 nt, Artificial Sequence
  Synthetic oligonucleotide
ccauauauugacaaaauaacu

SEQ ID NO: 1703 - RNA, 21 nt, Artificial Sequence
  Synthetic oligonucleotide
cauauauugacaaaauaacuc

SEQ ID NO: 1704 - RNA, 21 nt, Artificial Sequence
  Synthetic oligonucleotide
auauugacaaaauaacucacu

SEQ ID NO: 1705 - RNA, 21 nt, Artificial Sequence
  Synthetic oligonucleotide
auugacaaaauaacucacuau

SEQ ID NO: 1706 - RNA, 21 nt, Artificial Sequence
  Synthetic oligonucleotide
uugacaaaauaacucacuaua

SEQ ID NO: 1707 - RNA, 21 nt, Artificial Sequence
  Synthetic oligonucleotide
ugacaaaauaacucacuauaa

SEQ ID NO: 1708 - RNA, 21 nt, Artificial Sequence
  Synthetic oligonucleotide
gacaaaauaacucacuauaau

SEQ ID NO: 1709 - RNA, 21 nt, Artificial Sequence
  Synthetic oligonucleotide
acaaaauaacucacuauaauu

SEQ ID NO: 1710 - RNA, 21 nt, Artificial Sequence
  Synthetic oligonucleotide
caaaauaacucacuauaauua

SEQ ID NO: 1711 - RNA, 21 nt, Artificial Sequence
  Synthetic oligonucleotide
aaaauaacucacuauaauuac

SEQ ID NO: 1712 - RNA, 21 nt, Artificial Sequence
  Synthetic oligonucleotide
aaauaacucacuauaauuacu

SEQ ID NO: 1713 - RNA, 21 nt, Artificial Sequence
  Synthetic oligonucleotide
aauaacucacuauaauuacuu

SEQ ID NO: 1714 - RNA, 21 nt, Artificial Sequence
  Synthetic oligonucleotide
auaacucacuauaauuacuug

SEQ ID NO: 1715 - RNA, 21 nt, Artificial Sequence
  Synthetic oligonucleotide
uaacucacuauaauuacuuga

SEQ ID NO: 1716 - RNA, 21 nt, Artificial Sequence
  Synthetic oligonucleotide
aacucacuauaauuacuugau

SEQ ID NO: 1717 - RNA, 21 nt, Artificial Sequence
  Synthetic oligonucleotide
acucacuauaauuacuugauu

SEQ ID NO: 1718 - RNA, 21 nt, Artificial Sequence
  Synthetic oligonucleotide
cucacuauaauuacuugauuu

SEQ ID NO: 1719 - RNA, 21 nt, Artificial Sequence
  Synthetic oligonucleotide
ucacuauaauuacuugauuuu

SEQ ID NO: 1720 - RNA, 21 nt, Artificial Sequence
  Synthetic oligonucleotide
cacuauaauuacuugauuuua

SEQ ID NO: 1721 - RNA, 21 nt, Artificial Sequence
  Synthetic oligonucleotide
acuauaauuacuugauuuuau

SEQ ID NO: 1722 - RNA, 21 nt, Artificial Sequence
  Synthetic oligonucleotide
cuauaauuacuugauuuuauc

SEQ ID NO: 1723 - RNA, 21 nt, Artificial Sequence
  Synthetic oligonucleotide
uauaauuacuugauuuuaucc

SEQ ID NO: 1724 - RNA, 21 nt, Artificial Sequence
  Synthetic oligonucleotide
auaauuacuugauuuuaucca

SEQ ID NO: 1725 - RNA, 21 nt, Artificial Sequence
  Synthetic oligonucleotide
uaauuacuugauuuuauccaa

SEQ ID NO: 1726 - RNA, 21 nt, Artificial Sequence
  Synthetic oligonucleotide
gugucugauucagucugguua

SEQ ID NO: 1727 - RNA, 21 nt, Artificial Sequence
  Synthetic oligonucleotide
gucugauucagucugguuaaa

SEQ ID NO: 1728 - RNA, 21 nt, Artificial Sequence
  Synthetic oligonucleotide
ucugauucagucugguuaaau

SEQ ID NO: 1729 - RNA, 21 nt, Artificial Sequence
  Synthetic oligonucleotide
cugauucagucugguuaaaua

SEQ ID NO: 1730 - RNA, 21 nt, Artificial Sequence
  Synthetic oligonucleotide
ugauucagucugguuaaauau

SEQ ID NO: 1731 - RNA, 21 nt, Artificial Sequence
  Synthetic oligonucleotide
auucagucugguuaaauauug

SEQ ID NO: 1732 - RNA, 21 nt, Artificial Sequence
  Synthetic oligonucleotide
uucagucugguuaaauauuga

SEQ ID NO: 1733 - RNA, 21 nt, Artificial Sequence
  Synthetic oligonucleotide
ucagucugguuaaauauugaa

SEQ ID NO: 1734 - RNA, 21 nt, Artificial Sequence
  Synthetic oligonucleotide
cagucugguuaaauauugaag

SEQ ID NO: 1735 - RNA, 21 nt, Artificial Sequence
  Synthetic oligonucleotide
agucugguuaaauauugaaga

SEQ ID NO: 1736 - RNA, 21 nt, Artificial Sequence
  Synthetic oligonucleotide
gucugguuaaauauugaagaa

SEQ ID NO: 1737 - RNA, 21 nt, Artificial Sequence
  Synthetic oligonucleotide
ucugguuaaauauugaagaaa

SEQ ID NO: 1738 - RNA, 21 nt, Artificial Sequence
  Synthetic oligonucleotide
cugguuaaauauugaagaaaa

SEQ ID NO: 1739 - RNA, 21 nt, Artificial Sequence
  Synthetic oligonucleotide
aauguggcaaccagcuccagg

SEQ ID NO: 1740 - RNA, 21 nt, Artificial Sequence
  Synthetic oligonucleotide
auguggcaaccagcuccaggu

SEQ ID NO: 1741 - RNA, 21 nt, Artificial Sequence
  Synthetic oligonucleotide
aucugggcuguggggcaggug

SEQ ID NO: 1742 - RNA, 21 nt, Artificial Sequence
  Synthetic oligonucleotide
ucugggcuguggggcaggugg

SEQ ID NO: 1743 - RNA, 21 nt, Artificial Sequence
  Synthetic oligonucleotide
cugggcuguggggcagguggu

SEQ ID NO: 1744 - RNA, 21 nt, Artificial Sequence
  Synthetic oligonucleotide
ugggcuguggggcagguggug

SEQ ID NO: 1745 - RNA, 21 nt, Artificial Sequence
  Synthetic oligonucleotide
gggcuguggggcagguggugg

SEQ ID NO: 1746 - RNA, 21 nt, Artificial Sequence
  Synthetic oligonucleotide
ggcuguggggcaggugguggc

SEQ ID NO: 1747 - RNA, 21 nt, Artificial Sequence
  Synthetic oligonucleotide
gcuguggggcaggugguggcc

SEQ ID NO: 1748 - RNA, 21 nt, Artificial Sequence
  Synthetic oligonucleotide
caagaaaaugaugaaccuugu

SEQ ID NO: 1749 - RNA, 21 nt, Artificial Sequence
  Synthetic oligonucleotide
aaaugaugaaccuuguaaaga

SEQ ID NO: 1750 - RNA, 21 nt, Artificial Sequence
  Synthetic oligonucleotide
augaugaaccuuguaaagaaa

SEQ ID NO: 1751 - RNA, 21 nt, Artificial Sequence
  Synthetic oligonucleotide
ugaugaaccuuguaaagaaau

SEQ ID NO: 1752 - RNA, 21 nt, Artificial Sequence
  Synthetic oligonucleotide
accuuguaaagaaauucucag

SEQ ID NO: 1753 - RNA, 21 nt, Artificial Sequence
  Synthetic oligonucleotide
ccuuguaaagaaauucucagg

SEQ ID NO: 1754 - RNA, 21 nt, Artificial Sequence
  Synthetic oligonucleotide
ucaguagugaagaaauguugu

SEQ ID NO: 1755 - RNA, 21 nt, Artificial Sequence
  Synthetic oligonucleotide
caguagugaagaaauguuguu

SEQ ID NO: 1756 - RNA, 21 nt, Artificial Sequence
  Synthetic oligonucleotide
augaagacccuguuaccagua

SEQ ID NO: 1757 - RNA, 21 nt, Artificial Sequence
  Synthetic oligonucleotide
agcaagccagaaauucggagu

SEQ ID NO: 1758 - RNA, 21 nt, Artificial Sequence
  Synthetic oligonucleotide
ugucaaggcaaagguguucaa

SEQ ID NO: 1759 - RNA, 21 nt, Artificial Sequence
  Synthetic oligonucleotide
gucaaggcaaagguguucaaa

SEQ ID NO: 1760 - RNA, 21 nt, Artificial Sequence
  Synthetic oligonucleotide
ucaaggcaaagguguucaaag

SEQ ID NO: 1761 - RNA, 21 nt, Artificial Sequence
  Synthetic oligonucleotide
caaggcaaagguguucaaaga

SEQ ID NO: 1762 - RNA, 21 nt, Artificial Sequence
  Synthetic oligonucleotide
aagaugucuuccuggaaauga

SEQ ID NO: 1763 - RNA, 21 nt, Artificial Sequence
  Synthetic oligonucleotide
uccuggaaaugaauauaccau

SEQ ID NO: 1764 - RNA, 21 nt, Artificial Sequence
  Synthetic oligonucleotide
ccuggaaaugaauauaccaua

SEQ ID NO: 1765 - RNA, 21 nt, Artificial Sequence
  Synthetic oligonucleotide
cuggaaaugaauauaccauau

SEQ ID NO: 1766 - RNA, 21 nt, Artificial Sequence
  Synthetic oligonucleotide
uggaaaugaauauaccauauu

SEQ ID NO: 1767 - RNA, 21 nt, Artificial Sequence
  Synthetic oligonucleotide
ggaaaugaauauaccauauuc

SEQ ID NO: 1768 - RNA, 21 nt, Artificial Sequence
  Synthetic oligonucleotide
gaaaugaauauaccauauucu

SEQ ID NO: 1769 - RNA, 21 nt, Artificial Sequence
  Synthetic oligonucleotide
aaaugaauauaccauauucug

SEQ ID NO: 1770 - RNA, 21 nt, Artificial Sequence
  Synthetic oligonucleotide
aaugaauauaccauauucugu

SEQ ID NO: 1771 - RNA, 21 nt, Artificial Sequence
  Synthetic oligonucleotide
augaauauaccauauucuguu

SEQ ID NO: 1772 - RNA, 21 nt, Artificial Sequence
  Synthetic oligonucleotide
ugaauauaccauauucuguug

SEQ ID NO: 1773 - RNA, 21 nt, Artificial Sequence
  Synthetic oligonucleotide
gaauauaccauauucuguugu

SEQ ID NO: 1774 - RNA, 21 nt, Artificial Sequence
  Synthetic oligonucleotide
uacgaggagaacagauccaau

SEQ ID NO: 1775 - RNA, 21 nt, Artificial Sequence
  Synthetic oligonucleotide
acgaggagaacagauccaauu

SEQ ID NO: 1776 - RNA, 21 nt, Artificial Sequence
  Synthetic oligonucleotide
cgaggagaacagauccaauug

SEQ ID NO: 1777 - RNA, 21 nt, Artificial Sequence
  Synthetic oligonucleotide
gaggagaacagauccaauuga

SEQ ID NO: 1778 - RNA, 21 nt, Artificial Sequence
  Synthetic oligonucleotide
aggagaacagauccaauugaa

SEQ ID NO: 1779 - RNA, 21 nt, Artificial Sequence
  Synthetic oligonucleotide
ggagaacagauccaauugaaa

SEQ ID NO: 1780 - RNA, 21 nt, Artificial Sequence
  Synthetic oligonucleotide
gagaacagauccaauugaaag

SEQ ID NO: 1781 - RNA, 21 nt, Artificial Sequence
  Synthetic oligonucleotide
agaacagauccaauugaaagg

SEQ ID NO: 1782 - RNA, 21 nt, Artificial Sequence
  Synthetic oligonucleotide
gaacagauccaauugaaagga

SEQ ID NO: 1783 - RNA, 21 nt, Artificial Sequence
  Synthetic oligonucleotide
aacagauccaauugaaaggaa

SEQ ID NO: 1784 - RNA, 21 nt, Artificial Sequence
  Synthetic oligonucleotide
acagauccaauugaaaggaac

SEQ ID NO: 1785 - RNA, 21 nt, Artificial Sequence
  Synthetic oligonucleotide
cagauccaauugaaaggaacu

SEQ ID NO: 1786 - RNA, 21 nt, Artificial Sequence
  Synthetic oligonucleotide
agauccaauugaaaggaacug

SEQ ID NO: 1787 - RNA, 21 nt, Artificial Sequence
  Synthetic oligonucleotide
gauccaauugaaaggaacugu

SEQ ID NO: 1788 - RNA, 21 nt, Artificial Sequence
  Synthetic oligonucleotide
auccaauugaaaggaacuguu

SEQ ID NO: 1789 - RNA, 21 nt, Artificial Sequence
  Synthetic oligonucleotide
uccaauugaaaggaacuguuu

SEQ ID NO: 1790 - RNA, 21 nt, Artificial Sequence
  Synthetic oligonucleotide
ccaauugaaaggaacuguuua

SEQ ID NO: 1791 - RNA, 21 nt, Artificial Sequence
  Synthetic oligonucleotide
caauugaaaggaacuguuuac

SEQ ID NO: 1792 - RNA, 21 nt, Artificial Sequence
  Synthetic oligonucleotide
aauugaaaggaacuguuuaca

SEQ ID NO: 1793 - RNA, 21 nt, Artificial Sequence
  Synthetic oligonucleotide
auugaaaggaacuguuuacaa

SEQ ID NO: 1794 - RNA, 21 nt, Artificial Sequence
  Synthetic oligonucleotide
uugaaaggaacuguuuacaac

SEQ ID NO: 1795 - RNA, 21 nt, Artificial Sequence
  Synthetic oligonucleotide
ugaaaggaacuguuuacaacu

SEQ ID NO: 1796 - RNA, 21 nt, Artificial Sequence
  Synthetic oligonucleotide
gaaaggaacuguuuacaacua

SEQ ID NO: 1797 - RNA, 21 nt, Artificial Sequence
  Synthetic oligonucleotide
aaaggaacuguuuacaacuau

SEQ ID NO: 1798 - RNA, 21 nt, Artificial Sequence
  Synthetic oligonucleotide
aaggaacuguuuacaacuaua

SEQ ID NO: 1799 - RNA, 21 nt, Artificial Sequence
  Synthetic oligonucleotide
guguuaaaaugucugcugugg

SEQ ID NO: 1800 - RNA, 21 nt, Artificial Sequence
  Synthetic oligonucleotide
uguuaaaaugucugcugugga

SEQ ID NO: 1801 - RNA, 21 nt, Artificial Sequence
  Synthetic oligonucleotide
guuaaaaugucugcuguggag

SEQ ID NO: 1802 - RNA, 21 nt, Artificial Sequence
  Synthetic oligonucleotide
uuaaaaugucugcuguggagg

SEQ ID NO: 1803 - RNA, 21 nt, Artificial Sequence
  Synthetic oligonucleotide
uaaaaugucugcuguggaggg

SEQ ID NO: 1804 - RNA, 21 nt, Artificial Sequence
  Synthetic oligonucleotide
ugugcuuccucuggaaauugg

SEQ ID NO: 1805 - RNA, 21 nt, Artificial Sequence
  Synthetic oligonucleotide
gugcuuccucuggaaauuggc

SEQ ID NO: 1806 - RNA, 21 nt, Artificial Sequence
  Synthetic oligonucleotide
ugcuuccucuggaaauuggcc

SEQ ID NO: 1807 - RNA, 21 nt, Artificial Sequence
  Synthetic oligonucleotide
gcuuccucuggaaauuggccu

SEQ ID NO: 1808 - RNA, 21 nt, Artificial Sequence
  Synthetic oligonucleotide
cuuccucuggaaauuggccuu

SEQ ID NO: 1809 - RNA, 21 nt, Artificial Sequence
  Synthetic oligonucleotide
uuccucuggaaauuggccuuc

SEQ ID NO: 1810 - RNA, 21 nt, Artificial Sequence
  Synthetic oligonucleotide
uccucuggaaauuggccuuca

SEQ ID NO: 1811 - RNA, 21 nt, Artificial Sequence
  Synthetic oligonucleotide
ccucuggaaauuggccuucac

SEQ ID NO: 1812 - RNA, 21 nt, Artificial Sequence
  Synthetic oligonucleotide
acagaaaucaaaaggauuuug

SEQ ID NO: 1813 - RNA, 21 nt, Artificial Sequence
  Synthetic oligonucleotide
cagaaaucaaaaggauuuuga

SEQ ID NO: 1814 - RNA, 21 nt, Artificial Sequence
  Synthetic oligonucleotide
aucaaaaggauuuugagugua

SEQ ID NO: 1815 - RNA, 21 nt, Artificial Sequence
  Synthetic oligonucleotide
auauccuaacccaccucccca

SEQ ID NO: 1816 - RNA, 21 nt, Artificial Sequence
  Synthetic oligonucleotide
uauccuaacccaccuccccaa

SEQ ID NO: 1817 - RNA, 21 nt, Artificial Sequence
  Synthetic oligonucleotide
ucccaguauucuauguuuuuc

SEQ ID NO: 1818 - RNA, 21 nt, Artificial Sequence
  Synthetic oligonucleotide
acaggaaaucauuggaacauu

SEQ ID NO: 1819 - RNA, 21 nt, Artificial Sequence
  Synthetic oligonucleotide
caggaaaucauuggaacauuu

SEQ ID NO: 1820 - RNA, 21 nt, Artificial Sequence
  Synthetic oligonucleotide
uugagcauuauguccuacaga

SEQ ID NO: 1821 - RNA, 21 nt, Artificial Sequence
  Synthetic oligonucleotide
cacuugguuaacagcuuuugc

SEQ ID NO: 1822 - RNA, 21 nt, Artificial Sequence
  Synthetic oligonucleotide
uugguuaacagcuuuugcuuu

SEQ ID NO: 1823 - RNA, 21 nt, Artificial Sequence
  Synthetic oligonucleotide
ugguuaacagcuuuugcuuua

SEQ ID NO: 1824 - RNA, 21 nt, Artificial Sequence
  Synthetic oligonucleotide
uugcuuuaagaguacuuggac

SEQ ID NO: 1825 - RNA, 21 nt, Artificial Sequence
  Synthetic oligonucleotide
ugcuuuaagaguacuuggaca

SEQ ID NO: 1826 - RNA, 21 nt, Artificial Sequence
  Synthetic oligonucleotide
uuuaagaguacuuggacaagu

SEQ ID NO: 1827 - RNA, 21 nt, Artificial Sequence
  Synthetic oligonucleotide
uuaagaguacuuggacaagua

SEQ ID NO: 1828 - RNA, 21 nt, Artificial Sequence
  Synthetic oligonucleotide
cguagagcagaaccaaaauuc

SEQ ID NO: 1829 - RNA, 21 nt, Artificial Sequence
  Synthetic oligonucleotide
guagagcagaaccaaaauuca

SEQ ID NO: 1830 - RNA, 21 nt, Artificial Sequence
  Synthetic oligonucleotide
uagagcagaaccaaaauucaa

SEQ ID NO: 1831 - RNA, 21 nt, Artificial Sequence
  Synthetic oligonucleotide
agagcagaaccaaaauucaau

SEQ ID NO: 1832 - RNA, 21 nt, Artificial Sequence
  Synthetic oligonucleotide
uucacaguaucaaccaauaaa

SEQ ID NO: 1833 - RNA, 21 nt, Artificial Sequence
  Synthetic oligonucleotide
caaccaauaaaauuacagggu

SEQ ID NO: 1834 - RNA, 21 nt, Artificial Sequence
  Synthetic oligonucleotide
aaccaauaaaauuacagggua

SEQ ID NO: 1835 - RNA, 21 nt, Artificial Sequence
  Synthetic oligonucleotide
accaauaaaauuacaggguac

SEQ ID NO: 1836 - RNA, 21 nt, Artificial Sequence
  Synthetic oligonucleotide
uacugugauuggaauuagaaa

SEQ ID NO: 1837 - RNA, 21 nt, Artificial Sequence
  Synthetic oligonucleotide
acugugauuggaauuagaaag

SEQ ID NO: 1838 - RNA, 21 nt, Artificial Sequence
  Synthetic oligonucleotide
cugugauuggaauuagaaagg

SEQ ID NO: 1839 - RNA, 21 nt, Artificial Sequence
  Synthetic oligonucleotide
ugugauuggaauuagaaaggc

SEQ ID NO: 1840 - RNA, 21 nt, Artificial Sequence
  Synthetic oligonucleotide
cguucaauuguuucagcuuug

SEQ ID NO: 1841 - RNA, 21 nt, Artificial Sequence
  Synthetic oligonucleotide
uugaagagagaagcuuugguu

SEQ ID NO: 1842 - RNA, 21 nt, Artificial Sequence
  Synthetic oligonucleotide
ugaagagagaagcuuugguua

SEQ ID NO: 1843 - RNA, 21 nt, Artificial Sequence
  Synthetic oligonucleotide
gaagagagaagcuuugguuaa

SEQ ID NO: 1844 - RNA, 21 nt, Artificial Sequence
  Synthetic oligonucleotide
agagaagcuuugguuaaaggu

SEQ ID NO: 1845 - RNA, 21 nt, Artificial Sequence
  Synthetic oligonucleotide
gagaagcuuugguuaaaggua

SEQ ID NO: 1846 - RNA, 21 nt, Artificial Sequence
  Synthetic oligonucleotide
acccauuuaucguuuuuggaa

SEQ ID NO: 1847 - RNA, 21 nt, Artificial Sequence
  Synthetic oligonucleotide
augcuuuacucaccagucuga

SEQ ID NO: 1848 - RNA, 21 nt, Artificial Sequence
  Synthetic oligonucleotide
ugcuuuacucaccagucugaa

SEQ ID NO: 1849 - RNA, 21 nt, Artificial Sequence
  Synthetic oligonucleotide
uacucaccagucugaacuuga

SEQ ID NO: 1850 - RNA, 21 nt, Artificial Sequence
  Synthetic oligonucleotide
caccagucugaacuugaaaga

SEQ ID NO: 1851 - RNA, 21 nt, Artificial Sequence
  Synthetic oligonucleotide
cagaagagcagagguauggag

SEQ ID NO: 1852 - RNA, 21 nt, Artificial Sequence
  Synthetic oligonucleotide
agaagagcagagguauggagg

SEQ ID NO: 1853 - RNA, 21 nt, Artificial Sequence
  Synthetic oligonucleotide
cggaauauucacuccugguua

SEQ ID NO: 1854 - RNA, 21 nt, Artificial Sequence
  Synthetic oligonucleotide
ugccuuacauaauuauaaaau

SEQ ID NO: 1855 - RNA, 21 nt, Artificial Sequence
  Synthetic oligonucleotide
uacauguaacaacuguaguuc

SEQ ID NO: 1856 - RNA, 21 nt, Artificial Sequence
  Synthetic oligonucleotide
cugaggaaguuugcagcuuuu

SEQ ID NO: 1857 - RNA, 21 nt, Artificial Sequence
  Synthetic oligonucleotide
ugaggaaguuugcagcuuuua

SEQ ID NO: 1858 - RNA, 21 nt, Artificial Sequence
  Synthetic oligonucleotide
gaggaaguuugcagcuuuuau

SEQ ID NO: 1859 - RNA, 21 nt, Artificial Sequence
  Synthetic oligonucleotide
aggaaguuugcagcuuuuauu

SEQ ID NO: 1860 - RNA, 21 nt, Artificial Sequence
  Synthetic oligonucleotide
ggaaguuugcagcuuuuauuu

SEQ ID NO: 1861 - RNA, 21 nt, Artificial Sequence
  Synthetic oligonucleotide
gaaguuugcagcuuuuauuug

SEQ ID NO: 1862 - RNA, 21 nt, Artificial Sequence
  Synthetic oligonucleotide
aaguuugcagcuuuuauuuga

SEQ ID NO: 1863 - RNA, 21 nt, Artificial Sequence
  Synthetic oligonucleotide
aguuugcagcuuuuauuugaa

SEQ ID NO: 1864 - RNA, 21 nt, Artificial Sequence
  Synthetic oligonucleotide
uugcagcuuuuauuugaaaau

SEQ ID NO: 1865 - RNA, 21 nt, Artificial Sequence
  Synthetic oligonucleotide
cgauacucaggauauugaagc

SEQ ID NO: 1866 - RNA, 21 nt, Artificial Sequence
  Synthetic oligonucleotide
cucaggauauugaagcauccc

SEQ ID NO: 1867 - RNA, 21 nt, Artificial Sequence
  Synthetic oligonucleotide
aguagcaugugccagcuacaa

SEQ ID NO: 1868 - RNA, 21 nt, Artificial Sequence
  Synthetic oligonucleotide
guagcaugugccagcuacaag

SEQ ID NO: 1869 - RNA, 21 nt, Artificial Sequence
  Synthetic oligonucleotide
uagcaugugccagcuacaagc

SEQ ID NO: 1870 - RNA, 21 nt, Artificial Sequence
  Synthetic oligonucleotide
agcaugugccagcuacaagcc

SEQ ID NO: 1871 - RNA, 21 nt, Artificial Sequence
  Synthetic oligonucleotide
gcaugugccagcuacaagccc

SEQ ID NO: 1872 - RNA, 21 nt, Artificial Sequence
  Synthetic oligonucleotide
caugugccagcuacaagccca

SEQ ID NO: 1873 - RNA, 21 nt, Artificial Sequence
  Synthetic oligonucleotide
augugccagcuacaagcccag

SEQ ID NO: 1874 - RNA, 21 nt, Artificial Sequence
  Synthetic oligonucleotide
ugugccagcuacaagcccagc

SEQ ID NO: 1875 - RNA, 21 nt, Artificial Sequence
  Synthetic oligonucleotide
gugccagcuacaagcccagca

SEQ ID NO: 1876 - RNA, 21 nt, Artificial Sequence
  Synthetic oligonucleotide
aagauggacauguuauucugc

SEQ ID NO: 1877 - RNA, 21 nt, Artificial Sequence
  Synthetic oligonucleotide
agauggacauguuauucugca

SEQ ID NO: 1878 - RNA, 21 nt, Artificial Sequence
  Synthetic oligonucleotide
auggacauguuauucugcaac

SEQ ID NO: 1879 - RNA, 21 nt, Artificial Sequence
  Synthetic oligonucleotide
ggacauguuauucugcaacug

SEQ ID NO: 1880 - RNA, 21 nt, Artificial Sequence
  Synthetic oligonucleotide
gacauguuauucugcaacuga

SEQ ID NO: 1881 - RNA, 21 nt, Artificial Sequence
  Synthetic oligonucleotide
acauguuauucugcaacugaa

SEQ ID NO: 1882 - RNA, 21 nt, Artificial Sequence
  Synthetic oligonucleotide
uuauucugcaacugaauucga

SEQ ID NO: 1883 - RNA, 21 nt, Artificial Sequence
  Synthetic oligonucleotide
uauucugcaacugaauucgau

SEQ ID NO: 1884 - RNA, 21 nt, Artificial Sequence
  Synthetic oligonucleotide
cagauaaacaguguaccaugu

SEQ ID NO: 1885 - RNA, 21 nt, Artificial Sequence
  Synthetic oligonucleotide
agauaaacaguguaccauguu

SEQ ID NO: 1886 - RNA, 21 nt, Artificial Sequence
  Synthetic oligonucleotide
auaaacaguguaccauguuuu

SEQ ID NO: 1887 - RNA, 21 nt, Artificial Sequence
  Synthetic oligonucleotide
aaacaguguaccauguuuuau

SEQ ID NO: 1888 - RNA, 21 nt, Artificial Sequence
  Synthetic oligonucleotide
uuauagcacuuccaauaucaa

SEQ ID NO: 1889 - RNA, 21 nt, Artificial Sequence
  Synthetic oligonucleotide
aauucagaaagucugugaagg

SEQ ID NO: 1890 - RNA, 21 nt, Artificial Sequence
  Synthetic oligonucleotide
auucagaaagucugugaagga

SEQ ID NO: 1891 - RNA, 21 nt, Artificial Sequence
  Synthetic oligonucleotide
uucagaaagucugugaaggag

SEQ ID NO: 1892 - RNA, 21 nt, Artificial Sequence
  Synthetic oligonucleotide
ucagaaagucugugaaggagc

SEQ ID NO: 1893 - RNA, 21 nt, Artificial Sequence
  Synthetic oligonucleotide
aaccagagauugcauaugcuu

SEQ ID NO: 1894 - RNA, 21 nt, Artificial Sequence
  Synthetic oligonucleotide
accagagauugcauaugcuua

SEQ ID NO: 1895 - RNA, 21 nt, Artificial Sequence
  Synthetic oligonucleotide
ccagagauugcauaugcuuau

SEQ ID NO: 1896 - RNA, 21 nt, Artificial Sequence
  Synthetic oligonucleotide
cagagauugcauaugcuuaua

SEQ ID NO: 1897 - RNA, 21 nt, Artificial Sequence
  Synthetic oligonucleotide
agagauugcauaugcuuauaa

SEQ ID NO: 1898 - RNA, 21 nt, Artificial Sequence
  Synthetic oligonucleotide
guagaaaauguuuuugucaag

SEQ ID NO: 1899 - RNA, 21 nt, Artificial Sequence
  Synthetic oligonucleotide
uagaaaauguuuuugucaagu

SEQ ID NO: 1900 - RNA, 21 nt, Artificial Sequence
  Synthetic oligonucleotide
agaaaauguuuuugucaagua

SEQ ID NO: 1901 - RNA, 21 nt, Artificial Sequence
  Synthetic oligonucleotide
gaaaauguuuuugucaaguac

SEQ ID NO: 1902 - RNA, 21 nt, Artificial Sequence
  Synthetic oligonucleotide
aaaauguuuuugucaaguaca

SEQ ID NO: 1903 - RNA, 21 nt, Artificial Sequence
  Synthetic oligonucleotide
cuccagauaaaauacaauuuc

SEQ ID NO: 1904 - RNA, 21 nt, Artificial Sequence
  Synthetic oligonucleotide
acauguucaucgugucaagca

SEQ ID NO: 1905 - RNA, 21 nt, Artificial Sequence
  Synthetic oligonucleotide
uucaucgugucaagcauuuuu

SEQ ID NO: 1906 - RNA, 21 nt, Artificial Sequence
  Synthetic oligonucleotide
ucgugucaagcauuuuuagcu

SEQ ID NO: 1907 - RNA, 21 nt, Artificial Sequence
  Synthetic oligonucleotide
ucaagcauuuuuagcuaauuu

SEQ ID NO: 1908 - RNA, 21 nt, Artificial Sequence
  Synthetic oligonucleotide
aauggaugcuaaaauuccuga

SEQ ID NO: 1909 - RNA, 21 nt, Artificial Sequence
  Synthetic oligonucleotide
uuauggacuccuguuguugaa

SEQ ID NO: 1910 - RNA, 21 nt, Artificial Sequence
  Synthetic oligonucleotide
auggacuccuguuguugaagu

SEQ ID NO: 1911 - RNA, 21 nt, Artificial Sequence
  Synthetic oligonucleotide
uggacuccuguuguugaaguu

SEQ ID NO: 1912 - RNA, 21 nt, Artificial Sequence
  Synthetic oligonucleotide
acuugcuuuuauuagagaaug

SEQ ID NO: 1913 - RNA, 21 nt, Artificial Sequence
  Synthetic oligonucleotide
cuugcuuuuauuagagaauga

SEQ ID NO: 1914 - RNA, 21 nt, Artificial Sequence
  Synthetic oligonucleotide
uugcuuuuauuagagaaugau

SEQ ID NO: 1915 - RNA, 21 nt, Artificial Sequence
  Synthetic oligonucleotide
ugcuuuuauuagagaaugauu

SEQ ID NO: 1916 - RNA, 21 nt, Artificial Sequence
  Synthetic oligonucleotide
gacagauacuccuccaagguu

SEQ ID NO: 1917 - RNA, 21 nt, Artificial Sequence
  Synthetic oligonucleotide
aucauuaaagccugaguuugc

SEQ ID NO: 1918 - RNA, 21 nt, Artificial Sequence
  Synthetic oligonucleotide
ucauuaaagccugaguuugcu

SEQ ID NO: 1919 - RNA, 21 nt, Artificial Sequence
  Synthetic oligonucleotide
uuaaagccugaguuugcuuuc

SEQ ID NO: 1920 - RNA, 21 nt, Artificial Sequence
  Synthetic oligonucleotide
uaaagccugaguuugcuuuca

SEQ ID NO: 1921 - RNA, 27 nt, Artificial Sequence
  Synthetic oligonucleotide
acauaugucauuucagcaccaaaaaua

SEQ ID NO: 1922 - RNA, 27 nt, Artificial Sequence
  Synthetic oligonucleotide
auauugugauucaaguuuauggauaca

SEQ ID NO: 1923 - RNA, 27 nt, Artificial Sequence
  Synthetic oligonucleotide
uauugugauucaaguuuauggauacac

SEQ ID NO: 1924 - RNA, 27 nt, Artificial Sequence
  Synthetic oligonucleotide
auugugauucaaguuuauggauacacu

SEQ ID NO: 1925 - RNA, 27 nt, Artificial Sequence
  Synthetic oligonucleotide
uugugauucaaguuuauggauacacug

SEQ ID NO: 1926 - RNA, 27 nt, Artificial Sequence
  Synthetic oligonucleotide
ugugauucaaguuuauggauacacuga

SEQ ID NO: 1927 - RNA, 27 nt, Artificial Sequence
  Synthetic oligonucleotide
gugauucaaguuuauggauacacugaa

SEQ ID NO: 1928 - RNA, 27 nt, Artificial Sequence
  Synthetic oligonucleotide
ugauucaaguuuauggauacacugaag

SEQ ID NO: 1929 - RNA, 27 nt, Artificial Sequence
  Synthetic oligonucleotide
gauucaaguuuauggauacacugaagc

SEQ ID NO: 1930 - RNA, 27 nt, Artificial Sequence
  Synthetic oligonucleotide
auucaaguuuauggauacacugaagca

SEQ ID NO: 1931 - RNA, 27 nt, Artificial Sequence
  Synthetic oligonucleotide
uucaaguuuauggauacacugaagcau

SEQ ID NO: 1932 - RNA, 27 nt, Artificial Sequence
  Synthetic oligonucleotide
ucaaguuuauggauacacugaagcauu

SEQ ID NO: 1933 - RNA, 27 nt, Artificial Sequence
  Synthetic oligonucleotide
caaguuuauggauacacugaagcauuu

SEQ ID NO: 1934 - RNA, 27 nt, Artificial Sequence
  Synthetic oligonucleotide
aguuuauggauacacugaagcauuuga

SEQ ID NO: 1935 - RNA, 27 nt, Artificial Sequence
  Synthetic oligonucleotide
guuuauggauacacugaagcauuugau

SEQ ID NO: 1936 - RNA, 27 nt, Artificial Sequence
  Synthetic oligonucleotide
uuauggauacacugaagcauuugaugc

SEQ ID NO: 1937 - RNA, 27 nt, Artificial Sequence
  Synthetic oligonucleotide
auggauacacugaagcauuugaugcaa

SEQ ID NO: 1938 - RNA, 27 nt, Artificial Sequence
  Synthetic oligonucleotide
uggauacacugaagcauuugaugcaac

SEQ ID NO: 1939 - RNA, 27 nt, Artificial Sequence
  Synthetic oligonucleotide
ggauacacugaagcauuugaugcaaca

SEQ ID NO: 1940 - RNA, 27 nt, Artificial Sequence
  Synthetic oligonucleotide
gauacacugaagcauuugaugcaacaa

SEQ ID NO: 1941 - RNA, 27 nt, Artificial Sequence
  Synthetic oligonucleotide
auacacugaagcauuugaugcaacaau

SEQ ID NO: 1942 - RNA, 27 nt, Artificial Sequence
  Synthetic oligonucleotide
uacacugaagcauuugaugcaacaauc

SEQ ID NO: 1943 - RNA, 27 nt, Artificial Sequence
  Synthetic oligonucleotide
acacugaagcauuugaugcaacaaucu

SEQ ID NO: 1944 - RNA, 27 nt, Artificial Sequence
  Synthetic oligonucleotide
cacugaagcauuugaugcaacaaucuc

SEQ ID NO: 1945 - RNA, 27 nt, Artificial Sequence
  Synthetic oligonucleotide
cugaagcauuugaugcaacaaucucua

SEQ ID NO: 1946 - RNA, 27 nt, Artificial Sequence
  Synthetic oligonucleotide
gaagcauuugaugcaacaaucucuauu

SEQ ID NO: 1947 - RNA, 27 nt, Artificial Sequence
  Synthetic oligonucleotide
agcauuugaugcaacaaucucuauuaa

SEQ ID NO: 1948 - RNA, 27 nt, Artificial Sequence
  Synthetic oligonucleotide
uuugaugcaacaaucucuauuaaaagu

SEQ ID NO: 1949 - RNA, 27 nt, Artificial Sequence
  Synthetic oligonucleotide
uugaugcaacaaucucuauuaaaaguu

SEQ ID NO: 1950 - RNA, 27 nt, Artificial Sequence
  Synthetic oligonucleotide
ugaugcaacaaucucuauuaaaaguua

SEQ ID NO: 1951 - RNA, 27 nt, Artificial Sequence
  Synthetic oligonucleotide
gaugcaacaaucucuauuaaaaguuau

SEQ ID NO: 1952 - RNA, 27 nt, Artificial Sequence
  Synthetic oligonucleotide
caacaaucucuauuaaaaguuauccug

SEQ ID NO: 1953 - RNA, 27 nt, Artificial Sequence
  Synthetic oligonucleotide
aacaaucucuauuaaaaguuauccuga

SEQ ID NO: 1954 - RNA, 27 nt, Artificial Sequence
  Synthetic oligonucleotide
cucuauuaaaaguuauccugauaaaaa

SEQ ID NO: 1955 - RNA, 27 nt, Artificial Sequence
  Synthetic oligonucleotide
cuauuaaaaguuauccugauaaaaaau

SEQ ID NO: 1956 - RNA, 27 nt, Artificial Sequence
  Synthetic oligonucleotide
uuaaaaguuauccugauaaaaaauuua

SEQ ID NO: 1957 - RNA, 27 nt, Artificial Sequence
  Synthetic oligonucleotide
uaaaaguuauccugauaaaaaauuuag

SEQ ID NO: 1958 - RNA, 27 nt, Artificial Sequence
  Synthetic oligonucleotide
aaguuauccugauaaaaaauuuaguua

SEQ ID NO: 1959 - RNA, 27 nt, Artificial Sequence
  Synthetic oligonucleotide
aguuauccugauaaaaaauuuaguuac

SEQ ID NO: 1960 - RNA, 27 nt, Artificial Sequence
  Synthetic oligonucleotide
auguucauuuauccucagagaauaaau

SEQ ID NO: 1961 - RNA, 27 nt, Artificial Sequence
  Synthetic oligonucleotide
uguucauuuauccucagagaauaaauu

SEQ ID NO: 1962 - RNA, 27 nt, Artificial Sequence
  Synthetic oligonucleotide
guguauuuggaaguuguaucaaagcau

SEQ ID NO: 1963 - RNA, 27 nt, Artificial Sequence
  Synthetic oligonucleotide
uguauuuggaaguuguaucaaagcauu

SEQ ID NO: 1964 - RNA, 27 nt, Artificial Sequence
  Synthetic oligonucleotide
auuuggaaguuguaucaaagcauuuuu

SEQ ID NO: 1965 - RNA, 27 nt, Artificial Sequence
  Synthetic oligonucleotide
uuuggaaguuguaucaaagcauuuuuc

SEQ ID NO: 1966 - RNA, 27 nt, Artificial Sequence
  Synthetic oligonucleotide
uuggaaguuguaucaaagcauuuuuca

SEQ ID NO: 1967 - RNA, 27 nt, Artificial Sequence
  Synthetic oligonucleotide
uggaaguuguaucaaagcauuuuucaa

SEQ ID NO: 1968 - RNA, 27 nt, Artificial Sequence
  Synthetic oligonucleotide
ggaaguuguaucaaagcauuuuucaaa

SEQ ID NO: 1969 - RNA, 27 nt, Artificial Sequence
  Synthetic oligonucleotide
gaaguuguaucaaagcauuuuucaaaa

SEQ ID NO: 1970 - RNA, 27 nt, Artificial Sequence
  Synthetic oligonucleotide
aaguuguaucaaagcauuuuucaaaau

SEQ ID NO: 1971 - RNA, 27 nt, Artificial Sequence
  Synthetic oligonucleotide
aguuguaucaaagcauuuuucaaaauc

SEQ ID NO: 1972 - RNA, 27 nt, Artificial Sequence
  Synthetic oligonucleotide
guuguaucaaagcauuuuucaaaauca

SEQ ID NO: 1973 - RNA, 27 nt, Artificial Sequence
  Synthetic oligonucleotide
uuguaucaaagcauuuuucaaaaucaa

SEQ ID NO: 1974 - RNA, 27 nt, Artificial Sequence
  Synthetic oligonucleotide
ccaauaaccuaugacaauggauuucuc

SEQ ID NO: 1975 - RNA, 27 nt, Artificial Sequence
  Synthetic oligonucleotide
accuaugacaauggauuucucuucauu

SEQ ID NO: 1976 - RNA, 27 nt, Artificial Sequence
  Synthetic oligonucleotide
augacaauggauuucucuucauucaua

SEQ ID NO: 1977 - RNA, 27 nt, Artificial Sequence
  Synthetic oligonucleotide
ugacaauggauuucucuucauucauac

SEQ ID NO: 1978 - RNA, 27 nt, Artificial Sequence
  Synthetic oligonucleotide
gacaauggauuucucuucauucauaca

SEQ ID NO: 1979 - RNA, 27 nt, Artificial Sequence
  Synthetic oligonucleotide
caauggauuucucuucauucauacaga

SEQ ID NO: 1980 - RNA, 27 nt, Artificial Sequence
  Synthetic oligonucleotide
aauggauuucucuucauucauacagac

SEQ ID NO: 1981 - RNA, 27 nt, Artificial Sequence
  Synthetic oligonucleotide
uggauuucucuucauucauacagacaa

SEQ ID NO: 1982 - RNA, 27 nt, Artificial Sequence
  Synthetic oligonucleotide
ucauucauacagacaaaccuguuuaua

SEQ ID NO: 1983 - RNA, 27 nt, Artificial Sequence
  Synthetic oligonucleotide
auucauacagacaaaccuguuuauacu

SEQ ID NO: 1984 - RNA, 27 nt, Artificial Sequence
  Synthetic oligonucleotide
uucauacagacaaaccuguuuauacuc

SEQ ID NO: 1985 - RNA, 27 nt, Artificial Sequence
  Synthetic oligonucleotide
ucauacagacaaaccuguuuauacucc

SEQ ID NO: 1986 - RNA, 27 nt, Artificial Sequence
  Synthetic oligonucleotide
aaguuagaguuuauucguugaaugacg

SEQ ID NO: 1987 - RNA, 27 nt, Artificial Sequence
  Synthetic oligonucleotide
aaugacgacuugaagccagccaaaaga

SEQ ID NO: 1988 - RNA, 27 nt, Artificial Sequence
  Synthetic oligonucleotide
augacgacuugaagccagccaaaagag

SEQ ID NO: 1989 - RNA, 27 nt, Artificial Sequence
  Synthetic oligonucleotide
ugacgacuugaagccagccaaaagaga

SEQ ID NO: 1990 - RNA, 27 nt, Artificial Sequence
  Synthetic oligonucleotide
gacgacuugaagccagccaaaagagaa

SEQ ID NO: 1991 - RNA, 27 nt, Artificial Sequence
  Synthetic oligonucleotide
agagaaacugucuuaacuuucauagau

SEQ ID NO: 1992 - RNA, 27 nt, Artificial Sequence
  Synthetic oligonucleotide
aaacugucuuaacuuucauagauccug

SEQ ID NO: 1993 - RNA, 27 nt, Artificial Sequence
  Synthetic oligonucleotide
aacugucuuaacuuucauagauccuga

SEQ ID NO: 1994 - RNA, 27 nt, Artificial Sequence
  Synthetic oligonucleotide
cugaaggaucagaaguugacaugguag

SEQ ID NO: 1995 - RNA, 27 nt, Artificial Sequence
  Synthetic oligonucleotide
ugaaggaucagaaguugacaugguaga

SEQ ID NO: 1996 - RNA, 27 nt, Artificial Sequence
  Synthetic oligonucleotide
uugacaugguagaagaaauugaucaua

SEQ ID NO: 1997 - RNA, 27 nt, Artificial Sequence
  Synthetic oligonucleotide
ugacaugguagaagaaauugaucauau

SEQ ID NO: 1998 - RNA, 27 nt, Artificial Sequence
  Synthetic oligonucleotide
augguagaagaaauugaucauauugga

SEQ ID NO: 1999 - RNA, 27 nt, Artificial Sequence
  Synthetic oligonucleotide
ugguagaagaaauugaucauauuggaa

SEQ ID NO: 2000 - RNA, 27 nt, Artificial Sequence
  Synthetic oligonucleotide
agaagaaauugaucauauuggaauuau

SEQ ID NO: 2001 - RNA, 27 nt, Artificial Sequence
  Synthetic oligonucleotide
gaagaaauugaucauauuggaauuauc

SEQ ID NO: 2002 - RNA, 27 nt, Artificial Sequence
  Synthetic oligonucleotide
uuggaauuaucucuuuuccugacuuca

SEQ ID NO: 2003 - RNA, 27 nt, Artificial Sequence
  Synthetic oligonucleotide
uggaauuaucucuuuuccugacuucaa

SEQ ID NO: 2004 - RNA, 27 nt, Artificial Sequence
  Synthetic oligonucleotide
ggaauuaucucuuuuccugacuucaag

SEQ ID NO: 2005 - RNA, 27 nt, Artificial Sequence
  Synthetic oligonucleotide
gaauuaucucuuuuccugacuucaaga

SEQ ID NO: 2006 - RNA, 27 nt, Artificial Sequence
  Synthetic oligonucleotide
aauuaucucuuuuccugacuucaagau

SEQ ID NO: 2007 - RNA, 27 nt, Artificial Sequence
  Synthetic oligonucleotide
auuaucucuuuuccugacuucaagauu

SEQ ID NO: 2008 - RNA, 27 nt, Artificial Sequence
  Synthetic oligonucleotide
uuaucucuuuuccugacuucaagauuc

SEQ ID NO: 2009 - RNA, 27 nt, Artificial Sequence
  Synthetic oligonucleotide
uaucucuuuuccugacuucaagauucc

SEQ ID NO: 2010 - RNA, 27 nt, Artificial Sequence
  Synthetic oligonucleotide
aucucuuuuccugacuucaagauuccg

SEQ ID NO: 2011 - RNA, 27 nt, Artificial Sequence
  Synthetic oligonucleotide
ucucuuuuccugacuucaagauuccgu

SEQ ID NO: 2012 - RNA, 27 nt, Artificial Sequence
  Synthetic oligonucleotide
cucuuuuccugacuucaagauuccguc

SEQ ID NO: 2013 - RNA, 27 nt, Artificial Sequence
  Synthetic oligonucleotide
ucuuuuccugacuucaagauuccgucu

SEQ ID NO: 2014 - RNA, 27 nt, Artificial Sequence
  Synthetic oligonucleotide
cuuuuccugacuucaagauuccgucua

SEQ ID NO: 2015 - RNA, 27 nt, Artificial Sequence
  Synthetic oligonucleotide
uuuuccugacuucaagauuccgucuaa

SEQ ID NO: 2016 - RNA, 27 nt, Artificial Sequence
  Synthetic oligonucleotide
aguuaaagaauaugucuugccacauuu

SEQ ID NO: 2017 - RNA, 27 nt, Artificial Sequence
  Synthetic oligonucleotide
guuaaagaauaugucuugccacauuuu

SEQ ID NO: 2018 - RNA, 27 nt, Artificial Sequence
  Synthetic oligonucleotide
uuaaagaauaugucuugccacauuuuu

SEQ ID NO: 2019 - RNA, 27 nt, Artificial Sequence
  Synthetic oligonucleotide
acaagaacuuuaagaauuuugaaauua

SEQ ID NO: 2020 - RNA, 27 nt, Artificial Sequence
  Synthetic oligonucleotide
caagaacuuuaagaauuuugaaauuac

SEQ ID NO: 2021 - RNA, 27 nt, Artificial Sequence
  Synthetic oligonucleotide
aacuuuaagaauuuugaaauuacuaua

SEQ ID NO: 2022 - RNA, 27 nt, Artificial Sequence
  Synthetic oligonucleotide
aagaauuuugaaauuacuauaaaagca

SEQ ID NO: 2023 - RNA, 27 nt, Artificial Sequence
  Synthetic oligonucleotide
agaauuuugaaauuacuauaaaagcaa

SEQ ID NO: 2024 - RNA, 27 nt, Artificial Sequence
  Synthetic oligonucleotide
gaauuuugaaauuacuauaaaagcaag

SEQ ID NO: 2025 - RNA, 27 nt, Artificial Sequence
  Synthetic oligonucleotide
uuuugaaauuacuauaaaagcaagaua

SEQ ID NO: 2026 - RNA, 27 nt, Artificial Sequence
  Synthetic oligonucleotide
uuugaaauuacuauaaaagcaagauau

SEQ ID NO: 2027 - RNA, 27 nt, Artificial Sequence
  Synthetic oligonucleotide
uugaaauuacuauaaaagcaagauauu

SEQ ID NO: 2028 - RNA, 27 nt, Artificial Sequence
  Synthetic oligonucleotide
uaaaagcaagauauuuuuauaauaaag

SEQ ID NO: 2029 - RNA, 27 nt, Artificial Sequence
  Synthetic oligonucleotide
aaaagcaagauauuuuuauaauaaagu

SEQ ID NO: 2030 - RNA, 27 nt, Artificial Sequence
  Synthetic oligonucleotide
aaagcaagauauuuuuauaauaaagua

SEQ ID NO: 2031 - RNA, 27 nt, Artificial Sequence
  Synthetic oligonucleotide
aagcaagauauuuuuauaauaaaguag

SEQ ID NO: 2032 - RNA, 27 nt, Artificial Sequence
  Synthetic oligonucleotide
agcaagauauuuuuauaauaaaguagu

SEQ ID NO: 2033 - RNA, 27 nt, Artificial Sequence
  Synthetic oligonucleotide
gcaagauauuuuuauaauaaaguaguc

SEQ ID NO: 2034 - RNA, 27 nt, Artificial Sequence
  Synthetic oligonucleotide
caagauauuuuuauaauaaaguaguca

SEQ ID NO: 2035 - RNA, 27 nt, Artificial Sequence
  Synthetic oligonucleotide
aagauauuuuuauaauaaaguagucac

SEQ ID NO: 2036 - RNA, 27 nt, Artificial Sequence
  Synthetic oligonucleotide
cacaauguugauaaauggaauugcuca

SEQ ID NO: 2037 - RNA, 27 nt, Artificial Sequence
  Synthetic oligonucleotide
acaauguugauaaauggaauugcucaa

SEQ ID NO: 2038 - RNA, 27 nt, Artificial Sequence
  Synthetic oligonucleotide
aauguugauaaauggaauugcucaagu

SEQ ID NO: 2039 - RNA, 27 nt, Artificial Sequence
  Synthetic oligonucleotide
auguugauaaauggaauugcucaaguc

SEQ ID NO: 2040 - RNA, 27 nt, Artificial Sequence
  Synthetic oligonucleotide
uguugauaaauggaauugcucaaguca

SEQ ID NO: 2041 - RNA, 27 nt, Artificial Sequence
  Synthetic oligonucleotide
ugauaaauggaauugcucaagucacau

SEQ ID NO: 2042 - RNA, 27 nt, Artificial Sequence
  Synthetic oligonucleotide
aaauggaauugcucaagucacauuuga

SEQ ID NO: 2043 - RNA, 27 nt, Artificial Sequence
  Synthetic oligonucleotide
ugcucaagucacauuugauucugaaac

SEQ ID NO: 2044 - RNA, 27 nt, Artificial Sequence
  Synthetic oligonucleotide
cucaagucacauuugauucugaaacag

SEQ ID NO: 2045 - RNA, 27 nt, Artificial Sequence
  Synthetic oligonucleotide
ucaagucacauuugauucugaaacagc

SEQ ID NO: 2046 - RNA, 27 nt, Artificial Sequence
  Synthetic oligonucleotide
caagucacauuugauucugaaacagca

SEQ ID NO: 2047 - RNA, 27 nt, Artificial Sequence
  Synthetic oligonucleotide
cacauuugauucugaaacagcagucaa

SEQ ID NO: 2048 - RNA, 27 nt, Artificial Sequence
  Synthetic oligonucleotide
cauuugauucugaaacagcagucaaag

SEQ ID NO: 2049 - RNA, 27 nt, Artificial Sequence
  Synthetic oligonucleotide
auuugauucugaaacagcagucaaaga

SEQ ID NO: 2050 - RNA, 27 nt, Artificial Sequence
  Synthetic oligonucleotide
aacagcagucaaagaacugucauacua

SEQ ID NO: 2051 - RNA, 27 nt, Artificial Sequence
  Synthetic oligonucleotide
cagcagucaaagaacugucauacuaca

SEQ ID NO: 2052 - RNA, 27 nt, Artificial Sequence
  Synthetic oligonucleotide
cagucaaagaacugucauacuacaguu

SEQ ID NO: 2053 - RNA, 27 nt, Artificial Sequence
  Synthetic oligonucleotide
caaagaacugucauacuacaguuuaga

SEQ ID NO: 2054 - RNA, 27 nt, Artificial Sequence
  Synthetic oligonucleotide
aaagaacugucauacuacaguuuagaa

SEQ ID NO: 2055 - RNA, 27 nt, Artificial Sequence
  Synthetic oligonucleotide
agaacugucauacuacaguuuagaaga

SEQ ID NO: 2056 - RNA, 27 nt, Artificial Sequence
  Synthetic oligonucleotide
auuuaaacaacaaguaccuuuauauug

SEQ ID NO: 2057 - RNA, 27 nt, Artificial Sequence
  Synthetic oligonucleotide
uuuaaacaacaaguaccuuuauauugc

SEQ ID NO: 2058 - RNA, 27 nt, Artificial Sequence
  Synthetic oligonucleotide
uuaaacaacaaguaccuuuauauugcu

SEQ ID NO: 2059 - RNA, 27 nt, Artificial Sequence
  Synthetic oligonucleotide
uaaacaacaaguaccuuuauauugcug

SEQ ID NO: 2060 - RNA, 27 nt, Artificial Sequence
  Synthetic oligonucleotide
aaacaacaaguaccuuuauauugcugu

SEQ ID NO: 2061 - RNA, 27 nt, Artificial Sequence
  Synthetic oligonucleotide
aacaacaaguaccuuuauauugcugua

SEQ ID NO: 2062 - RNA, 27 nt, Artificial Sequence
  Synthetic oligonucleotide
acaacaaguaccuuuauauugcuguaa

SEQ ID NO: 2063 - RNA, 27 nt, Artificial Sequence
  Synthetic oligonucleotide
caacaaguaccuuuauauugcuguaac

SEQ ID NO: 2064 - RNA, 27 nt, Artificial Sequence
  Synthetic oligonucleotide
aacaaguaccuuuauauugcuguaaca

SEQ ID NO: 2065 - RNA, 27 nt, Artificial Sequence
  Synthetic oligonucleotide
acaaguaccuuuauauugcuguaacag

SEQ ID NO: 2066 - RNA, 27 nt, Artificial Sequence
  Synthetic oligonucleotide
caaguaccuuuauauugcuguaacagu

SEQ ID NO: 2067 - RNA, 27 nt, Artificial Sequence
  Synthetic oligonucleotide
aaguaccuuuauauugcuguaacaguc

SEQ ID NO: 2068 - RNA, 27 nt, Artificial Sequence
  Synthetic oligonucleotide
guaccuuuauauugcuguaacagucau

SEQ ID NO: 2069 - RNA, 27 nt, Artificial Sequence
  Synthetic oligonucleotide
caucaaauauguccucucucccuacaa

SEQ ID NO: 2070 - RNA, 27 nt, Artificial Sequence
  Synthetic oligonucleotide
cucccuacaaacugaauuugguugcua

SEQ ID NO: 2071 - RNA, 27 nt, Artificial Sequence
  Synthetic oligonucleotide
cuacaaacugaauuugguugcuacucc

SEQ ID NO: 2072 - RNA, 27 nt, Artificial Sequence
  Synthetic oligonucleotide
uacaaacugaauuugguugcuacuccu

SEQ ID NO: 2073 - RNA, 27 nt, Artificial Sequence
  Synthetic oligonucleotide
cacugaaugcacaaacaauugauguaa

SEQ ID NO: 2074 - RNA, 27 nt, Artificial Sequence
  Synthetic oligonucleotide
acugaaugcacaaacaauugauguaaa

SEQ ID NO: 2075 - RNA, 27 nt, Artificial Sequence
  Synthetic oligonucleotide
accaagagacaucugacuuggauccaa

SEQ ID NO: 2076 - RNA, 27 nt, Artificial Sequence
  Synthetic oligonucleotide
ccaagagacaucugacuuggauccaag

SEQ ID NO: 2077 - RNA, 27 nt, Artificial Sequence
  Synthetic oligonucleotide
aagguuaccgagcaauagcauacucau

SEQ ID NO: 2078 - RNA, 27 nt, Artificial Sequence
  Synthetic oligonucleotide
ucucagccaaaguuaccuuuauauuga

SEQ ID NO: 2079 - RNA, 27 nt, Artificial Sequence
  Synthetic oligonucleotide
cucagccaaaguuaccuuuauauugau

SEQ ID NO: 2080 - RNA, 27 nt, Artificial Sequence
  Synthetic oligonucleotide
ucagccaaaguuaccuuuauauugauu

SEQ ID NO: 2081 - RNA, 27 nt, Artificial Sequence
  Synthetic oligonucleotide
cagccaaaguuaccuuuauauugauug

SEQ ID NO: 2082 - RNA, 27 nt, Artificial Sequence
  Synthetic oligonucleotide
ccaaaagcccauauauugacaaaauaa

SEQ ID NO: 2083 - RNA, 27 nt, Artificial Sequence
  Synthetic oligonucleotide
aagcccauauauugacaaaauaacuca

SEQ ID NO: 2084 - RNA, 27 nt, Artificial Sequence
  Synthetic oligonucleotide
agcccauauauugacaaaauaacucac

SEQ ID NO: 2085 - RNA, 27 nt, Artificial Sequence
  Synthetic oligonucleotide
cccauauauugacaaaauaacucacua

SEQ ID NO: 2086 - RNA, 27 nt, Artificial Sequence
  Synthetic oligonucleotide
ccauauauugacaaaauaacucacuau

SEQ ID NO: 2087 - RNA, 27 nt, Artificial Sequence
  Synthetic oligonucleotide
cauauauugacaaaauaacucacuaua

SEQ ID NO: 2088 - RNA, 27 nt, Artificial Sequence
  Synthetic oligonucleotide
auauugacaaaauaacucacuauaauu

SEQ ID NO: 2089 - RNA, 27 nt, Artificial Sequence
  Synthetic oligonucleotide
auugacaaaauaacucacuauaauuac

SEQ ID NO: 2090 - RNA, 27 nt, Artificial Sequence
  Synthetic oligonucleotide
uugacaaaauaacucacuauaauuacu

SEQ ID NO: 2091 - RNA, 27 nt, Artificial Sequence
  Synthetic oligonucleotide
ugacaaaauaacucacuauaauuacuu

SEQ ID NO: 2092 - RNA, 27 nt, Artificial Sequence
  Synthetic oligonucleotide
gacaaaauaacucacuauaauuacuug

SEQ ID NO: 2093 - RNA, 27 nt, Artificial Sequence
  Synthetic oligonucleotide
acaaaauaacucacuauaauuacuuga

SEQ ID NO: 2094 - RNA, 27 nt, Artificial Sequence
  Synthetic oligonucleotide
caaaauaacucacuauaauuacuugau

SEQ ID NO: 2095 - RNA, 27 nt, Artificial Sequence
  Synthetic oligonucleotide
aaaauaacucacuauaauuacuugauu

SEQ ID NO: 2096 - RNA, 27 nt, Artificial Sequence
  Synthetic oligonucleotide
aaauaacucacuauaauuacuugauuu

SEQ ID NO: 2097 - RNA, 27 nt, Artificial Sequence
  Synthetic oligonucleotide
aauaacucacuauaauuacuugauuuu

SEQ ID NO: 2098 - RNA, 27 nt, Artificial Sequence
  Synthetic oligonucleotide
auaacucacuauaauuacuugauuuua

SEQ ID NO: 2099 - RNA, 27 nt, Artificial Sequence
  Synthetic oligonucleotide
uaacucacuauaauuacuugauuuuau

SEQ ID NO: 2100 - RNA, 27 nt, Artificial Sequence
  Synthetic oligonucleotide
aacucacuauaauuacuugauuuuauc

SEQ ID NO: 2101 - RNA, 27 nt, Artificial Sequence
  Synthetic oligonucleotide
acucacuauaauuacuugauuuuaucc

SEQ ID NO: 2102 - RNA, 27 nt, Artificial Sequence
  Synthetic oligonucleotide
cucacuauaauuacuugauuuuaucca

SEQ ID NO: 2103 - RNA, 27 nt, Artificial Sequence
  Synthetic oligonucleotide
ucacuauaauuacuugauuuuauccaa

SEQ ID NO: 2104 - RNA, 27 nt, Artificial Sequence
  Synthetic oligonucleotide
cacuauaauuacuugauuuuauccaag

SEQ ID NO: 2105 - RNA, 27 nt, Artificial Sequence
  Synthetic oligonucleotide
acuauaauuacuugauuuuauccaagg

SEQ ID NO: 2106 - RNA, 27 nt, Artificial Sequence
  Synthetic oligonucleotide
cuauaauuacuugauuuuauccaaggg

SEQ ID NO: 2107 - RNA, 27 nt, Artificial Sequence
  Synthetic oligonucleotide
uauaauuacuugauuuuauccaagggc

SEQ ID NO: 2108 - RNA, 27 nt, Artificial Sequence
  Synthetic oligonucleotide
auaauuacuugauuuuauccaagggca

SEQ ID NO: 2109 - RNA, 27 nt, Artificial Sequence
  Synthetic oligonucleotide
uaauuacuugauuuuauccaagggcaa

SEQ ID NO: 2110 - RNA, 27 nt, Artificial Sequence
  Synthetic oligonucleotide
gugucugauucagucugguuaaauauu

SEQ ID NO: 2111 - RNA, 27 nt, Artificial Sequence
  Synthetic oligonucleotide
gucugauucagucugguuaaauauuga

SEQ ID NO: 2112 - RNA, 27 nt, Artificial Sequence
  Synthetic oligonucleotide
ucugauucagucugguuaaauauugaa

SEQ ID NO: 2113 - RNA, 27 nt, Artificial Sequence
  Synthetic oligonucleotide
cugauucagucugguuaaauauugaag

SEQ ID NO: 2114 - RNA, 27 nt, Artificial Sequence
  Synthetic oligonucleotide
ugauucagucugguuaaauauugaaga

SEQ ID NO: 2115 - RNA, 27 nt, Artificial Sequence
  Synthetic oligonucleotide
auucagucugguuaaauauugaagaaa

SEQ ID NO: 2116 - RNA, 27 nt, Artificial Sequence
  Synthetic oligonucleotide
uucagucugguuaaauauugaagaaaa

SEQ ID NO: 2117 - RNA, 27 nt, Artificial Sequence
  Synthetic oligonucleotide
ucagucugguuaaauauugaagaaaaa

SEQ ID NO: 2118 - RNA, 27 nt, Artificial Sequence
  Synthetic oligonucleotide
cagucugguuaaauauugaagaaaaau

SEQ ID NO: 2119 - RNA, 27 nt, Artificial Sequence
  Synthetic oligonucleotide
agucugguuaaauauugaagaaaaaug

SEQ ID NO: 2120 - RNA, 27 nt, Artificial Sequence
  Synthetic oligonucleotide
gucugguuaaauauugaagaaaaaugu

SEQ ID NO: 2121 - RNA, 27 nt, Artificial Sequence
  Synthetic oligonucleotide
ucugguuaaauauugaagaaaaaugug

SEQ ID NO: 2122 - RNA, 27 nt, Artificial Sequence
  Synthetic oligonucleotide
cugguuaaauauugaagaaaaaugugg

SEQ ID NO: 2123 - RNA, 27 nt, Artificial Sequence
  Synthetic oligonucleotide
aauguggcaaccagcuccagguucauc

SEQ ID NO: 2124 - RNA, 27 nt, Artificial Sequence
  Synthetic oligonucleotide
auguggcaaccagcuccagguucaucu

SEQ ID NO: 2125 - RNA, 27 nt, Artificial Sequence
  Synthetic oligonucleotide
aucugggcuguggggcaggugguggcc

SEQ ID NO: 2126 - RNA, 27 nt, Artificial Sequence
  Synthetic oligonucleotide
ucugggcuguggggcaggugguggccu

SEQ ID NO: 2127 - RNA, 27 nt, Artificial Sequence
  Synthetic oligonucleotide
cugggcuguggggcaggugguggccuc

SEQ ID NO: 2128 - RNA, 27 nt, Artificial Sequence
  Synthetic oligonucleotide
ugggcuguggggcaggugguggccuca

SEQ ID NO: 2129 - RNA, 27 nt, Artificial Sequence
  Synthetic oligonucleotide
gggcuguggggcaggugguggccucaa

SEQ ID NO: 2130 - RNA, 27 nt, Artificial Sequence
  Synthetic oligonucleotide
ggcuguggggcaggugguggccucaac

SEQ ID NO: 2131 - RNA, 27 nt, Artificial Sequence
  Synthetic oligonucleotide
gcuguggggcaggugguggccucaaca

SEQ ID NO: 2132 - RNA, 27 nt, Artificial Sequence
  Synthetic oligonucleotide
caagaaaaugaugaaccuuguaaagaa

SEQ ID NO: 2133 - RNA, 27 nt, Artificial Sequence
  Synthetic oligonucleotide
aaaugaugaaccuuguaaagaaauucu

SEQ ID NO: 2134 - RNA, 27 nt, Artificial Sequence
  Synthetic oligonucleotide
augaugaaccuuguaaagaaauucuca

SEQ ID NO: 2135 - RNA, 27 nt, Artificial Sequence
  Synthetic oligonucleotide
ugaugaaccuuguaaagaaauucucag

SEQ ID NO: 2136 - RNA, 27 nt, Artificial Sequence
  Synthetic oligonucleotide
accuuguaaagaaauucucaggccaag

SEQ ID NO: 2137 - RNA, 27 nt, Artificial Sequence
  Synthetic oligonucleotide
ccuuguaaagaaauucucaggccaaga

SEQ ID NO: 2138 - RNA, 27 nt, Artificial Sequence
  Synthetic oligonucleotide
ucaguagugaagaaauguuguuacgau

SEQ ID NO: 2139 - RNA, 27 nt, Artificial Sequence
  Synthetic oligonucleotide
caguagugaagaaauguuguuacgaug

SEQ ID NO: 2140 - RNA, 27 nt, Artificial Sequence
  Synthetic oligonucleotide
augaagacccuguuaccaguaagcaag

SEQ ID NO: 2141 - RNA, 27 nt, Artificial Sequence
  Synthetic oligonucleotide
agcaagccagaaauucggaguuauuuu

SEQ ID NO: 2142 - RNA, 27 nt, Artificial Sequence
  Synthetic oligonucleotide
ugucaaggcaaagguguucaaagaugu

SEQ ID NO: 2143 - RNA, 27 nt, Artificial Sequence
  Synthetic oligonucleotide
gucaaggcaaagguguucaaagauguc

SEQ ID NO: 2144 - RNA, 27 nt, Artificial Sequence
  Synthetic oligonucleotide
ucaaggcaaagguguucaaagaugucu

SEQ ID NO: 2145 - RNA, 27 nt, Artificial Sequence
  Synthetic oligonucleotide
caaggcaaagguguucaaagaugucuu

SEQ ID NO: 2146 - RNA, 27 nt, Artificial Sequence
  Synthetic oligonucleotide
aagaugucuuccuggaaaugaauauac

SEQ ID NO: 2147 - RNA, 27 nt, Artificial Sequence
  Synthetic oligonucleotide
uccuggaaaugaauauaccauauucug

SEQ ID NO: 2148 - RNA, 27 nt, Artificial Sequence
  Synthetic oligonucleotide
ccuggaaaugaauauaccauauucugu

SEQ ID NO: 2149 - RNA, 27 nt, Artificial Sequence
  Synthetic oligonucleotide
cuggaaaugaauauaccauauucuguu

SEQ ID NO: 2150 - RNA, 27 nt, Artificial Sequence
  Synthetic oligonucleotide
uggaaaugaauauaccauauucuguug

SEQ ID NO: 2151 - RNA, 27 nt, Artificial Sequence
  Synthetic oligonucleotide
ggaaaugaauauaccauauucuguugu

SEQ ID NO: 2152 - RNA, 27 nt, Artificial Sequence
  Synthetic oligonucleotide
gaaaugaauauaccauauucuguugua

SEQ ID NO: 2153 - RNA, 27 nt, Artificial Sequence
  Synthetic oligonucleotide
aaaugaauauaccauauucuguuguac

SEQ ID NO: 2154 - RNA, 27 nt, Artificial Sequence
  Synthetic oligonucleotide
aaugaauauaccauauucuguuguacg

SEQ ID NO: 2155 - RNA, 27 nt, Artificial Sequence
  Synthetic oligonucleotide
augaauauaccauauucuguuguacga

SEQ ID NO: 2156 - RNA, 27 nt, Artificial Sequence
  Synthetic oligonucleotide
ugaauauaccauauucuguuguacgag

SEQ ID NO: 2157 - RNA, 27 nt, Artificial Sequence
  Synthetic oligonucleotide
gaauauaccauauucuguuguacgagg

SEQ ID NO: 2158 - RNA, 27 nt, Artificial Sequence
  Synthetic oligonucleotide
uacgaggagaacagauccaauugaaag

SEQ ID NO: 2159 - RNA, 27 nt, Artificial Sequence
  Synthetic oligonucleotide
acgaggagaacagauccaauugaaagg

SEQ ID NO: 2160 - RNA, 27 nt, Artificial Sequence
  Synthetic oligonucleotide
cgaggagaacagauccaauugaaagga

SEQ ID NO: 2161 - RNA, 27 nt, Artificial Sequence
  Synthetic oligonucleotide
gaggagaacagauccaauugaaaggaa

SEQ ID NO: 2162 - RNA, 27 nt, Artificial Sequence
  Synthetic oligonucleotide
aggagaacagauccaauugaaaggaac

SEQ ID NO: 2163 - RNA, 27 nt, Artificial Sequence
  Synthetic oligonucleotide
ggagaacagauccaauugaaaggaacu

SEQ ID NO: 2164 - RNA, 27 nt, Artificial Sequence
  Synthetic oligonucleotide
gagaacagauccaauugaaaggaacug

SEQ ID NO: 2165 - RNA, 27 nt, Artificial Sequence
  Synthetic oligonucleotide
agaacagauccaauugaaaggaacugu

SEQ ID NO: 2166 - RNA, 27 nt, Artificial Sequence
  Synthetic oligonucleotide
gaacagauccaauugaaaggaacuguu

SEQ ID NO: 2167 - RNA, 27 nt, Artificial Sequence
  Synthetic oligonucleotide
aacagauccaauugaaaggaacuguuu

SEQ ID NO: 2168 - RNA, 27 nt, Artificial Sequence
  Synthetic oligonucleotide
acagauccaauugaaaggaacuguuua

SEQ ID NO: 2169 - RNA, 27 nt, Artificial Sequence
  Synthetic oligonucleotide
cagauccaauugaaaggaacuguuuac

SEQ ID NO: 2170 - RNA, 27 nt, Artificial Sequence
  Synthetic oligonucleotide
agauccaauugaaaggaacuguuuaca

SEQ ID NO: 2171 - RNA, 27 nt, Artificial Sequence
  Synthetic oligonucleotide
gauccaauugaaaggaacuguuuacaa

SEQ ID NO: 2172 - RNA, 27 nt, Artificial Sequence
  Synthetic oligonucleotide
auccaauugaaaggaacuguuuacaac

SEQ ID NO: 2173 - RNA, 27 nt, Artificial Sequence
  Synthetic oligonucleotide
uccaauugaaaggaacuguuuacaacu

SEQ ID NO: 2174 - RNA, 27 nt, Artificial Sequence
  Synthetic oligonucleotide
ccaauugaaaggaacuguuuacaacua

SEQ ID NO: 2175 - RNA, 27 nt, Artificial Sequence
  Synthetic oligonucleotide
caauugaaaggaacuguuuacaacuau

SEQ ID NO: 2176 - RNA, 27 nt, Artificial Sequence
  Synthetic oligonucleotide
aauugaaaggaacuguuuacaacuaua

SEQ ID NO: 2177 - RNA, 27 nt, Artificial Sequence
  Synthetic oligonucleotide
auugaaaggaacuguuuacaacuauag

SEQ ID NO: 2178 - RNA, 27 nt, Artificial Sequence
  Synthetic oligonucleotide
uugaaaggaacuguuuacaacuauagg

SEQ ID NO: 2179 - RNA, 27 nt, Artificial Sequence
  Synthetic oligonucleotide
ugaaaggaacuguuuacaacuauagga

SEQ ID NO: 2180 - RNA, 27 nt, Artificial Sequence
  Synthetic oligonucleotide
gaaaggaacuguuuacaacuauaggac

SEQ ID NO: 2181 - RNA, 27 nt, Artificial Sequence
  Synthetic oligonucleotide
aaaggaacuguuuacaacuauaggacu

SEQ ID NO: 2182 - RNA, 27 nt, Artificial Sequence
  Synthetic oligonucleotide
aaggaacuguuuacaacuauaggacuu

SEQ ID NO: 2183 - RNA, 27 nt, Artificial Sequence
  Synthetic oligonucleotide
guguuaaaaugucugcuguggagggaa

SEQ ID NO: 2184 - RNA, 27 nt, Artificial Sequence
  Synthetic oligonucleotide
uguuaaaaugucugcuguggagggaau

SEQ ID NO: 2185 - RNA, 27 nt, Artificial Sequence
  Synthetic oligonucleotide
guuaaaaugucugcuguggagggaauc

SEQ ID NO: 2186 - RNA, 27 nt, Artificial Sequence
  Synthetic oligonucleotide
uuaaaaugucugcuguggagggaaucu

SEQ ID NO: 2187 - RNA, 27 nt, Artificial Sequence
  Synthetic oligonucleotide
uaaaaugucugcuguggagggaaucug

SEQ ID NO: 2188 - RNA, 27 nt, Artificial Sequence
  Synthetic oligonucleotide
ugugcuuccucuggaaauuggccuuca

SEQ ID NO: 2189 - RNA, 27 nt, Artificial Sequence
  Synthetic oligonucleotide
gugcuuccucuggaaauuggccuucac

SEQ ID NO: 2190 - RNA, 27 nt, Artificial Sequence
  Synthetic oligonucleotide
ugcuuccucuggaaauuggccuucaca

SEQ ID NO: 2191 - RNA, 27 nt, Artificial Sequence
  Synthetic oligonucleotide
gcuuccucuggaaauuggccuucacaa

SEQ ID NO: 2192 - RNA, 27 nt, Artificial Sequence
  Synthetic oligonucleotide
cuuccucuggaaauuggccuucacaac

SEQ ID NO: 2193 - RNA, 27 nt, Artificial Sequence
  Synthetic oligonucleotide
uuccucuggaaauuggccuucacaaca

SEQ ID NO: 2194 - RNA, 27 nt, Artificial Sequence
  Synthetic oligonucleotide
uccucuggaaauuggccuucacaacau

SEQ ID NO: 2195 - RNA, 27 nt, Artificial Sequence
  Synthetic oligonucleotide
ccucuggaaauuggccuucacaacauc

SEQ ID NO: 2196 - RNA, 27 nt, Artificial Sequence
  Synthetic oligonucleotide
acagaaaucaaaaggauuuugagugua

SEQ ID NO: 2197 - RNA, 27 nt, Artificial Sequence
  Synthetic oligonucleotide
cagaaaucaaaaggauuuugaguguaa

SEQ ID NO: 2198 - RNA, 27 nt, Artificial Sequence
  Synthetic oligonucleotide
aucaaaaggauuuugaguguaaaagga

SEQ ID NO: 2199 - RNA, 27 nt, Artificial Sequence
  Synthetic oligonucleotide
auauccuaacccaccuccccaaaggga

SEQ ID NO: 2200 - RNA, 27 nt, Artificial Sequence
  Synthetic oligonucleotide
uauccuaacccaccuccccaaagggag

SEQ ID NO: 2201 - RNA, 27 nt, Artificial Sequence
  Synthetic oligonucleotide
ucccaguauucuauguuuuucacuacc

SEQ ID NO: 2202 - RNA, 27 nt, Artificial Sequence
  Synthetic oligonucleotide
acaggaaaucauuggaacauuuuucau

SEQ ID NO: 2203 - RNA, 27 nt, Artificial Sequence
  Synthetic oligonucleotide
caggaaaucauuggaacauuuuucauu

SEQ ID NO: 2204 - RNA, 27 nt, Artificial Sequence
  Synthetic oligonucleotide
uugagcauuauguccuacagaaaugcu

SEQ ID NO: 2205 - RNA, 27 nt, Artificial Sequence
  Synthetic oligonucleotide
cacuugguuaacagcuuuugcuuuaag

SEQ ID NO: 2206 - RNA, 27 nt, Artificial Sequence
  Synthetic oligonucleotide
uugguuaacagcuuuugcuuuaagagu

SEQ ID NO: 2207 - RNA, 27 nt, Artificial Sequence
  Synthetic oligonucleotide
ugguuaacagcuuuugcuuuaagagua

SEQ ID NO: 2208 - RNA, 27 nt, Artificial Sequence
  Synthetic oligonucleotide
uugcuuuaagaguacuuggacaaguaa

SEQ ID NO: 2209 - RNA, 27 nt, Artificial Sequence
  Synthetic oligonucleotide
ugcuuuaagaguacuuggacaaguaaa

SEQ ID NO: 2210 - RNA, 27 nt, Artificial Sequence
  Synthetic oligonucleotide
uuuaagaguacuuggacaaguaaauaa

SEQ ID NO: 2211 - RNA, 27 nt, Artificial Sequence
  Synthetic oligonucleotide
uuaagaguacuuggacaaguaaauaaa

SEQ ID NO: 2212 - RNA, 27 nt, Artificial Sequence
  Synthetic oligonucleotide
cguagagcagaaccaaaauucaauuug

SEQ ID NO: 2213 - RNA, 27 nt, Artificial Sequence
  Synthetic oligonucleotide
guagagcagaaccaaaauucaauuugu

SEQ ID NO: 2214 - RNA, 27 nt, Artificial Sequence
  Synthetic oligonucleotide
uagagcagaaccaaaauucaauuugua

SEQ ID NO: 2215 - RNA, 27 nt, Artificial Sequence
  Synthetic oligonucleotide
agagcagaaccaaaauucaauuuguaa

SEQ ID NO: 2216 - RNA, 27 nt, Artificial Sequence
  Synthetic oligonucleotide
uucacaguaucaaccaauaaaauuaca

SEQ ID NO: 2217 - RNA, 27 nt, Artificial Sequence
  Synthetic oligonucleotide
caaccaauaaaauuacaggguaccuug

SEQ ID NO: 2218 - RNA, 27 nt, Artificial Sequence
  Synthetic oligonucleotide
aaccaauaaaauuacaggguaccuugc

SEQ ID NO: 2219 - RNA, 27 nt, Artificial Sequence
  Synthetic oligonucleotide
accaauaaaauuacaggguaccuugcc

SEQ ID NO: 2220 - RNA, 27 nt, Artificial Sequence
  Synthetic oligonucleotide
uacugugauuggaauuagaaaggcuuu

SEQ ID NO: 2221 - RNA, 27 nt, Artificial Sequence
  Synthetic oligonucleotide
acugugauuggaauuagaaaggcuuuc

SEQ ID NO: 2222 - RNA, 27 nt, Artificial Sequence
  Synthetic oligonucleotide
cugugauuggaauuagaaaggcuuucg

SEQ ID NO: 2223 - RNA, 27 nt, Artificial Sequence
  Synthetic oligonucleotide
ugugauuggaauuagaaaggcuuucga

SEQ ID NO: 2224 - RNA, 27 nt, Artificial Sequence
  Synthetic oligonucleotide
cguucaauuguuucagcuuugaagaga

SEQ ID NO: 2225 - RNA, 27 nt, Artificial Sequence
  Synthetic oligonucleotide
uugaagagagaagcuuugguuaaaggu

SEQ ID NO: 2226 - RNA, 27 nt, Artificial Sequence
  Synthetic oligonucleotide
ugaagagagaagcuuugguuaaaggua

SEQ ID NO: 2227 - RNA, 27 nt, Artificial Sequence
  Synthetic oligonucleotide
gaagagagaagcuuugguuaaagguaa

SEQ ID NO: 2228 - RNA, 27 nt, Artificial Sequence
  Synthetic oligonucleotide
agagaagcuuugguuaaagguaaucca

SEQ ID NO: 2229 - RNA, 27 nt, Artificial Sequence
  Synthetic oligonucleotide
gagaagcuuugguuaaagguaauccac

SEQ ID NO: 2230 - RNA, 27 nt, Artificial Sequence
  Synthetic oligonucleotide
acccauuuaucguuuuuggaaagacaa

SEQ ID NO: 2231 - RNA, 27 nt, Artificial Sequence
  Synthetic oligonucleotide
augcuuuacucaccagucugaacuuga

SEQ ID NO: 2232 - RNA, 27 nt, Artificial Sequence
  Synthetic oligonucleotide
ugcuuuacucaccagucugaacuugaa

SEQ ID NO: 2233 - RNA, 27 nt, Artificial Sequence
  Synthetic oligonucleotide
uacucaccagucugaacuugaaagaua

SEQ ID NO: 2234 - RNA, 27 nt, Artificial Sequence
  Synthetic oligonucleotide
caccagucugaacuugaaagauauaaa

SEQ ID NO: 2235 - RNA, 27 nt, Artificial Sequence
  Synthetic oligonucleotide
cagaagagcagagguauggagguggcu

SEQ ID NO: 2236 - RNA, 27 nt, Artificial Sequence
  Synthetic oligonucleotide
agaagagcagagguauggagguggcuu

SEQ ID NO: 2237 - RNA, 27 nt, Artificial Sequence
  Synthetic oligonucleotide
cggaauauucacuccugguuaaacaac

SEQ ID NO: 2238 - RNA, 27 nt, Artificial Sequence
  Synthetic oligonucleotide
ugccuuacauaauuauaaaaugacaga

SEQ ID NO: 2239 - RNA, 27 nt, Artificial Sequence
  Synthetic oligonucleotide
uacauguaacaacuguaguucacaaaa

SEQ ID NO: 2240 - RNA, 27 nt, Artificial Sequence
  Synthetic oligonucleotide
cugaggaaguuugcagcuuuuauuuga

SEQ ID NO: 2241 - RNA, 27 nt, Artificial Sequence
  Synthetic oligonucleotide
ugaggaaguuugcagcuuuuauuugaa

SEQ ID NO: 2242 - RNA, 27 nt, Artificial Sequence
  Synthetic oligonucleotide
gaggaaguuugcagcuuuuauuugaaa

SEQ ID NO: 2243 - RNA, 27 nt, Artificial Sequence
  Synthetic oligonucleotide
aggaaguuugcagcuuuuauuugaaaa

SEQ ID NO: 2244 - RNA, 27 nt, Artificial Sequence
  Synthetic oligonucleotide
ggaaguuugcagcuuuuauuugaaaau

SEQ ID NO: 2245 - RNA, 27 nt, Artificial Sequence
  Synthetic oligonucleotide
gaaguuugcagcuuuuauuugaaaauc

SEQ ID NO: 2246 - RNA, 27 nt, Artificial Sequence
  Synthetic oligonucleotide
aaguuugcagcuuuuauuugaaaaucg

SEQ ID NO: 2247 - RNA, 27 nt, Artificial Sequence
  Synthetic oligonucleotide
aguuugcagcuuuuauuugaaaaucga

SEQ ID NO: 2248 - RNA, 27 nt, Artificial Sequence
  Synthetic oligonucleotide
uugcagcuuuuauuugaaaaucgauac

SEQ ID NO: 2249 - RNA, 27 nt, Artificial Sequence
  Synthetic oligonucleotide
cgauacucaggauauugaagcauccca

SEQ ID NO: 2250 - RNA, 27 nt, Artificial Sequence
  Synthetic oligonucleotide
cucaggauauugaagcaucccacuaca

SEQ ID NO: 2251 - RNA, 27 nt, Artificial Sequence
  Synthetic oligonucleotide
aguagcaugugccagcuacaagcccag

SEQ ID NO: 2252 - RNA, 27 nt, Artificial Sequence
  Synthetic oligonucleotide
guagcaugugccagcuacaagcccagc

SEQ ID NO: 2253 - RNA, 27 nt, Artificial Sequence
  Synthetic oligonucleotide
uagcaugugccagcuacaagcccagca

SEQ ID NO: 2254 - RNA, 27 nt, Artificial Sequence
  Synthetic oligonucleotide
agcaugugccagcuacaagcccagcag

SEQ ID NO: 2255 - RNA, 27 nt, Artificial Sequence
  Synthetic oligonucleotide
gcaugugccagcuacaagcccagcagg

SEQ ID NO: 2256 - RNA, 27 nt, Artificial Sequence
  Synthetic oligonucleotide
caugugccagcuacaagcccagcaggg

SEQ ID NO: 2257 - RNA, 27 nt, Artificial Sequence
  Synthetic oligonucleotide
augugccagcuacaagcccagcaggga

SEQ ID NO: 2258 - RNA, 27 nt, Artificial Sequence
  Synthetic oligonucleotide
ugugccagcuacaagcccagcagggaa

SEQ ID NO: 2259 - RNA, 27 nt, Artificial Sequence
  Synthetic oligonucleotide
gugccagcuacaagcccagcagggaag

SEQ ID NO: 2260 - RNA, 27 nt, Artificial Sequence
  Synthetic oligonucleotide
aagauggacauguuauucugcaacuga

SEQ ID NO: 2261 - RNA, 27 nt, Artificial Sequence
  Synthetic oligonucleotide
agauggacauguuauucugcaacugaa

SEQ ID NO: 2262 - RNA, 27 nt, Artificial Sequence
  Synthetic oligonucleotide
auggacauguuauucugcaacugaauu

SEQ ID NO: 2263 - RNA, 27 nt, Artificial Sequence
  Synthetic oligonucleotide
ggacauguuauucugcaacugaauucg

SEQ ID NO: 2264 - RNA, 27 nt, Artificial Sequence
  Synthetic oligonucleotide
gacauguuauucugcaacugaauucga

SEQ ID NO: 2265 - RNA, 27 nt, Artificial Sequence
  Synthetic oligonucleotide
acauguuauucugcaacugaauucgau

SEQ ID NO: 2266 - RNA, 27 nt, Artificial Sequence
  Synthetic oligonucleotide
uuauucugcaacugaauucgauucccu

SEQ ID NO: 2267 - RNA, 27 nt, Artificial Sequence
  Synthetic oligonucleotide
uauucugcaacugaauucgauucccuc

SEQ ID NO: 2268 - RNA, 27 nt, Artificial Sequence
  Synthetic oligonucleotide
cagauaaacaguguaccauguuuuaua

SEQ ID NO: 2269 - RNA, 27 nt, Artificial Sequence
  Synthetic oligonucleotide
agauaaacaguguaccauguuuuauag

SEQ ID NO: 2270 - RNA, 27 nt, Artificial Sequence
  Synthetic oligonucleotide
auaaacaguguaccauguuuuauagca

SEQ ID NO: 2271 - RNA, 27 nt, Artificial Sequence
  Synthetic oligonucleotide
aaacaguguaccauguuuuauagcacu

SEQ ID NO: 2272 - RNA, 27 nt, Artificial Sequence
  Synthetic oligonucleotide
uuauagcacuuccaauaucaaaauuca

SEQ ID NO: 2273 - RNA, 27 nt, Artificial Sequence
  Synthetic oligonucleotide
aauucagaaagucugugaaggagccgc

SEQ ID NO: 2274 - RNA, 27 nt, Artificial Sequence
  Synthetic oligonucleotide
auucagaaagucugugaaggagccgcg

SEQ ID NO: 2275 - RNA, 27 nt, Artificial Sequence
  Synthetic oligonucleotide
uucagaaagucugugaaggagccgcgu

SEQ ID NO: 2276 - RNA, 27 nt, Artificial Sequence
  Synthetic oligonucleotide
ucagaaagucugugaaggagccgcgug

SEQ ID NO: 2277 - RNA, 27 nt, Artificial Sequence
  Synthetic oligonucleotide
aaccagagauugcauaugcuuauaaag

SEQ ID NO: 2278 - RNA, 27 nt, Artificial Sequence
  Synthetic oligonucleotide
accagagauugcauaugcuuauaaagu

SEQ ID NO: 2279 - RNA, 27 nt, Artificial Sequence
  Synthetic oligonucleotide
ccagagauugcauaugcuuauaaaguu

SEQ ID NO: 2280 - RNA, 27 nt, Artificial Sequence
  Synthetic oligonucleotide
cagagauugcauaugcuuauaaaguua

SEQ ID NO: 2281 - RNA, 27 nt, Artificial Sequence
  Synthetic oligonucleotide
agagauugcauaugcuuauaaaguuag

SEQ ID NO: 2282 - RNA, 27 nt, Artificial Sequence
  Synthetic oligonucleotide
guagaaaauguuuuugucaaguacaag

SEQ ID NO: 2283 - RNA, 27 nt, Artificial Sequence
  Synthetic oligonucleotide
uagaaaauguuuuugucaaguacaagg

SEQ ID NO: 2284 - RNA, 27 nt, Artificial Sequence
  Synthetic oligonucleotide
agaaaauguuuuugucaaguacaaggc

SEQ ID NO: 2285 - RNA, 27 nt, Artificial Sequence
  Synthetic oligonucleotide
gaaaauguuuuugucaaguacaaggca

SEQ ID NO: 2286 - RNA, 27 nt, Artificial Sequence
  Synthetic oligonucleotide
aaaauguuuuugucaaguacaaggcaa

SEQ ID NO: 2287 - RNA, 27 nt, Artificial Sequence
  Synthetic oligonucleotide
cuccagauaaaauacaauuucaguuuc

SEQ ID NO: 2288 - RNA, 27 nt, Artificial Sequence
  Synthetic oligonucleotide
acauguucaucgugucaagcauuuuua

SEQ ID NO: 2289 - RNA, 27 nt, Artificial Sequence
  Synthetic oligonucleotide
uucaucgugucaagcauuuuuagcuaa

SEQ ID NO: 2290 - RNA, 27 nt, Artificial Sequence
  Synthetic oligonucleotide
ucgugucaagcauuuuuagcuaauuua

SEQ ID NO: 2291 - RNA, 27 nt, Artificial Sequence
  Synthetic oligonucleotide
ucaagcauuuuuagcuaauuuagauga

SEQ ID NO: 2292 - RNA, 27 nt, Artificial Sequence
  Synthetic oligonucleotide
aauggaugcuaaaauuccugaaguuca

SEQ ID NO: 2293 - RNA, 27 nt, Artificial Sequence
  Synthetic oligonucleotide
uuauggacuccuguuguugaaguucgu

SEQ ID NO: 2294 - RNA, 27 nt, Artificial Sequence
  Synthetic oligonucleotide
auggacuccuguuguugaaguucguuu

SEQ ID NO: 2295 - RNA, 27 nt, Artificial Sequence
  Synthetic oligonucleotide
uggacuccuguuguugaaguucguuuu

SEQ ID NO: 2296 - RNA, 27 nt, Artificial Sequence
  Synthetic oligonucleotide
acuugcuuuuauuagagaaugauuuca

SEQ ID NO: 2297 - RNA, 27 nt, Artificial Sequence
  Synthetic oligonucleotide
cuugcuuuuauuagagaaugauuucaa

SEQ ID NO: 2298 - RNA, 27 nt, Artificial Sequence
  Synthetic oligonucleotide
uugcuuuuauuagagaaugauuucaaa

SEQ ID NO: 2299 - RNA, 27 nt, Artificial Sequence
  Synthetic oligonucleotide
ugcuuuuauuagagaaugauuucaaau

SEQ ID NO: 2300 - RNA, 27 nt, Artificial Sequence
  Synthetic oligonucleotide
gacagauacuccuccaagguuauugga

SEQ ID NO: 2301 - RNA, 27 nt, Artificial Sequence
  Synthetic oligonucleotide
aucauuaaagccugaguuugcuuucaa

SEQ ID NO: 2302 - RNA, 27 nt, Artificial Sequence
  Synthetic oligonucleotide
ucauuaaagccugaguuugcuuucaaa

SEQ ID NO: 2303 - RNA, 27 nt, Artificial Sequence
  Synthetic oligonucleotide
uuaaagccugaguuugcuuucaaaaaa

SEQ ID NO: 2304 - RNA, 27 nt, Artificial Sequence
  Synthetic oligonucleotide
uaaagccugaguuugcuuucaaaaaaa

SEQ ID NO: 2305 - RNA, 19 nt, Artificial Sequence
  Synthetic oligonucleotide
auaugucauuucagcacca

SEQ ID NO: 2306 - RNA, 19 nt, Artificial Sequence
  Synthetic oligonucleotide
auugugauucaaguuuaug

SEQ ID NO: 2307 - RNA, 19 nt, Artificial Sequence
  Synthetic oligonucleotide
uugugauucaaguuuaugg

SEQ ID NO: 2308 - RNA, 19 nt, Artificial Sequence
  Synthetic oligonucleotide
ugugauucaaguuuaugga

SEQ ID NO: 2309 - RNA, 19 nt, Artificial Sequence
  Synthetic oligonucleotide
gugauucaaguuuauggau

SEQ ID NO: 2310 - RNA, 19 nt, Artificial Sequence
  Synthetic oligonucleotide
ugauucaaguuuauggaua

SEQ ID NO: 2311 - RNA, 19 nt, Artificial Sequence
  Synthetic oligonucleotide
gauucaaguuuauggauac

SEQ ID NO: 2312 - RNA, 19 nt, Artificial Sequence
  Synthetic oligonucleotide
auucaaguuuauggauaca

SEQ ID NO: 2313 - RNA, 19 nt, Artificial Sequence
  Synthetic oligonucleotide
uucaaguuuauggauacac

SEQ ID NO: 2314 - RNA, 19 nt, Artificial Sequence
  Synthetic oligonucleotide
ucaaguuuauggauacacu

SEQ ID NO: 2315 - RNA, 19 nt, Artificial Sequence
  Synthetic oligonucleotide
caaguuuauggauacacug

SEQ ID NO: 2316 - RNA, 19 nt, Artificial Sequence
  Synthetic oligonucleotide
aaguuuauggauacacuga

SEQ ID NO: 2317 - RNA, 19 nt, Artificial Sequence
  Synthetic oligonucleotide
aguuuauggauacacugaa

SEQ ID NO: 2318 - RNA, 19 nt, Artificial Sequence
  Synthetic oligonucleotide
uuuauggauacacugaagc

SEQ ID NO: 2319 - RNA, 19 nt, Artificial Sequence
  Synthetic oligonucleotide
uuauggauacacugaagca

SEQ ID NO: 2320 - RNA, 19 nt, Artificial Sequence
  Synthetic oligonucleotide
auggauacacugaagcauu

SEQ ID NO: 2321 - RNA, 19 nt, Artificial Sequence
  Synthetic oligonucleotide
ggauacacugaagcauuug

SEQ ID NO: 2322 - RNA, 19 nt, Artificial Sequence
  Synthetic oligonucleotide
gauacacugaagcauuuga

SEQ ID NO: 2323 - RNA, 19 nt, Artificial Sequence
  Synthetic oligonucleotide
auacacugaagcauuugau

SEQ ID NO: 2324 - RNA, 19 nt, Artificial Sequence
  Synthetic oligonucleotide
uacacugaagcauuugaug

SEQ ID NO: 2325 - RNA, 19 nt, Artificial Sequence
  Synthetic oligonucleotide
acacugaagcauuugaugc

SEQ ID NO: 2326 - RNA, 19 nt, Artificial Sequence
  Synthetic oligonucleotide
cacugaagcauuugaugca

SEQ ID NO: 2327 - RNA, 19 nt, Artificial Sequence
  Synthetic oligonucleotide
acugaagcauuugaugcaa

SEQ ID NO: 2328 - RNA, 19 nt, Artificial Sequence
  Synthetic oligonucleotide
cugaagcauuugaugcaac

SEQ ID NO: 2329 - RNA, 19 nt, Artificial Sequence
  Synthetic oligonucleotide
gaagcauuugaugcaacaa

SEQ ID NO: 2330 - RNA, 19 nt, Artificial Sequence
  Synthetic oligonucleotide
agcauuugaugcaacaauc

SEQ ID NO: 2331 - RNA, 19 nt, Artificial Sequence
  Synthetic oligonucleotide
cauuugaugcaacaaucuc

SEQ ID NO: 2332 - RNA, 19 nt, Artificial Sequence
  Synthetic oligonucleotide
ugaugcaacaaucucuauu

SEQ ID NO: 2333 - RNA, 19 nt, Artificial Sequence
  Synthetic oligonucleotide
gaugcaacaaucucuauua

SEQ ID NO: 2334 - RNA, 19 nt, Artificial Sequence
  Synthetic oligonucleotide
augcaacaaucucuauuaa

SEQ ID NO: 2335 - RNA, 19 nt, Artificial Sequence
  Synthetic oligonucleotide
ugcaacaaucucuauuaaa

SEQ ID NO: 2336 - RNA, 19 nt, Artificial Sequence
  Synthetic oligonucleotide
acaaucucuauuaaaaguu

SEQ ID NO: 2337 - RNA, 19 nt, Artificial Sequence
  Synthetic oligonucleotide
caaucucuauuaaaaguua

SEQ ID NO: 2338 - RNA, 19 nt, Artificial Sequence
  Synthetic oligonucleotide
cuauuaaaaguuauccuga

SEQ ID NO: 2339 - RNA, 19 nt, Artificial Sequence
  Synthetic oligonucleotide
auuaaaaguuauccugaua

SEQ ID NO: 2340 - RNA, 19 nt, Artificial Sequence
  Synthetic oligonucleotide
aaaaguuauccugauaaaa

SEQ ID NO: 2341 - RNA, 19 nt, Artificial Sequence
  Synthetic oligonucleotide
aaaguuauccugauaaaaa

SEQ ID NO: 2342 - RNA, 19 nt, Artificial Sequence
  Synthetic oligonucleotide
guuauccugauaaaaaauu

SEQ ID NO: 2343 - RNA, 19 nt, Artificial Sequence
  Synthetic oligonucleotide
uuauccugauaaaaaauuu

SEQ ID NO: 2344 - RNA, 19 nt, Artificial Sequence
  Synthetic oligonucleotide
guucauuuauccucagaga

SEQ ID NO: 2345 - RNA, 19 nt, Artificial Sequence
  Synthetic oligonucleotide
uucauuuauccucagagaa

SEQ ID NO: 2346 - RNA, 19 nt, Artificial Sequence
  Synthetic oligonucleotide
guauuuggaaguuguauca

SEQ ID NO: 2347 - RNA, 19 nt, Artificial Sequence
  Synthetic oligonucleotide
uauuuggaaguuguaucaa

SEQ ID NO: 2348 - RNA, 19 nt, Artificial Sequence
  Synthetic oligonucleotide
uuggaaguuguaucaaagc

SEQ ID NO: 2349 - RNA, 19 nt, Artificial Sequence
  Synthetic oligonucleotide
uggaaguuguaucaaagca

SEQ ID NO: 2350 - RNA, 19 nt, Artificial Sequence
  Synthetic oligonucleotide
ggaaguuguaucaaagcau

SEQ ID NO: 2351 - RNA, 19 nt, Artificial Sequence
  Synthetic oligonucleotide
gaaguuguaucaaagcauu

SEQ ID NO: 2352 - RNA, 19 nt, Artificial Sequence
  Synthetic oligonucleotide
aaguuguaucaaagcauuu

SEQ ID NO: 2353 - RNA, 19 nt, Artificial Sequence
  Synthetic oligonucleotide
aguuguaucaaagcauuuu

SEQ ID NO: 2354 - RNA, 19 nt, Artificial Sequence
  Synthetic oligonucleotide
guuguaucaaagcauuuuu

SEQ ID NO: 2355 - RNA, 19 nt, Artificial Sequence
  Synthetic oligonucleotide
uuguaucaaagcauuuuuc

SEQ ID NO: 2356 - RNA, 19 nt, Artificial Sequence
  Synthetic oligonucleotide
uguaucaaagcauuuuuca

SEQ ID NO: 2357 - RNA, 19 nt, Artificial Sequence
  Synthetic oligonucleotide
guaucaaagcauuuuucaa

SEQ ID NO: 2358 - RNA, 19 nt, Artificial Sequence
  Synthetic oligonucleotide
aauaaccuaugacaaugga

SEQ ID NO: 2359 - RNA, 19 nt, Artificial Sequence
  Synthetic oligonucleotide
cuaugacaauggauuucuc

SEQ ID NO: 2360 - RNA, 19 nt, Artificial Sequence
  Synthetic oligonucleotide
gacaauggauuucucuuca

SEQ ID NO: 2361 - RNA, 19 nt, Artificial Sequence
  Synthetic oligonucleotide
acaauggauuucucuucau

SEQ ID NO: 2362 - RNA, 19 nt, Artificial Sequence
  Synthetic oligonucleotide
caauggauuucucuucauu

SEQ ID NO: 2363 - RNA, 19 nt, Artificial Sequence
  Synthetic oligonucleotide
auggauuucucuucauuca

SEQ ID NO: 2364 - RNA, 19 nt, Artificial Sequence
  Synthetic oligonucleotide
uggauuucucuucauucau

SEQ ID NO: 2365 - RNA, 19 nt, Artificial Sequence
  Synthetic oligonucleotide
gauuucucuucauucauac

SEQ ID NO: 2366 - RNA, 19 nt, Artificial Sequence
  Synthetic oligonucleotide
auucauacagacaaaccug

SEQ ID NO: 2367 - RNA, 19 nt, Artificial Sequence
  Synthetic oligonucleotide
ucauacagacaaaccuguu

SEQ ID NO: 2368 - RNA, 19 nt, Artificial Sequence
  Synthetic oligonucleotide
cauacagacaaaccuguuu

SEQ ID NO: 2369 - RNA, 19 nt, Artificial Sequence
  Synthetic oligonucleotide
auacagacaaaccuguuua

SEQ ID NO: 2370 - RNA, 19 nt, Artificial Sequence
  Synthetic oligonucleotide
guuagaguuuauucguuga

SEQ ID NO: 2371 - RNA, 19 nt, Artificial Sequence
  Synthetic oligonucleotide
ugacgacuugaagccagcc

SEQ ID NO: 2372 - RNA, 19 nt, Artificial Sequence
  Synthetic oligonucleotide
gacgacuugaagccagcca

SEQ ID NO: 2373 - RNA, 19 nt, Artificial Sequence
  Synthetic oligonucleotide
acgacuugaagccagccaa

SEQ ID NO: 2374 - RNA, 19 nt, Artificial Sequence
  Synthetic oligonucleotide
cgacuugaagccagccaaa

SEQ ID NO: 2375 - RNA, 19 nt, Artificial Sequence
  Synthetic oligonucleotide
agaaacugucuuaacuuuc

SEQ ID NO: 2376 - RNA, 19 nt, Artificial Sequence
  Synthetic oligonucleotide
acugucuuaacuuucauag

SEQ ID NO: 2377 - RNA, 19 nt, Artificial Sequence
  Synthetic oligonucleotide
cugucuuaacuuucauaga

SEQ ID NO: 2378 - RNA, 19 nt, Artificial Sequence
  Synthetic oligonucleotide
gaaggaucagaaguugaca

SEQ ID NO: 2379 - RNA, 19 nt, Artificial Sequence
  Synthetic oligonucleotide
aaggaucagaaguugacau

SEQ ID NO: 2380 - RNA, 19 nt, Artificial Sequence
  Synthetic oligonucleotide
gacaugguagaagaaauug

SEQ ID NO: 2381 - RNA, 19 nt, Artificial Sequence
  Synthetic oligonucleotide
acaugguagaagaaauuga

SEQ ID NO: 2382 - RNA, 19 nt, Artificial Sequence
  Synthetic oligonucleotide
gguagaagaaauugaucau

SEQ ID NO: 2383 - RNA, 19 nt, Artificial Sequence
  Synthetic oligonucleotide
guagaagaaauugaucaua

SEQ ID NO: 2384 - RNA, 19 nt, Artificial Sequence
  Synthetic oligonucleotide
aagaaauugaucauauugg

SEQ ID NO: 2385 - RNA, 19 nt, Artificial Sequence
  Synthetic oligonucleotide
agaaauugaucauauugga

SEQ ID NO: 2386 - RNA, 19 nt, Artificial Sequence
  Synthetic oligonucleotide
ggaauuaucucuuuuccug

SEQ ID NO: 2387 - RNA, 19 nt, Artificial Sequence
  Synthetic oligonucleotide
gaauuaucucuuuuccuga

SEQ ID NO: 2388 - RNA, 19 nt, Artificial Sequence
  Synthetic oligonucleotide
aauuaucucuuuuccugac

SEQ ID NO: 2389 - RNA, 19 nt, Artificial Sequence
  Synthetic oligonucleotide
auuaucucuuuuccugacu

SEQ ID NO: 2390 - RNA, 19 nt, Artificial Sequence
  Synthetic oligonucleotide
uuaucucuuuuccugacuu

SEQ ID NO: 2391 - RNA, 19 nt, Artificial Sequence
  Synthetic oligonucleotide
uaucucuuuuccugacuuc

SEQ ID NO: 2392 - RNA, 19 nt, Artificial Sequence
  Synthetic oligonucleotide
aucucuuuuccugacuuca

SEQ ID NO: 2393 - RNA, 19 nt, Artificial Sequence
  Synthetic oligonucleotide
ucucuuuuccugacuucaa

SEQ ID NO: 2394 - RNA, 19 nt, Artificial Sequence
  Synthetic oligonucleotide
cucuuuuccugacuucaag

SEQ ID NO: 2395 - RNA, 19 nt, Artificial Sequence
  Synthetic oligonucleotide
ucuuuuccugacuucaaga

SEQ ID NO: 2396 - RNA, 19 nt, Artificial Sequence
  Synthetic oligonucleotide
cuuuuccugacuucaagau

SEQ ID NO: 2397 - RNA, 19 nt, Artificial Sequence
  Synthetic oligonucleotide
uuuuccugacuucaagauu

SEQ ID NO: 2398 - RNA, 19 nt, Artificial Sequence
  Synthetic oligonucleotide
uuuccugacuucaagauuc

SEQ ID NO: 2399 - RNA, 19 nt, Artificial Sequence
  Synthetic oligonucleotide
uuccugacuucaagauucc

SEQ ID NO: 2400 - RNA, 19 nt, Artificial Sequence
  Synthetic oligonucleotide
uuaaagaauaugucuugcc

SEQ ID NO: 2401 - RNA, 19 nt, Artificial Sequence
  Synthetic oligonucleotide
uaaagaauaugucuugcca

SEQ ID NO: 2402 - RNA, 19 nt, Artificial Sequence
  Synthetic oligonucleotide
aaagaauaugucuugccac

SEQ ID NO: 2403 - RNA, 19 nt, Artificial Sequence
  Synthetic oligonucleotide
aagaacuuuaagaauuuug

SEQ ID NO: 2404 - RNA, 19 nt, Artificial Sequence
  Synthetic oligonucleotide
agaacuuuaagaauuuuga

SEQ ID NO: 2405 - RNA, 19 nt, Artificial Sequence
  Synthetic oligonucleotide
cuuuaagaauuuugaaauu

SEQ ID NO: 2406 - RNA, 19 nt, Artificial Sequence
  Synthetic oligonucleotide
gaauuuugaaauuacuaua

SEQ ID NO: 2407 - RNA, 19 nt, Artificial Sequence
  Synthetic oligonucleotide
aauuuugaaauuacuauaa

SEQ ID NO: 2408 - RNA, 19 nt, Artificial Sequence
  Synthetic oligonucleotide
auuuugaaauuacuauaaa

SEQ ID NO: 2409 - RNA, 19 nt, Artificial Sequence
  Synthetic oligonucleotide
uugaaauuacuauaaaagc

SEQ ID NO: 2410 - RNA, 19 nt, Artificial Sequence
  Synthetic oligonucleotide
ugaaauuacuauaaaagca

SEQ ID NO: 2411 - RNA, 19 nt, Artificial Sequence
  Synthetic oligonucleotide
gaaauuacuauaaaagcaa

SEQ ID NO: 2412 - RNA, 19 nt, Artificial Sequence
  Synthetic oligonucleotide
aaagcaagauauuuuuaua

SEQ ID NO: 2413 - RNA, 19 nt, Artificial Sequence
  Synthetic oligonucleotide
aagcaagauauuuuuauaa

SEQ ID NO: 2414 - RNA, 19 nt, Artificial Sequence
  Synthetic oligonucleotide
agcaagauauuuuuauaau

SEQ ID NO: 2415 - RNA, 19 nt, Artificial Sequence
  Synthetic oligonucleotide
gcaagauauuuuuauaaua

SEQ ID NO: 2416 - RNA, 19 nt, Artificial Sequence
  Synthetic oligonucleotide
caagauauuuuuauaauaa

SEQ ID NO: 2417 - RNA, 19 nt, Artificial Sequence
  Synthetic oligonucleotide
aagauauuuuuauaauaaa

SEQ ID NO: 2418 - RNA, 19 nt, Artificial Sequence
  Synthetic oligonucleotide
agauauuuuuauaauaaag

SEQ ID NO: 2419 - RNA, 19 nt, Artificial Sequence
  Synthetic oligonucleotide
gauauuuuuauaauaaagu

SEQ ID NO: 2420 - RNA, 19 nt, Artificial Sequence
  Synthetic oligonucleotide
caauguugauaaauggaau

SEQ ID NO: 2421 - RNA, 19 nt, Artificial Sequence
  Synthetic oligonucleotide
aauguugauaaauggaauu

SEQ ID NO: 2422 - RNA, 19 nt, Artificial Sequence
  Synthetic oligonucleotide
uguugauaaauggaauugc

SEQ ID NO: 2423 - RNA, 19 nt, Artificial Sequence
  Synthetic oligonucleotide
guugauaaauggaauugcu

SEQ ID NO: 2424 - RNA, 19 nt, Artificial Sequence
  Synthetic oligonucleotide
uugauaaauggaauugcuc

SEQ ID NO: 2425 - RNA, 19 nt, Artificial Sequence
  Synthetic oligonucleotide
auaaauggaauugcucaag

SEQ ID NO: 2426 - RNA, 19 nt, Artificial Sequence
  Synthetic oligonucleotide
auggaauugcucaagucac

SEQ ID NO: 2427 - RNA, 19 nt, Artificial Sequence
  Synthetic oligonucleotide
cucaagucacauuugauuc

SEQ ID NO: 2428 - RNA, 19 nt, Artificial Sequence
  Synthetic oligonucleotide
caagucacauuugauucug

SEQ ID NO: 2429 - RNA, 19 nt, Artificial Sequence
  Synthetic oligonucleotide
aagucacauuugauucuga

SEQ ID NO: 2430 - RNA, 19 nt, Artificial Sequence
  Synthetic oligonucleotide
agucacauuugauucugaa

SEQ ID NO: 2431 - RNA, 19 nt, Artificial Sequence
  Synthetic oligonucleotide
cauuugauucugaaacagc

SEQ ID NO: 2432 - RNA, 19 nt, Artificial Sequence
  Synthetic oligonucleotide
uuugauucugaaacagcag

SEQ ID NO: 2433 - RNA, 19 nt, Artificial Sequence
  Synthetic oligonucleotide
uugauucugaaacagcagu

SEQ ID NO: 2434 - RNA, 19 nt, Artificial Sequence
  Synthetic oligonucleotide
cagcagucaaagaacuguc

SEQ ID NO: 2435 - RNA, 19 nt, Artificial Sequence
  Synthetic oligonucleotide
gcagucaaagaacugucau

SEQ ID NO: 2436 - RNA, 19 nt, Artificial Sequence
  Synthetic oligonucleotide
gucaaagaacugucauacu

SEQ ID NO: 2437 - RNA, 19 nt, Artificial Sequence
  Synthetic oligonucleotide
aagaacugucauacuacag

SEQ ID NO: 2438 - RNA, 19 nt, Artificial Sequence
  Synthetic oligonucleotide
agaacugucauacuacagu

SEQ ID NO: 2439 - RNA, 19 nt, Artificial Sequence
  Synthetic oligonucleotide
aacugucauacuacaguuu

SEQ ID NO: 2440 - RNA, 19 nt, Artificial Sequence
  Synthetic oligonucleotide
uuaaacaacaaguaccuuu

SEQ ID NO: 2441 - RNA, 19 nt, Artificial Sequence
  Synthetic oligonucleotide
uaaacaacaaguaccuuua

SEQ ID NO: 2442 - RNA, 19 nt, Artificial Sequence
  Synthetic oligonucleotide
aaacaacaaguaccuuuau

SEQ ID NO: 2443 - RNA, 19 nt, Artificial Sequence
  Synthetic oligonucleotide
aacaacaaguaccuuuaua

SEQ ID NO: 2444 - RNA, 19 nt, Artificial Sequence
  Synthetic oligonucleotide
acaacaaguaccuuuauau

SEQ ID NO: 2445 - RNA, 19 nt, Artificial Sequence
  Synthetic oligonucleotide
caacaaguaccuuuauauu

SEQ ID NO: 2446 - RNA, 19 nt, Artificial Sequence
  Synthetic oligonucleotide
aacaaguaccuuuauauug

SEQ ID NO: 2447 - RNA, 19 nt, Artificial Sequence
  Synthetic oligonucleotide
acaaguaccuuuauauugc

SEQ ID NO: 2448 - RNA, 19 nt, Artificial Sequence
  Synthetic oligonucleotide
caaguaccuuuauauugcu

SEQ ID NO: 2449 - RNA, 19 nt, Artificial Sequence
  Synthetic oligonucleotide
aaguaccuuuauauugcug

SEQ ID NO: 2450 - RNA, 19 nt, Artificial Sequence
  Synthetic oligonucleotide
aguaccuuuauauugcugu

SEQ ID NO: 2451 - RNA, 19 nt, Artificial Sequence
  Synthetic oligonucleotide
guaccuuuauauugcugua

SEQ ID NO: 2452 - RNA, 19 nt, Artificial Sequence
  Synthetic oligonucleotide
accuuuauauugcuguaac

SEQ ID NO: 2453 - RNA, 19 nt, Artificial Sequence
  Synthetic oligonucleotide
ucaaauauguccucucucc

SEQ ID NO: 2454 - RNA, 19 nt, Artificial Sequence
  Synthetic oligonucleotide
cccuacaaacugaauuugg

SEQ ID NO: 2455 - RNA, 19 nt, Artificial Sequence
  Synthetic oligonucleotide
acaaacugaauuugguugc

SEQ ID NO: 2456 - RNA, 19 nt, Artificial Sequence
  Synthetic oligonucleotide
caaacugaauuugguugcu

SEQ ID NO: 2457 - RNA, 19 nt, Artificial Sequence
  Synthetic oligonucleotide
cugaaugcacaaacaauug

SEQ ID NO: 2458 - RNA, 19 nt, Artificial Sequence
  Synthetic oligonucleotide
ugaaugcacaaacaauuga

SEQ ID NO: 2459 - RNA, 19 nt, Artificial Sequence
  Synthetic oligonucleotide
caagagacaucugacuugg

SEQ ID NO: 2460 - RNA, 19 nt, Artificial Sequence
  Synthetic oligonucleotide
aagagacaucugacuugga

SEQ ID NO: 2461 - RNA, 19 nt, Artificial Sequence
  Synthetic oligonucleotide
gguuaccgagcaauagcau

SEQ ID NO: 2462 - RNA, 19 nt, Artificial Sequence
  Synthetic oligonucleotide
ucagccaaaguuaccuuua

SEQ ID NO: 2463 - RNA, 19 nt, Artificial Sequence
  Synthetic oligonucleotide
cagccaaaguuaccuuuau

SEQ ID NO: 2464 - RNA, 19 nt, Artificial Sequence
  Synthetic oligonucleotide
agccaaaguuaccuuuaua

SEQ ID NO: 2465 - RNA, 19 nt, Artificial Sequence
  Synthetic oligonucleotide
gccaaaguuaccuuuauau

SEQ ID NO: 2466 - RNA, 19 nt, Artificial Sequence
  Synthetic oligonucleotide
aaaagcccauauauugaca

SEQ ID NO: 2467 - RNA, 19 nt, Artificial Sequence
  Synthetic oligonucleotide
gcccauauauugacaaaau

SEQ ID NO: 2468 - RNA, 19 nt, Artificial Sequence
  Synthetic oligonucleotide
cccauauauugacaaaaua

SEQ ID NO: 2469 - RNA, 19 nt, Artificial Sequence
  Synthetic oligonucleotide
cauauauugacaaaauaac

SEQ ID NO: 2470 - RNA, 19 nt, Artificial Sequence
  Synthetic oligonucleotide
auauauugacaaaauaacu

SEQ ID NO: 2471 - RNA, 19 nt, Artificial Sequence
  Synthetic oligonucleotide
uauauugacaaaauaacuc

SEQ ID NO: 2472 - RNA, 19 nt, Artificial Sequence
  Synthetic oligonucleotide
auugacaaaauaacucacu

SEQ ID NO: 2473 - RNA, 19 nt, Artificial Sequence
  Synthetic oligonucleotide
ugacaaaauaacucacuau

SEQ ID NO: 2474 - RNA, 19 nt, Artificial Sequence
  Synthetic oligonucleotide
gacaaaauaacucacuaua

SEQ ID NO: 2475 - RNA, 19 nt, Artificial Sequence
  Synthetic oligonucleotide
acaaaauaacucacuauaa

SEQ ID NO: 2476 - RNA, 19 nt, Artificial Sequence
  Synthetic oligonucleotide
caaaauaacucacuauaau

SEQ ID NO: 2477 - RNA, 19 nt, Artificial Sequence
  Synthetic oligonucleotide
aaaauaacucacuauaauu

SEQ ID NO: 2478 - RNA, 19 nt, Artificial Sequence
  Synthetic oligonucleotide
aaauaacucacuauaauua

SEQ ID NO: 2479 - RNA, 19 nt, Artificial Sequence
  Synthetic oligonucleotide
aauaacucacuauaauuac

SEQ ID NO: 2480 - RNA, 19 nt, Artificial Sequence
  Synthetic oligonucleotide
auaacucacuauaauuacu

SEQ ID NO: 2481 - RNA, 19 nt, Artificial Sequence
  Synthetic oligonucleotide
uaacucacuauaauuacuu

SEQ ID NO: 2482 - RNA, 19 nt, Artificial Sequence
  Synthetic oligonucleotide
aacucacuauaauuacuug

SEQ ID NO: 2483 - RNA, 19 nt, Artificial Sequence
  Synthetic oligonucleotide
acucacuauaauuacuuga

SEQ ID NO: 2484 - RNA, 19 nt, Artificial Sequence
  Synthetic oligonucleotide
cucacuauaauuacuugau

SEQ ID NO: 2485 - RNA, 19 nt, Artificial Sequence
  Synthetic oligonucleotide
ucacuauaauuacuugauu

SEQ ID NO: 2486 - RNA, 19 nt, Artificial Sequence
  Synthetic oligonucleotide
cacuauaauuacuugauuu

SEQ ID NO: 2487 - RNA, 19 nt, Artificial Sequence
  Synthetic oligonucleotide
acuauaauuacuugauuuu

SEQ ID NO: 2488 - RNA, 19 nt, Artificial Sequence
  Synthetic oligonucleotide
cuauaauuacuugauuuua

SEQ ID NO: 2489 - RNA, 19 nt, Artificial Sequence
  Synthetic oligonucleotide
uauaauuacuugauuuuau

SEQ ID NO: 2490 - RNA, 19 nt, Artificial Sequence
  Synthetic oligonucleotide
auaauuacuugauuuuauc

SEQ ID NO: 2491 - RNA, 19 nt, Artificial Sequence
  Synthetic oligonucleotide
uaauuacuugauuuuaucc

SEQ ID NO: 2492 - RNA, 19 nt, Artificial Sequence
  Synthetic oligonucleotide
aauuacuugauuuuaucca

SEQ ID NO: 2493 - RNA, 19 nt, Artificial Sequence
  Synthetic oligonucleotide
auuacuugauuuuauccaa

SEQ ID NO: 2494 - RNA, 19 nt, Artificial Sequence
  Synthetic oligonucleotide
gucugauucagucugguua

SEQ ID NO: 2495 - RNA, 19 nt, Artificial Sequence
  Synthetic oligonucleotide
cugauucagucugguuaaa

SEQ ID NO: 2496 - RNA, 19 nt, Artificial Sequence
  Synthetic oligonucleotide
ugauucagucugguuaaau

SEQ ID NO: 2497 - RNA, 19 nt, Artificial Sequence
  Synthetic oligonucleotide
gauucagucugguuaaaua

SEQ ID NO: 2498 - RNA, 19 nt, Artificial Sequence
  Synthetic oligonucleotide
auucagucugguuaaauau

SEQ ID NO: 2499 - RNA, 19 nt, Artificial Sequence
  Synthetic oligonucleotide
ucagucugguuaaauauug

SEQ ID NO: 2500 - RNA, 19 nt, Artificial Sequence
  Synthetic oligonucleotide
cagucugguuaaauauuga

SEQ ID NO: 2501 - RNA, 19 nt, Artificial Sequence
  Synthetic oligonucleotide
agucugguuaaauauugaa

SEQ ID NO: 2502 - RNA, 19 nt, Artificial Sequence
  Synthetic oligonucleotide
gucugguuaaauauugaag

SEQ ID NO: 2503 - RNA, 19 nt, Artificial Sequence
  Synthetic oligonucleotide
ucugguuaaauauugaaga

SEQ ID NO: 2504 - RNA, 19 nt, Artificial Sequence
  Synthetic oligonucleotide
cugguuaaauauugaagaa

SEQ ID NO: 2505 - RNA, 19 nt, Artificial Sequence
  Synthetic oligonucleotide
ugguuaaauauugaagaaa

SEQ ID NO: 2506 - RNA, 19 nt, Artificial Sequence
  Synthetic oligonucleotide
gguuaaauauugaagaaaa

SEQ ID NO: 2507 - RNA, 19 nt, Artificial Sequence
  Synthetic oligonucleotide
uguggcaaccagcuccagg

SEQ ID NO: 2508 - RNA, 19 nt, Artificial Sequence
  Synthetic oligonucleotide
guggcaaccagcuccaggu

SEQ ID NO: 2509 - RNA, 19 nt, Artificial Sequence
  Synthetic oligonucleotide
cugggcuguggggcaggug

SEQ ID NO: 2510 - RNA, 19 nt, Artificial Sequence
  Synthetic oligonucleotide
ugggcuguggggcaggugg

SEQ ID NO: 2511 - RNA, 19 nt, Artificial Sequence
  Synthetic oligonucleotide
gggcuguggggcagguggu

SEQ ID NO: 2512 - RNA, 19 nt, Artificial Sequence
  Synthetic oligonucleotide
ggcuguggggcagguggug

SEQ ID NO: 2513 - RNA, 19 nt, Artificial Sequence
  Synthetic oligonucleotide
gcuguggggcagguggugg

SEQ ID NO: 2514 - RNA, 19 nt, Artificial Sequence
  Synthetic oligonucleotide
cuguggggcaggugguggc

SEQ ID NO: 2515 - RNA, 19 nt, Artificial Sequence
  Synthetic oligonucleotide
uguggggcaggugguggcc

SEQ ID NO: 2516 - RNA, 19 nt, Artificial Sequence
  Synthetic oligonucleotide
agaaaaugaugaaccuugu

SEQ ID NO: 2517 - RNA, 19 nt, Artificial Sequence
  Synthetic oligonucleotide
augaugaaccuuguaaaga

SEQ ID NO: 2518 - RNA, 19 nt, Artificial Sequence
  Synthetic oligonucleotide
gaugaaccuuguaaagaaa

SEQ ID NO: 2519 - RNA, 19 nt, Artificial Sequence
  Synthetic oligonucleotide
augaaccuuguaaagaaau

SEQ ID NO: 2520 - RNA, 19 nt, Artificial Sequence
  Synthetic oligonucleotide
cuuguaaagaaauucucag

SEQ ID NO: 2521 - RNA, 19 nt, Artificial Sequence
  Synthetic oligonucleotide
uuguaaagaaauucucagg

SEQ ID NO: 2522 - RNA, 19 nt, Artificial Sequence
  Synthetic oligonucleotide
aguagugaagaaauguugu

SEQ ID NO: 2523 - RNA, 19 nt, Artificial Sequence
  Synthetic oligonucleotide
guagugaagaaauguuguu

SEQ ID NO: 2524 - RNA, 19 nt, Artificial Sequence
  Synthetic oligonucleotide
gaagacccuguuaccagua

SEQ ID NO: 2525 - RNA, 19 nt, Artificial Sequence
  Synthetic oligonucleotide
caagccagaaauucggagu

SEQ ID NO: 2526 - RNA, 19 nt, Artificial Sequence
  Synthetic oligonucleotide
ucaaggcaaagguguucaa

SEQ ID NO: 2527 - RNA, 19 nt, Artificial Sequence
  Synthetic oligonucleotide
caaggcaaagguguucaaa

SEQ ID NO: 2528 - RNA, 19 nt, Artificial Sequence
  Synthetic oligonucleotide
aaggcaaagguguucaaag

SEQ ID NO: 2529 - RNA, 19 nt, Artificial Sequence
  Synthetic oligonucleotide
aggcaaagguguucaaaga

SEQ ID NO: 2530 - RNA, 19 nt, Artificial Sequence
  Synthetic oligonucleotide
gaugucuuccuggaaauga

SEQ ID NO: 2531 - RNA, 19 nt, Artificial Sequence
  Synthetic oligonucleotide
cuggaaaugaauauaccau

SEQ ID NO: 2532 - RNA, 19 nt, Artificial Sequence
  Synthetic oligonucleotide
uggaaaugaauauaccaua

SEQ ID NO: 2533 - RNA, 19 nt, Artificial Sequence
  Synthetic oligonucleotide
ggaaaugaauauaccauau

SEQ ID NO: 2534 - RNA, 19 nt, Artificial Sequence
  Synthetic oligonucleotide
gaaaugaauauaccauauu

SEQ ID NO: 2535 - RNA, 19 nt, Artificial Sequence
  Synthetic oligonucleotide
aaaugaauauaccauauuc

SEQ ID NO: 2536 - RNA, 19 nt, Artificial Sequence
  Synthetic oligonucleotide
aaugaauauaccauauucu

SEQ ID NO: 2537 - RNA, 19 nt, Artificial Sequence
  Synthetic oligonucleotide
augaauauaccauauucug

SEQ ID NO: 2538 - RNA, 19 nt, Artificial Sequence
  Synthetic oligonucleotide
ugaauauaccauauucugu

SEQ ID NO: 2539 - RNA, 19 nt, Artificial Sequence
  Synthetic oligonucleotide
gaauauaccauauucuguu

SEQ ID NO: 2540 - RNA, 19 nt, Artificial Sequence
  Synthetic oligonucleotide
aauauaccauauucuguug

SEQ ID NO: 2541 - RNA, 19 nt, Artificial Sequence
  Synthetic oligonucleotide
auauaccauauucuguugu

SEQ ID NO: 2542 - RNA, 19 nt, Artificial Sequence
  Synthetic oligonucleotide
cgaggagaacagauccaau

SEQ ID NO: 2543 - RNA, 19 nt, Artificial Sequence
  Synthetic oligonucleotide
gaggagaacagauccaauu

SEQ ID NO: 2544 - RNA, 19 nt, Artificial Sequence
  Synthetic oligonucleotide
aggagaacagauccaauug

SEQ ID NO: 2545 - RNA, 19 nt, Artificial Sequence
  Synthetic oligonucleotide
ggagaacagauccaauuga

SEQ ID NO: 2546 - RNA, 19 nt, Artificial Sequence
  Synthetic oligonucleotide
gagaacagauccaauugaa

SEQ ID NO: 2547 - RNA, 19 nt, Artificial Sequence
  Synthetic oligonucleotide
agaacagauccaauugaaa

SEQ ID NO: 2548 - RNA, 19 nt, Artificial Sequence
  Synthetic oligonucleotide
gaacagauccaauugaaag

SEQ ID NO: 2549 - RNA, 19 nt, Artificial Sequence
  Synthetic oligonucleotide
aacagauccaauugaaagg

SEQ ID NO: 2550 - RNA, 19 nt, Artificial Sequence
  Synthetic oligonucleotide
acagauccaauugaaagga

SEQ ID NO: 2551 - RNA, 19 nt, Artificial Sequence
  Synthetic oligonucleotide
cagauccaauugaaaggaa

SEQ ID NO: 2552 - RNA, 19 nt, Artificial Sequence
  Synthetic oligonucleotide
agauccaauugaaaggaac

SEQ ID NO: 2553 - RNA, 19 nt, Artificial Sequence
  Synthetic oligonucleotide
gauccaauugaaaggaacu

SEQ ID NO: 2554 - RNA, 19 nt, Artificial Sequence
  Synthetic oligonucleotide
auccaauugaaaggaacug

SEQ ID NO: 2555 - RNA, 19 nt, Artificial Sequence
  Synthetic oligonucleotide
uccaauugaaaggaacugu

SEQ ID NO: 2556 - RNA, 19 nt, Artificial Sequence
  Synthetic oligonucleotide
ccaauugaaaggaacuguu

SEQ ID NO: 2557 - RNA, 19 nt, Artificial Sequence
  Synthetic oligonucleotide
caauugaaaggaacuguuu

SEQ ID NO: 2558 - RNA, 19 nt, Artificial Sequence
  Synthetic oligonucleotide
aauugaaaggaacuguuua

SEQ ID NO: 2559 - RNA, 19 nt, Artificial Sequence
  Synthetic oligonucleotide
auugaaaggaacuguuuac

SEQ ID NO: 2560 - RNA, 19 nt, Artificial Sequence
  Synthetic oligonucleotide
uugaaaggaacuguuuaca

SEQ ID NO: 2561 - RNA, 19 nt, Artificial Sequence
  Synthetic oligonucleotide
ugaaaggaacuguuuacaa

SEQ ID NO: 2562 - RNA, 19 nt, Artificial Sequence
  Synthetic oligonucleotide
gaaaggaacuguuuacaac

SEQ ID NO: 2563 - RNA, 19 nt, Artificial Sequence
  Synthetic oligonucleotide
aaaggaacuguuuacaacu

SEQ ID NO: 2564 - RNA, 19 nt, Artificial Sequence
  Synthetic oligonucleotide
aaggaacuguuuacaacua

SEQ ID NO: 2565 - RNA, 19 nt, Artificial Sequence
  Synthetic oligonucleotide
aggaacuguuuacaacuau

SEQ ID NO: 2566 - RNA, 19 nt, Artificial Sequence
  Synthetic oligonucleotide
ggaacuguuuacaacuaua

SEQ ID NO: 2567 - RNA, 19 nt, Artificial Sequence
  Synthetic oligonucleotide
guuaaaaugucugcugugg

SEQ ID NO: 2568 - RNA, 19 nt, Artificial Sequence
  Synthetic oligonucleotide
uuaaaaugucugcugugga

SEQ ID NO: 2569 - RNA, 19 nt, Artificial Sequence
  Synthetic oligonucleotide
uaaaaugucugcuguggag

SEQ ID NO: 2570 - RNA, 19 nt, Artificial Sequence
  Synthetic oligonucleotide
aaaaugucugcuguggagg

SEQ ID NO: 2571 - RNA, 19 nt, Artificial Sequence
  Synthetic oligonucleotide
aaaugucugcuguggaggg

SEQ ID NO: 2572 - RNA, 19 nt, Artificial Sequence
  Synthetic oligonucleotide
ugcuuccucuggaaauugg

SEQ ID NO: 2573 - RNA, 19 nt, Artificial Sequence
  Synthetic oligonucleotide
gcuuccucuggaaauuggc

SEQ ID NO: 2574 - RNA, 19 nt, Artificial Sequence
  Synthetic oligonucleotide
cuuccucuggaaauuggcc

SEQ ID NO: 2575 - RNA, 19 nt, Artificial Sequence
  Synthetic oligonucleotide
uuccucuggaaauuggccu

SEQ ID NO: 2576 - RNA, 19 nt, Artificial Sequence
  Synthetic oligonucleotide
uccucuggaaauuggccuu

SEQ ID NO: 2577 - RNA, 19 nt, Artificial Sequence
  Synthetic oligonucleotide
ccucuggaaauuggccuuc

SEQ ID NO: 2578 - RNA, 19 nt, Artificial Sequence
  Synthetic oligonucleotide
cucuggaaauuggccuuca

SEQ ID NO: 2579 - RNA, 19 nt, Artificial Sequence
  Synthetic oligonucleotide
ucuggaaauuggccuucac

SEQ ID NO: 2580 - RNA, 19 nt, Artificial Sequence
  Synthetic oligonucleotide
agaaaucaaaaggauuuug

SEQ ID NO: 2581 - RNA, 19 nt, Artificial Sequence
  Synthetic oligonucleotide
gaaaucaaaaggauuuuga

SEQ ID NO: 2582 - RNA, 19 nt, Artificial Sequence
  Synthetic oligonucleotide
caaaaggauuuugagugua

SEQ ID NO: 2583 - RNA, 19 nt, Artificial Sequence
  Synthetic oligonucleotide
auccuaacccaccucccca

SEQ ID NO: 2584 - RNA, 19 nt, Artificial Sequence
  Synthetic oligonucleotide
uccuaacccaccuccccaa

SEQ ID NO: 2585 - RNA, 19 nt, Artificial Sequence
  Synthetic oligonucleotide
ccaguauucuauguuuuuc

SEQ ID NO: 2586 - RNA, 19 nt, Artificial Sequence
  Synthetic oligonucleotide
aggaaaucauuggaacauu

SEQ ID NO: 2587 - RNA, 19 nt, Artificial Sequence
  Synthetic oligonucleotide
ggaaaucauuggaacauuu

SEQ ID NO: 2588 - RNA, 19 nt, Artificial Sequence
  Synthetic oligonucleotide
gagcauuauguccuacaga

SEQ ID NO: 2589 - RNA, 19 nt, Artificial Sequence
  Synthetic oligonucleotide
cuugguuaacagcuuuugc

SEQ ID NO: 2590 - RNA, 19 nt, Artificial Sequence
  Synthetic oligonucleotide
gguuaacagcuuuugcuuu

SEQ ID NO: 2591 - RNA, 19 nt, Artificial Sequence
  Synthetic oligonucleotide
guuaacagcuuuugcuuua

SEQ ID NO: 2592 - RNA, 19 nt, Artificial Sequence
  Synthetic oligonucleotide
gcuuuaagaguacuuggac

SEQ ID NO: 2593 - RNA, 19 nt, Artificial Sequence
  Synthetic oligonucleotide
cuuuaagaguacuuggaca

SEQ ID NO: 2594 - RNA, 19 nt, Artificial Sequence
  Synthetic oligonucleotide
uaagaguacuuggacaagu

SEQ ID NO: 2595 - RNA, 19 nt, Artificial Sequence
  Synthetic oligonucleotide
aagaguacuuggacaagua

SEQ ID NO: 2596 - RNA, 19 nt, Artificial Sequence
  Synthetic oligonucleotide
uagagcagaaccaaaauuc

SEQ ID NO: 2597 - RNA, 19 nt, Artificial Sequence
  Synthetic oligonucleotide
agagcagaaccaaaauuca

SEQ ID NO: 2598 - RNA, 19 nt, Artificial Sequence
  Synthetic oligonucleotide
gagcagaaccaaaauucaa

SEQ ID NO: 2599 - RNA, 19 nt, Artificial Sequence
  Synthetic oligonucleotide
agcagaaccaaaauucaau

SEQ ID NO: 2600 - RNA, 19 nt, Artificial Sequence
  Synthetic oligonucleotide
cacaguaucaaccaauaaa

SEQ ID NO: 2601 - RNA, 19 nt, Artificial Sequence
  Synthetic oligonucleotide
accaauaaaauuacagggu

SEQ ID NO: 2602 - RNA, 19 nt, Artificial Sequence
  Synthetic oligonucleotide
ccaauaaaauuacagggua

SEQ ID NO: 2603 - RNA, 19 nt, Artificial Sequence
  Synthetic oligonucleotide
caauaaaauuacaggguac

SEQ ID NO: 2604 - RNA, 19 nt, Artificial Sequence
  Synthetic oligonucleotide
cugugauuggaauuagaaa

SEQ ID NO: 2605 - RNA, 19 nt, Artificial Sequence
  Synthetic oligonucleotide
ugugauuggaauuagaaag

SEQ ID NO: 2606 - RNA, 19 nt, Artificial Sequence
  Synthetic oligonucleotide
gugauuggaauuagaaagg

SEQ ID NO: 2607 - RNA, 19 nt, Artificial Sequence
  Synthetic oligonucleotide
ugauuggaauuagaaaggc

SEQ ID NO: 2608 - RNA, 19 nt, Artificial Sequence
  Synthetic oligonucleotide
uucaauuguuucagcuuug

SEQ ID NO: 2609 - RNA, 19 nt, Artificial Sequence
  Synthetic oligonucleotide
gaagagagaagcuuugguu

SEQ ID NO: 2610 - RNA, 19 nt, Artificial Sequence
  Synthetic oligonucleotide
aagagagaagcuuugguua

SEQ ID NO: 2611 - RNA, 19 nt, Artificial Sequence
  Synthetic oligonucleotide
agagagaagcuuugguuaa

SEQ ID NO: 2612 - RNA, 19 nt, Artificial Sequence
  Synthetic oligonucleotide
agaagcuuugguuaaaggu

SEQ ID NO: 2613 - RNA, 19 nt, Artificial Sequence
  Synthetic oligonucleotide
gaagcuuugguuaaaggua

SEQ ID NO: 2614 - RNA, 19 nt, Artificial Sequence
  Synthetic oligonucleotide
ccauuuaucguuuuuggaa

SEQ ID NO: 2615 - RNA, 19 nt, Artificial Sequence
  Synthetic oligonucleotide
gcuuuacucaccagucuga

SEQ ID NO: 2616 - RNA, 19 nt, Artificial Sequence
  Synthetic oligonucleotide
cuuuacucaccagucugaa

SEQ ID NO: 2617 - RNA, 19 nt, Artificial Sequence
  Synthetic oligonucleotide
cucaccagucugaacuuga

SEQ ID NO: 2618 - RNA, 19 nt, Artificial Sequence
  Synthetic oligonucleotide
ccagucugaacuugaaaga

SEQ ID NO: 2619 - RNA, 19 nt, Artificial Sequence
  Synthetic oligonucleotide
gaagagcagagguauggag

SEQ ID NO: 2620 - RNA, 19 nt, Artificial Sequence
  Synthetic oligonucleotide
aagagcagagguauggagg

SEQ ID NO: 2621 - RNA, 19 nt, Artificial Sequence
  Synthetic oligonucleotide
gaauauucacuccugguua

SEQ ID NO: 2622 - RNA, 19 nt, Artificial Sequence
  Synthetic oligonucleotide
ccuuacauaauuauaaaau

SEQ ID NO: 2623 - RNA, 19 nt, Artificial Sequence
  Synthetic oligonucleotide
cauguaacaacuguaguuc

SEQ ID NO: 2624 - RNA, 19 nt, Artificial Sequence
  Synthetic oligonucleotide
gaggaaguuugcagcuuuu

SEQ ID NO: 2625 - RNA, 19 nt, Artificial Sequence
  Synthetic oligonucleotide
aggaaguuugcagcuuuua

SEQ ID NO: 2626 - RNA, 19 nt, Artificial Sequence
  Synthetic oligonucleotide
ggaaguuugcagcuuuuau

SEQ ID NO: 2627 - RNA, 19 nt, Artificial Sequence
  Synthetic oligonucleotide
gaaguuugcagcuuuuauu

SEQ ID NO: 2628 - RNA, 19 nt, Artificial Sequence
  Synthetic oligonucleotide
aaguuugcagcuuuuauuu

SEQ ID NO: 2629 - RNA, 19 nt, Artificial Sequence
  Synthetic oligonucleotide
aguuugcagcuuuuauuug

SEQ ID NO: 2630 - RNA, 19 nt, Artificial Sequence
  Synthetic oligonucleotide
guuugcagcuuuuauuuga

SEQ ID NO: 2631 - RNA, 19 nt, Artificial Sequence
  Synthetic oligonucleotide
uuugcagcuuuuauuugaa

SEQ ID NO: 2632 - RNA, 19 nt, Artificial Sequence
  Synthetic oligonucleotide
gcagcuuuuauuugaaaau

SEQ ID NO: 2633 - RNA, 19 nt, Artificial Sequence
  Synthetic oligonucleotide
auacucaggauauugaagc

SEQ ID NO: 2634 - RNA, 19 nt, Artificial Sequence
  Synthetic oligonucleotide
caggauauugaagcauccc

SEQ ID NO: 2635 - RNA, 19 nt, Artificial Sequence
  Synthetic oligonucleotide
uagcaugugccagcuacaa

SEQ ID NO: 2636 - RNA, 19 nt, Artificial Sequence
  Synthetic oligonucleotide
agcaugugccagcuacaag

SEQ ID NO: 2637 - RNA, 19 nt, Artificial Sequence
  Synthetic oligonucleotide
gcaugugccagcuacaagc

SEQ ID NO: 2638 - RNA, 19 nt, Artificial Sequence
  Synthetic oligonucleotide
caugugccagcuacaagcc

SEQ ID NO: 2639 - RNA, 19 nt, Artificial Sequence
  Synthetic oligonucleotide
augugccagcuacaagccc

SEQ ID NO: 2640 - RNA, 19 nt, Artificial Sequence
  Synthetic oligonucleotide
ugugccagcuacaagccca

SEQ ID NO: 2641 - RNA, 19 nt, Artificial Sequence
  Synthetic oligonucleotide
gugccagcuacaagcccag

SEQ ID NO: 2642 - RNA, 19 nt, Artificial Sequence
  Synthetic oligonucleotide
ugccagcuacaagcccagc

SEQ ID NO: 2643 - RNA, 19 nt, Artificial Sequence
  Synthetic oligonucleotide
gccagcuacaagcccagca

SEQ ID NO: 2644 - RNA, 19 nt, Artificial Sequence
  Synthetic oligonucleotide
gauggacauguuauucugc

SEQ ID NO: 2645 - RNA, 19 nt, Artificial Sequence
  Synthetic oligonucleotide
auggacauguuauucugca

SEQ ID NO: 2646 - RNA, 19 nt, Artificial Sequence
  Synthetic oligonucleotide
ggacauguuauucugcaac

SEQ ID NO: 2647 - RNA, 19 nt, Artificial Sequence
  Synthetic oligonucleotide
acauguuauucugcaacug

SEQ ID NO: 2648 - RNA, 19 nt, Artificial Sequence
  Synthetic oligonucleotide
cauguuauucugcaacuga

SEQ ID NO: 2649 - RNA, 19 nt, Artificial Sequence
  Synthetic oligonucleotide
auguuauucugcaacugaa

SEQ ID NO: 2650 - RNA, 19 nt, Artificial Sequence
  Synthetic oligonucleotide
auucugcaacugaauucga

SEQ ID NO: 2651 - RNA, 19 nt, Artificial Sequence
  Synthetic oligonucleotide
uucugcaacugaauucgau

SEQ ID NO: 2652 - RNA, 19 nt, Artificial Sequence
  Synthetic oligonucleotide
gauaaacaguguaccaugu

SEQ ID NO: 2653 - RNA, 19 nt, Artificial Sequence
  Synthetic oligonucleotide
auaaacaguguaccauguu

SEQ ID NO: 2654 - RNA, 19 nt, Artificial Sequence
  Synthetic oligonucleotide
aaacaguguaccauguuuu

SEQ ID NO: 2655 - RNA, 19 nt, Artificial Sequence
  Synthetic oligonucleotide
acaguguaccauguuuuau

SEQ ID NO: 2656 - RNA, 19 nt, Artificial Sequence
  Synthetic oligonucleotide
auagcacuuccaauaucaa

SEQ ID NO: 2657 - RNA, 19 nt, Artificial Sequence
  Synthetic oligonucleotide
uucagaaagucugugaagg

SEQ ID NO: 2658 - RNA, 19 nt, Artificial Sequence
  Synthetic oligonucleotide
ucagaaagucugugaagga

SEQ ID NO: 2659 - RNA, 19 nt, Artificial Sequence
  Synthetic oligonucleotide
cagaaagucugugaaggag

SEQ ID NO: 2660 - RNA, 19 nt, Artificial Sequence
  Synthetic oligonucleotide
agaaagucugugaaggagc

SEQ ID NO: 2661 - RNA, 19 nt, Artificial Sequence
  Synthetic oligonucleotide
ccagagauugcauaugcuu

SEQ ID NO: 2662 - RNA, 19 nt, Artificial Sequence
  Synthetic oligonucleotide
cagagauugcauaugcuua

SEQ ID NO: 2663 - RNA, 19 nt, Artificial Sequence
  Synthetic oligonucleotide
agagauugcauaugcuuau

SEQ ID NO: 2664 - RNA, 19 nt, Artificial Sequence
  Synthetic oligonucleotide
gagauugcauaugcuuaua

SEQ ID NO: 2665 - RNA, 19 nt, Artificial Sequence
  Synthetic oligonucleotide
agauugcauaugcuuauaa

SEQ ID NO: 2666 - RNA, 19 nt, Artificial Sequence
  Synthetic oligonucleotide
agaaaauguuuuugucaag

SEQ ID NO: 2667 - RNA, 19 nt, Artificial Sequence
  Synthetic oligonucleotide
gaaaauguuuuugucaagu

SEQ ID NO: 2668 - RNA, 19 nt, Artificial Sequence
  Synthetic oligonucleotide
aaaauguuuuugucaagua

SEQ ID NO: 2669 - RNA, 19 nt, Artificial Sequence
  Synthetic oligonucleotide
aaauguuuuugucaaguac

SEQ ID NO: 2670 - RNA, 19 nt, Artificial Sequence
  Synthetic oligonucleotide
aauguuuuugucaaguaca

SEQ ID NO: 2671 - RNA, 19 nt, Artificial Sequence
  Synthetic oligonucleotide
ccagauaaaauacaauuuc

SEQ ID NO: 2672 - RNA, 19 nt, Artificial Sequence
  Synthetic oligonucleotide
auguucaucgugucaagca

SEQ ID NO: 2673 - RNA, 19 nt, Artificial Sequence
  Synthetic oligonucleotide
caucgugucaagcauuuuu

SEQ ID NO: 2674 - RNA, 19 nt, Artificial Sequence
  Synthetic oligonucleotide
gugucaagcauuuuuagcu

SEQ ID NO: 2675 - RNA, 19 nt, Artificial Sequence
  Synthetic oligonucleotide
aagcauuuuuagcuaauuu

SEQ ID NO: 2676 - RNA, 19 nt, Artificial Sequence
  Synthetic oligonucleotide
uggaugcuaaaauuccuga

SEQ ID NO: 2677 - RNA, 19 nt, Artificial Sequence
  Synthetic oligonucleotide
auggacuccuguuguugaa

SEQ ID NO: 2678 - RNA, 19 nt, Artificial Sequence
  Synthetic oligonucleotide
ggacuccuguuguugaagu

SEQ ID NO: 2679 - RNA, 19 nt, Artificial Sequence
  Synthetic oligonucleotide
gacuccuguuguugaaguu

SEQ ID NO: 2680 - RNA, 19 nt, Artificial Sequence
  Synthetic oligonucleotide
uugcuuuuauuagagaaug

SEQ ID NO: 2681 - RNA, 19 nt, Artificial Sequence
  Synthetic oligonucleotide
ugcuuuuauuagagaauga

SEQ ID NO: 2682 - RNA, 19 nt, Artificial Sequence
  Synthetic oligonucleotide
gcuuuuauuagagaaugau

SEQ ID NO: 2683 - RNA, 19 nt, Artificial Sequence
  Synthetic oligonucleotide
cuuuuauuagagaaugauu

SEQ ID NO: 2684 - RNA, 19 nt, Artificial Sequence
  Synthetic oligonucleotide
cagauacuccuccaagguu

SEQ ID NO: 2685 - RNA, 19 nt, Artificial Sequence
  Synthetic oligonucleotide
cauuaaagccugaguuugc

SEQ ID NO: 2686 - RNA, 19 nt, Artificial Sequence
  Synthetic oligonucleotide
auuaaagccugaguuugcu

SEQ ID NO: 2687 - RNA, 19 nt, Artificial Sequence
  Synthetic oligonucleotide
aaagccugaguuugcuuuc

SEQ ID NO: 2688 - RNA, 19 nt, Artificial Sequence
  Synthetic oligonucleotide
aagccugaguuugcuuuca

SEQ ID NO: 2689 - RNA, 19 nt, Artificial Sequence
  Synthetic oligonucleotide
cauaugucauuucagcacc

SEQ ID NO: 2690 - RNA, 19 nt, Artificial Sequence
  Synthetic oligonucleotide
uauugugauucaaguuuau

SEQ ID NO: 2691 - RNA, 19 nt, Artificial Sequence
  Synthetic oligonucleotide
auugugauucaaguuuaug

SEQ ID NO: 2692 - RNA, 19 nt, Artificial Sequence
  Synthetic oligonucleotide
uugugauucaaguuuaugg

SEQ ID NO: 2693 - RNA, 19 nt, Artificial Sequence
  Synthetic oligonucleotide
ugugauucaaguuuaugga

SEQ ID NO: 2694 - RNA, 19 nt, Artificial Sequence
  Synthetic oligonucleotide
gugauucaaguuuauggau

SEQ ID NO: 2695 - RNA, 19 nt, Artificial Sequence
  Synthetic oligonucleotide
ugauucaaguuuauggaua

SEQ ID NO: 2696 - RNA, 19 nt, Artificial Sequence
  Synthetic oligonucleotide
gauucaaguuuauggauac

SEQ ID NO: 2697 - RNA, 19 nt, Artificial Sequence
  Synthetic oligonucleotide
auucaaguuuauggauaca

SEQ ID NO: 2698 - RNA, 19 nt, Artificial Sequence
  Synthetic oligonucleotide
uucaaguuuauggauacac

SEQ ID NO: 2699 - RNA, 19 nt, Artificial Sequence
  Synthetic oligonucleotide
ucaaguuuauggauacacu

SEQ ID NO: 2700 - RNA, 19 nt, Artificial Sequence
  Synthetic oligonucleotide
caaguuuauggauacacug

SEQ ID NO: 2701 - RNA, 19 nt, Artificial Sequence
  Synthetic oligonucleotide
aaguuuauggauacacuga

SEQ ID NO: 2702 - RNA, 19 nt, Artificial Sequence
  Synthetic oligonucleotide
guuuauggauacacugaag

SEQ ID NO: 2703 - RNA, 19 nt, Artificial Sequence
  Synthetic oligonucleotide
uuuauggauacacugaagc

SEQ ID NO: 2704 - RNA, 19 nt, Artificial Sequence
  Synthetic oligonucleotide
uauggauacacugaagcau

SEQ ID NO: 2705 - RNA, 19 nt, Artificial Sequence
  Synthetic oligonucleotide
uggauacacugaagcauuu

SEQ ID NO: 2706 - RNA, 19 nt, Artificial Sequence
  Synthetic oligonucleotide
ggauacacugaagcauuug

SEQ ID NO: 2707 - RNA, 19 nt, Artificial Sequence
  Synthetic oligonucleotide
gauacacugaagcauuuga

SEQ ID NO: 2708 - RNA, 19 nt, Artificial Sequence
  Synthetic oligonucleotide
auacacugaagcauuugau

SEQ ID NO: 2709 - RNA, 19 nt, Artificial Sequence
  Synthetic oligonucleotide
uacacugaagcauuugaug

SEQ ID NO: 2710 - RNA, 19 nt, Artificial Sequence
  Synthetic oligonucleotide
acacugaagcauuugaugc

SEQ ID NO: 2711 - RNA, 19 nt, Artificial Sequence
  Synthetic oligonucleotide
cacugaagcauuugaugca

SEQ ID NO: 2712 - RNA, 19 nt, Artificial Sequence
  Synthetic oligonucleotide
acugaagcauuugaugcaa

SEQ ID NO: 2713 - RNA, 19 nt, Artificial Sequence
  Synthetic oligonucleotide
ugaagcauuugaugcaaca

SEQ ID NO: 2714 - RNA, 19 nt, Artificial Sequence
  Synthetic oligonucleotide
aagcauuugaugcaacaau

SEQ ID NO: 2715 - RNA, 19 nt, Artificial Sequence
  Synthetic oligonucleotide
gcauuugaugcaacaaucu

SEQ ID NO: 2716 - RNA, 19 nt, Artificial Sequence
  Synthetic oligonucleotide
uugaugcaacaaucucuau

SEQ ID NO: 2717 - RNA, 19 nt, Artificial Sequence
  Synthetic oligonucleotide
ugaugcaacaaucucuauu

SEQ ID NO: 2718 - RNA, 19 nt, Artificial Sequence
  Synthetic oligonucleotide
gaugcaacaaucucuauua

SEQ ID NO: 2719 - RNA, 19 nt, Artificial Sequence
  Synthetic oligonucleotide
augcaacaaucucuauuaa

SEQ ID NO: 2720 - RNA, 19 nt, Artificial Sequence
  Synthetic oligonucleotide
aacaaucucuauuaaaagu

SEQ ID NO: 2721 - RNA, 19 nt, Artificial Sequence
  Synthetic oligonucleotide
acaaucucuauuaaaaguu

SEQ ID NO: 2722 - RNA, 19 nt, Artificial Sequence
  Synthetic oligonucleotide
ucuauuaaaaguuauccug

SEQ ID NO: 2723 - RNA, 19 nt, Artificial Sequence
  Synthetic oligonucleotide
uauuaaaaguuauccugau

SEQ ID NO: 2724 - RNA, 19 nt, Artificial Sequence
  Synthetic oligonucleotide
uaaaaguuauccugauaaa

SEQ ID NO: 2725 - RNA, 19 nt, Artificial Sequence
  Synthetic oligonucleotide
aaaaguuauccugauaaaa

SEQ ID NO: 2726 - RNA, 19 nt, Artificial Sequence
  Synthetic oligonucleotide
aguuauccugauaaaaaau

SEQ ID NO: 2727 - RNA, 19 nt, Artificial Sequence
  Synthetic oligonucleotide
guuauccugauaaaaaauu

SEQ ID NO: 2728 - RNA, 19 nt, Artificial Sequence
  Synthetic oligonucleotide
uguucauuuauccucagag

SEQ ID NO: 2729 - RNA, 19 nt, Artificial Sequence
  Synthetic oligonucleotide
guucauuuauccucagaga

SEQ ID NO: 2730 - RNA, 19 nt, Artificial Sequence
  Synthetic oligonucleotide
uguauuuggaaguuguauc

SEQ ID NO: 2731 - RNA, 19 nt, Artificial Sequence
  Synthetic oligonucleotide
guauuuggaaguuguauca

SEQ ID NO: 2732 - RNA, 19 nt, Artificial Sequence
  Synthetic oligonucleotide
uuuggaaguuguaucaaag

SEQ ID NO: 2733 - RNA, 19 nt, Artificial Sequence
  Synthetic oligonucleotide
uuggaaguuguaucaaagc

SEQ ID NO: 2734 - RNA, 19 nt, Artificial Sequence
  Synthetic oligonucleotide
uggaaguuguaucaaagca

SEQ ID NO: 2735 - RNA, 19 nt, Artificial Sequence
  Synthetic oligonucleotide
ggaaguuguaucaaagcau

SEQ ID NO: 2736 - RNA, 19 nt, Artificial Sequence
  Synthetic oligonucleotide
gaaguuguaucaaagcauu

SEQ ID NO: 2737 - RNA, 19 nt, Artificial Sequence
  Synthetic oligonucleotide
aaguuguaucaaagcauuu

SEQ ID NO: 2738 - RNA, 19 nt, Artificial Sequence
  Synthetic oligonucleotide
aguuguaucaaagcauuuu

SEQ ID NO: 2739 - RNA, 19 nt, Artificial Sequence
  Synthetic oligonucleotide
guuguaucaaagcauuuuu

SEQ ID NO: 2740 - RNA, 19 nt, Artificial Sequence
  Synthetic oligonucleotide
uuguaucaaagcauuuuuc

SEQ ID NO: 2741 - RNA, 19 nt, Artificial Sequence
  Synthetic oligonucleotide
uguaucaaagcauuuuuca

SEQ ID NO: 2742 - RNA, 19 nt, Artificial Sequence
  Synthetic oligonucleotide
caauaaccuaugacaaugg

SEQ ID NO: 2743 - RNA, 19 nt, Artificial Sequence
  Synthetic oligonucleotide
ccuaugacaauggauuucu

SEQ ID NO: 2744 - RNA, 19 nt, Artificial Sequence
  Synthetic oligonucleotide
ugacaauggauuucucuuc

SEQ ID NO: 2745 - RNA, 19 nt, Artificial Sequence
  Synthetic oligonucleotide
gacaauggauuucucuuca

SEQ ID NO: 2746 - RNA, 19 nt, Artificial Sequence
  Synthetic oligonucleotide
acaauggauuucucuucau

SEQ ID NO: 2747 - RNA, 19 nt, Artificial Sequence
  Synthetic oligonucleotide
aauggauuucucuucauuc

SEQ ID NO: 2748 - RNA, 19 nt, Artificial Sequence
  Synthetic oligonucleotide
auggauuucucuucauuca

SEQ ID NO: 2749 - RNA, 19 nt, Artificial Sequence
  Synthetic oligonucleotide
ggauuucucuucauucaua

SEQ ID NO: 2750 - RNA, 19 nt, Artificial Sequence
  Synthetic oligonucleotide
cauucauacagacaaaccu

SEQ ID NO: 2751 - RNA, 19 nt, Artificial Sequence
  Synthetic oligonucleotide
uucauacagacaaaccugu

SEQ ID NO: 2752 - RNA, 19 nt, Artificial Sequence
  Synthetic oligonucleotide
ucauacagacaaaccuguu

SEQ ID NO: 2753 - RNA, 19 nt, Artificial Sequence
  Synthetic oligonucleotide
cauacagacaaaccuguuu

SEQ ID NO: 2754 - RNA, 19 nt, Artificial Sequence
  Synthetic oligonucleotide
aguuagaguuuauucguug

SEQ ID NO: 2755 - RNA, 19 nt, Artificial Sequence
  Synthetic oligonucleotide
augacgacuugaagccagc

SEQ ID NO: 2756 - RNA, 19 nt, Artificial Sequence
  Synthetic oligonucleotide
ugacgacuugaagccagcc

SEQ ID NO: 2757 - RNA, 19 nt, Artificial Sequence
  Synthetic oligonucleotide
gacgacuugaagccagcca

SEQ ID NO: 2758 - RNA, 19 nt, Artificial Sequence
  Synthetic oligonucleotide
acgacuugaagccagccaa

SEQ ID NO: 2759 - RNA, 19 nt, Artificial Sequence
  Synthetic oligonucleotide
gagaaacugucuuaacuuu

SEQ ID NO: 2760 - RNA, 19 nt, Artificial Sequence
  Synthetic oligonucleotide
aacugucuuaacuuucaua

SEQ ID NO: 2761 - RNA, 19 nt, Artificial Sequence
  Synthetic oligonucleotide
acugucuuaacuuucauag

SEQ ID NO: 2762 - RNA, 19 nt, Artificial Sequence
  Synthetic oligonucleotide
ugaaggaucagaaguugac

SEQ ID NO: 2763 - RNA, 19 nt, Artificial Sequence
  Synthetic oligonucleotide
gaaggaucagaaguugaca

SEQ ID NO: 2764 - RNA, 19 nt, Artificial Sequence
  Synthetic oligonucleotide
ugacaugguagaagaaauu

SEQ ID NO: 2765 - RNA, 19 nt, Artificial Sequence
  Synthetic oligonucleotide
gacaugguagaagaaauug

SEQ ID NO: 2766 - RNA, 19 nt, Artificial Sequence
  Synthetic oligonucleotide
ugguagaagaaauugauca

SEQ ID NO: 2767 - RNA, 19 nt, Artificial Sequence
  Synthetic oligonucleotide
gguagaagaaauugaucau

SEQ ID NO: 2768 - RNA, 19 nt, Artificial Sequence
  Synthetic oligonucleotide
gaagaaauugaucauauug

SEQ ID NO: 2769 - RNA, 19 nt, Artificial Sequence
  Synthetic oligonucleotide
aagaaauugaucauauugg

SEQ ID NO: 2770 - RNA, 19 nt, Artificial Sequence
  Synthetic oligonucleotide
uggaauuaucucuuuuccu

SEQ ID NO: 2771 - RNA, 19 nt, Artificial Sequence
  Synthetic oligonucleotide
ggaauuaucucuuuuccug

SEQ ID NO: 2772 - RNA, 19 nt, Artificial Sequence
  Synthetic oligonucleotide
gaauuaucucuuuuccuga

SEQ ID NO: 2773 - RNA, 19 nt, Artificial Sequence
  Synthetic oligonucleotide
aauuaucucuuuuccugac

SEQ ID NO: 2774 - RNA, 19 nt, Artificial Sequence
  Synthetic oligonucleotide
auuaucucuuuuccugacu

SEQ ID NO: 2775 - RNA, 19 nt, Artificial Sequence
  Synthetic oligonucleotide
uuaucucuuuuccugacuu

SEQ ID NO: 2776 - RNA, 19 nt, Artificial Sequence
  Synthetic oligonucleotide
uaucucuuuuccugacuuc

SEQ ID NO: 2777 - RNA, 19 nt, Artificial Sequence
  Synthetic oligonucleotide
aucucuuuuccugacuuca

SEQ ID NO: 2778 - RNA, 19 nt, Artificial Sequence
  Synthetic oligonucleotide
ucucuuuuccugacuucaa

SEQ ID NO: 2779 - RNA, 19 nt, Artificial Sequence
  Synthetic oligonucleotide
cucuuuuccugacuucaag

SEQ ID NO: 2780 - RNA, 19 nt, Artificial Sequence
  Synthetic oligonucleotide
ucuuuuccugacuucaaga

SEQ ID NO: 2781 - RNA, 19 nt, Artificial Sequence
  Synthetic oligonucleotide
cuuuuccugacuucaagau

SEQ ID NO: 2782 - RNA, 19 nt, Artificial Sequence
  Synthetic oligonucleotide
uuuuccugacuucaagauu

SEQ ID NO: 2783 - RNA, 19 nt, Artificial Sequence
  Synthetic oligonucleotide
uuuccugacuucaagauuc

SEQ ID NO: 2784 - RNA, 19 nt, Artificial Sequence
  Synthetic oligonucleotide
guuaaagaauaugucuugc

SEQ ID NO: 2785 - RNA, 19 nt, Artificial Sequence
  Synthetic oligonucleotide
uuaaagaauaugucuugcc

SEQ ID NO: 2786 - RNA, 19 nt, Artificial Sequence
  Synthetic oligonucleotide
uaaagaauaugucuugcca

SEQ ID NO: 2787 - RNA, 19 nt, Artificial Sequence
  Synthetic oligonucleotide
caagaacuuuaagaauuuu

SEQ ID NO: 2788 - RNA, 19 nt, Artificial Sequence
  Synthetic oligonucleotide
aagaacuuuaagaauuuug

SEQ ID NO: 2789 - RNA, 19 nt, Artificial Sequence
  Synthetic oligonucleotide
acuuuaagaauuuugaaau

SEQ ID NO: 2790 - RNA, 19 nt, Artificial Sequence
  Synthetic oligonucleotide
agaauuuugaaauuacuau

SEQ ID NO: 2791 - RNA, 19 nt, Artificial Sequence
  Synthetic oligonucleotide
gaauuuugaaauuacuaua

SEQ ID NO: 2792 - RNA, 19 nt, Artificial Sequence
  Synthetic oligonucleotide
aauuuugaaauuacuauaa

SEQ ID NO: 2793 - RNA, 19 nt, Artificial Sequence
  Synthetic oligonucleotide
uuugaaauuacuauaaaag

SEQ ID NO: 2794 - RNA, 19 nt, Artificial Sequence
  Synthetic oligonucleotide
uugaaauuacuauaaaagc

SEQ ID NO: 2795 - RNA, 19 nt, Artificial Sequence
  Synthetic oligonucleotide
ugaaauuacuauaaaagca

SEQ ID NO: 2796 - RNA, 19 nt, Artificial Sequence
  Synthetic oligonucleotide
aaaagcaagauauuuuuau

SEQ ID NO: 2797 - RNA, 19 nt, Artificial Sequence
  Synthetic oligonucleotide
aaagcaagauauuuuuaua

SEQ ID NO: 2798 - RNA, 19 nt, Artificial Sequence
  Synthetic oligonucleotide
aagcaagauauuuuuauaa

SEQ ID NO: 2799 - RNA, 19 nt, Artificial Sequence
  Synthetic oligonucleotide
agcaagauauuuuuauaau

SEQ ID NO: 2800 - RNA, 19 nt, Artificial Sequence
  Synthetic oligonucleotide
gcaagauauuuuuauaaua

SEQ ID NO: 2801 - RNA, 19 nt, Artificial Sequence
  Synthetic oligonucleotide
caagauauuuuuauaauaa

SEQ ID NO: 2802 - RNA, 19 nt, Artificial Sequence
  Synthetic oligonucleotide
aagauauuuuuauaauaaa

SEQ ID NO: 2803 - RNA, 19 nt, Artificial Sequence
  Synthetic oligonucleotide
agauauuuuuauaauaaag

SEQ ID NO: 2804 - RNA, 19 nt, Artificial Sequence
  Synthetic oligonucleotide
acaauguugauaaauggaa

SEQ ID NO: 2805 - RNA, 19 nt, Artificial Sequence
  Synthetic oligonucleotide
caauguugauaaauggaau

SEQ ID NO: 2806 - RNA, 19 nt, Artificial Sequence
  Synthetic oligonucleotide
auguugauaaauggaauug

SEQ ID NO: 2807 - RNA, 19 nt, Artificial Sequence
  Synthetic oligonucleotide
uguugauaaauggaauugc

SEQ ID NO: 2808 - RNA, 19 nt, Artificial Sequence
  Synthetic oligonucleotide
guugauaaauggaauugcu

SEQ ID NO: 2809 - RNA, 19 nt, Artificial Sequence
  Synthetic oligonucleotide
gauaaauggaauugcucaa

SEQ ID NO: 2810 - RNA, 19 nt, Artificial Sequence
  Synthetic oligonucleotide
aauggaauugcucaaguca

SEQ ID NO: 2811 - RNA, 19 nt, Artificial Sequence
  Synthetic oligonucleotide
gcucaagucacauuugauu

SEQ ID NO: 2812 - RNA, 19 nt, Artificial Sequence
  Synthetic oligonucleotide
ucaagucacauuugauucu

SEQ ID NO: 2813 - RNA, 19 nt, Artificial Sequence
  Synthetic oligonucleotide
caagucacauuugauucug

SEQ ID NO: 2814 - RNA, 19 nt, Artificial Sequence
  Synthetic oligonucleotide
aagucacauuugauucuga

SEQ ID NO: 2815 - RNA, 19 nt, Artificial Sequence
  Synthetic oligonucleotide
acauuugauucugaaacag

SEQ ID NO: 2816 - RNA, 19 nt, Artificial Sequence
  Synthetic oligonucleotide
auuugauucugaaacagca

SEQ ID NO: 2817 - RNA, 19 nt, Artificial Sequence
  Synthetic oligonucleotide
uuugauucugaaacagcag

SEQ ID NO: 2818 - RNA, 19 nt, Artificial Sequence
  Synthetic oligonucleotide
acagcagucaaagaacugu

SEQ ID NO: 2819 - RNA, 19 nt, Artificial Sequence
  Synthetic oligonucleotide
agcagucaaagaacuguca

SEQ ID NO: 2820 - RNA, 19 nt, Artificial Sequence
  Synthetic oligonucleotide
agucaaagaacugucauac

SEQ ID NO: 2821 - RNA, 19 nt, Artificial Sequence
  Synthetic oligonucleotide
aaagaacugucauacuaca

SEQ ID NO: 2822 - RNA, 19 nt, Artificial Sequence
  Synthetic oligonucleotide
aagaacugucauacuacag

SEQ ID NO: 2823 - RNA, 19 nt, Artificial Sequence
  Synthetic oligonucleotide
gaacugucauacuacaguu

SEQ ID NO: 2824 - RNA, 19 nt, Artificial Sequence
  Synthetic oligonucleotide
uuuaaacaacaaguaccuu

SEQ ID NO: 2825 - RNA, 19 nt, Artificial Sequence
  Synthetic oligonucleotide
uuaaacaacaaguaccuuu

SEQ ID NO: 2826 - RNA, 19 nt, Artificial Sequence
  Synthetic oligonucleotide
uaaacaacaaguaccuuua

SEQ ID NO: 2827 - RNA, 19 nt, Artificial Sequence
  Synthetic oligonucleotide
aaacaacaaguaccuuuau

SEQ ID NO: 2828 - RNA, 19 nt, Artificial Sequence
  Synthetic oligonucleotide
aacaacaaguaccuuuaua

SEQ ID NO: 2829 - RNA, 19 nt, Artificial Sequence
  Synthetic oligonucleotide
acaacaaguaccuuuauau

SEQ ID NO: 2830 - RNA, 19 nt, Artificial Sequence
  Synthetic oligonucleotide
caacaaguaccuuuauauu

SEQ ID NO: 2831 - RNA, 19 nt, Artificial Sequence
  Synthetic oligonucleotide
aacaaguaccuuuauauug

SEQ ID NO: 2832 - RNA, 19 nt, Artificial Sequence
  Synthetic oligonucleotide
acaaguaccuuuauauugc

SEQ ID NO: 2833 - RNA, 19 nt, Artificial Sequence
  Synthetic oligonucleotide
caaguaccuuuauauugcu

SEQ ID NO: 2834 - RNA, 19 nt, Artificial Sequence
  Synthetic oligonucleotide
aaguaccuuuauauugcug

SEQ ID NO: 2835 - RNA, 19 nt, Artificial Sequence
  Synthetic oligonucleotide
aguaccuuuauauugcugu

SEQ ID NO: 2836 - RNA, 19 nt, Artificial Sequence
  Synthetic oligonucleotide
uaccuuuauauugcuguaa

SEQ ID NO: 2837 - RNA, 19 nt, Artificial Sequence
  Synthetic oligonucleotide
aucaaauauguccucucuc

SEQ ID NO: 2838 - RNA, 19 nt, Artificial Sequence
  Synthetic oligonucleotide
ucccuacaaacugaauuug

SEQ ID NO: 2839 - RNA, 19 nt, Artificial Sequence
  Synthetic oligonucleotide
uacaaacugaauuugguug

SEQ ID NO: 2840 - RNA, 19 nt, Artificial Sequence
  Synthetic oligonucleotide
acaaacugaauuugguugc

SEQ ID NO: 2841 - RNA, 19 nt, Artificial Sequence
  Synthetic oligonucleotide
acugaaugcacaaacaauu

SEQ ID NO: 2842 - RNA, 19 nt, Artificial Sequence
  Synthetic oligonucleotide
cugaaugcacaaacaauug

SEQ ID NO: 2843 - RNA, 19 nt, Artificial Sequence
  Synthetic oligonucleotide
ccaagagacaucugacuug

SEQ ID NO: 2844 - RNA, 19 nt, Artificial Sequence
  Synthetic oligonucleotide
caagagacaucugacuugg

SEQ ID NO: 2845 - RNA, 19 nt, Artificial Sequence
  Synthetic oligonucleotide
agguuaccgagcaauagca

SEQ ID NO: 2846 - RNA, 19 nt, Artificial Sequence
  Synthetic oligonucleotide
cucagccaaaguuaccuuu

SEQ ID NO: 2847 - RNA, 19 nt, Artificial Sequence
  Synthetic oligonucleotide
ucagccaaaguuaccuuua

SEQ ID NO: 2848 - RNA, 19 nt, Artificial Sequence
  Synthetic oligonucleotide
cagccaaaguuaccuuuau

SEQ ID NO: 2849 - RNA, 19 nt, Artificial Sequence
  Synthetic oligonucleotide
agccaaaguuaccuuuaua

SEQ ID NO: 2850 - RNA, 19 nt, Artificial Sequence
  Synthetic oligonucleotide
caaaagcccauauauugac

SEQ ID NO: 2851 - RNA, 19 nt, Artificial Sequence
  Synthetic oligonucleotide
agcccauauauugacaaaa

SEQ ID NO: 2852 - RNA, 19 nt, Artificial Sequence
  Synthetic oligonucleotide
gcccauauauugacaaaau

SEQ ID NO: 2853 - RNA, 19 nt, Artificial Sequence
  Synthetic oligonucleotide
ccauauauugacaaaauaa

SEQ ID NO: 2854 - RNA, 19 nt, Artificial Sequence
  Synthetic oligonucleotide
cauauauugacaaaauaac

SEQ ID NO: 2855 - RNA, 19 nt, Artificial Sequence
  Synthetic oligonucleotide
auauauugacaaaauaacu

SEQ ID NO: 2856 - RNA, 19 nt, Artificial Sequence
  Synthetic oligonucleotide
uauugacaaaauaacucac

SEQ ID NO: 2857 - RNA, 19 nt, Artificial Sequence
  Synthetic oligonucleotide
uugacaaaauaacucacua

SEQ ID NO: 2858 - RNA, 19 nt, Artificial Sequence
  Synthetic oligonucleotide
ugacaaaauaacucacuau

SEQ ID NO: 2859 - RNA, 19 nt, Artificial Sequence
  Synthetic oligonucleotide
gacaaaauaacucacuaua

SEQ ID NO: 2860 - RNA, 19 nt, Artificial Sequence
  Synthetic oligonucleotide
acaaaauaacucacuauaa

SEQ ID NO: 2861 - RNA, 19 nt, Artificial Sequence
  Synthetic oligonucleotide
caaaauaacucacuauaau

SEQ ID NO: 2862 - RNA, 19 nt, Artificial Sequence
  Synthetic oligonucleotide
aaaauaacucacuauaauu

SEQ ID NO: 2863 - RNA, 19 nt, Artificial Sequence
  Synthetic oligonucleotide
aaauaacucacuauaauua

SEQ ID NO: 2864 - RNA, 19 nt, Artificial Sequence
  Synthetic oligonucleotide
aauaacucacuauaauuac

SEQ ID NO: 2865 - RNA, 19 nt, Artificial Sequence
  Synthetic oligonucleotide
auaacucacuauaauuacu

SEQ ID NO: 2866 - RNA, 19 nt, Artificial Sequence
  Synthetic oligonucleotide
uaacucacuauaauuacuu

SEQ ID NO: 2867 - RNA, 19 nt, Artificial Sequence
  Synthetic oligonucleotide
aacucacuauaauuacuug

SEQ ID NO: 2868 - RNA, 19 nt, Artificial Sequence
  Synthetic oligonucleotide
acucacuauaauuacuuga

SEQ ID NO: 2869 - RNA, 19 nt, Artificial Sequence
  Synthetic oligonucleotide
cucacuauaauuacuugau

SEQ ID NO: 2870 - RNA, 19 nt, Artificial Sequence
  Synthetic oligonucleotide
ucacuauaauuacuugauu

SEQ ID NO: 2871 - RNA, 19 nt, Artificial Sequence
  Synthetic oligonucleotide
cacuauaauuacuugauuu

SEQ ID NO: 2872 - RNA, 19 nt, Artificial Sequence
  Synthetic oligonucleotide
acuauaauuacuugauuuu

SEQ ID NO: 2873 - RNA, 19 nt, Artificial Sequence
  Synthetic oligonucleotide
cuauaauuacuugauuuua

SEQ ID NO: 2874 - RNA, 19 nt, Artificial Sequence
  Synthetic oligonucleotide
uauaauuacuugauuuuau

SEQ ID NO: 2875 - RNA, 19 nt, Artificial Sequence
  Synthetic oligonucleotide
auaauuacuugauuuuauc

SEQ ID NO: 2876 - RNA, 19 nt, Artificial Sequence
  Synthetic oligonucleotide
uaauuacuugauuuuaucc

SEQ ID NO: 2877 - RNA, 19 nt, Artificial Sequence
  Synthetic oligonucleotide
aauuacuugauuuuaucca

SEQ ID NO: 2878 - RNA, 19 nt, Artificial Sequence
  Synthetic oligonucleotide
ugucugauucagucugguu

SEQ ID NO: 2879 - RNA, 19 nt, Artificial Sequence
  Synthetic oligonucleotide
ucugauucagucugguuaa

SEQ ID NO: 2880 - RNA, 19 nt, Artificial Sequence
  Synthetic oligonucleotide
cugauucagucugguuaaa

SEQ ID NO: 2881 - RNA, 19 nt, Artificial Sequence
  Synthetic oligonucleotide
ugauucagucugguuaaau

SEQ ID NO: 2882 - RNA, 19 nt, Artificial Sequence
  Synthetic oligonucleotide
gauucagucugguuaaaua

SEQ ID NO: 2883 - RNA, 19 nt, Artificial Sequence
  Synthetic oligonucleotide
uucagucugguuaaauauu

SEQ ID NO: 2884 - RNA, 19 nt, Artificial Sequence
  Synthetic oligonucleotide
ucagucugguuaaauauug

SEQ ID NO: 2885 - RNA, 19 nt, Artificial Sequence
  Synthetic oligonucleotide
cagucugguuaaauauuga

SEQ ID NO: 2886 - RNA, 19 nt, Artificial Sequence
  Synthetic oligonucleotide
agucugguuaaauauugaa

SEQ ID NO: 2887 - RNA, 19 nt, Artificial Sequence
  Synthetic oligonucleotide
gucugguuaaauauugaag

SEQ ID NO: 2888 - RNA, 19 nt, Artificial Sequence
  Synthetic oligonucleotide
ucugguuaaauauugaaga

SEQ ID NO: 2889 - RNA, 19 nt, Artificial Sequence
  Synthetic oligonucleotide
cugguuaaauauugaagaa

SEQ ID NO: 2890 - RNA, 19 nt, Artificial Sequence
  Synthetic oligonucleotide
ugguuaaauauugaagaaa

SEQ ID NO: 2891 - RNA, 19 nt, Artificial Sequence
  Synthetic oligonucleotide
auguggcaaccagcuccag

SEQ ID NO: 2892 - RNA, 19 nt, Artificial Sequence
  Synthetic oligonucleotide
uguggcaaccagcuccagg

SEQ ID NO: 2893 - RNA, 19 nt, Artificial Sequence
  Synthetic oligonucleotide
ucugggcuguggggcaggu

SEQ ID NO: 2894 - RNA, 19 nt, Artificial Sequence
  Synthetic oligonucleotide
cugggcuguggggcaggug

SEQ ID NO: 2895 - RNA, 19 nt, Artificial Sequence
  Synthetic oligonucleotide
ugggcuguggggcaggugg

SEQ ID NO: 2896 - RNA, 19 nt, Artificial Sequence
  Synthetic oligonucleotide
gggcuguggggcagguggu

SEQ ID NO: 2897 - RNA, 19 nt, Artificial Sequence
  Synthetic oligonucleotide
ggcuguggggcagguggug

SEQ ID NO: 2898 - RNA, 19 nt, Artificial Sequence
  Synthetic oligonucleotide
gcuguggggcagguggugg

SEQ ID NO: 2899 - RNA, 19 nt, Artificial Sequence
  Synthetic oligonucleotide
cuguggggcaggugguggc

SEQ ID NO: 2900 - RNA, 19 nt, Artificial Sequence
  Synthetic oligonucleotide
aagaaaaugaugaaccuug

SEQ ID NO: 2901 - RNA, 19 nt, Artificial Sequence
  Synthetic oligonucleotide
aaugaugaaccuuguaaag

SEQ ID NO: 2902 - RNA, 19 nt, Artificial Sequence
  Synthetic oligonucleotide
ugaugaaccuuguaaagaa

SEQ ID NO: 2903 - RNA, 19 nt, Artificial Sequence
  Synthetic oligonucleotide
gaugaaccuuguaaagaaa

SEQ ID NO: 2904 - RNA, 19 nt, Artificial Sequence
  Synthetic oligonucleotide
ccuuguaaagaaauucuca

SEQ ID NO: 2905 - RNA, 19 nt, Artificial Sequence
  Synthetic oligonucleotide
cuuguaaagaaauucucag

SEQ ID NO: 2906 - RNA, 19 nt, Artificial Sequence
  Synthetic oligonucleotide
caguagugaagaaauguug

SEQ ID NO: 2907 - RNA, 19 nt, Artificial Sequence
  Synthetic oligonucleotide
aguagugaagaaauguugu

SEQ ID NO: 2908 - RNA, 19 nt, Artificial Sequence
  Synthetic oligonucleotide
ugaagacccuguuaccagu

SEQ ID NO: 2909 - RNA, 19 nt, Artificial Sequence
  Synthetic oligonucleotide
gcaagccagaaauucggag

SEQ ID NO: 2910 - RNA, 19 nt, Artificial Sequence
  Synthetic oligonucleotide
gucaaggcaaagguguuca

SEQ ID NO: 2911 - RNA, 19 nt, Artificial Sequence
  Synthetic oligonucleotide
ucaaggcaaagguguucaa

SEQ ID NO: 2912 - RNA, 19 nt, Artificial Sequence
  Synthetic oligonucleotide
caaggcaaagguguucaaa

SEQ ID NO: 2913 - RNA, 19 nt, Artificial Sequence
  Synthetic oligonucleotide
aaggcaaagguguucaaag

SEQ ID NO: 2914 - RNA, 19 nt, Artificial Sequence
  Synthetic oligonucleotide
agaugucuuccuggaaaug

SEQ ID NO: 2915 - RNA, 19 nt, Artificial Sequence
  Synthetic oligonucleotide
ccuggaaaugaauauacca

SEQ ID NO: 2916 - RNA, 19 nt, Artificial Sequence
  Synthetic oligonucleotide
cuggaaaugaauauaccau

SEQ ID NO: 2917 - RNA, 19 nt, Artificial Sequence
  Synthetic oligonucleotide
uggaaaugaauauaccaua

SEQ ID NO: 2918 - RNA, 19 nt, Artificial Sequence
  Synthetic oligonucleotide
ggaaaugaauauaccauau

SEQ ID NO: 2919 - RNA, 19 nt, Artificial Sequence
  Synthetic oligonucleotide
gaaaugaauauaccauauu

SEQ ID NO: 2920 - RNA, 19 nt, Artificial Sequence
  Synthetic oligonucleotide
aaaugaauauaccauauuc

SEQ ID NO: 2921 - RNA, 19 nt, Artificial Sequence
  Synthetic oligonucleotide
aaugaauauaccauauucu

SEQ ID NO: 2922 - RNA, 19 nt, Artificial Sequence
  Synthetic oligonucleotide
augaauauaccauauucug

SEQ ID NO: 2923 - RNA, 19 nt, Artificial Sequence
  Synthetic oligonucleotide
ugaauauaccauauucugu

SEQ ID NO: 2924 - RNA, 19 nt, Artificial Sequence
  Synthetic oligonucleotide
gaauauaccauauucuguu

SEQ ID NO: 2925 - RNA, 19 nt, Artificial Sequence
  Synthetic oligonucleotide
aauauaccauauucuguug

SEQ ID NO: 2926 - RNA, 19 nt, Artificial Sequence
  Synthetic oligonucleotide
acgaggagaacagauccaa

SEQ ID NO: 2927 - RNA, 19 nt, Artificial Sequence
  Synthetic oligonucleotide
cgaggagaacagauccaau

SEQ ID NO: 2928 - RNA, 19 nt, Artificial Sequence
  Synthetic oligonucleotide
gaggagaacagauccaauu

SEQ ID NO: 2929 - RNA, 19 nt, Artificial Sequence
  Synthetic oligonucleotide
aggagaacagauccaauug

SEQ ID NO: 2930 - RNA, 19 nt, Artificial Sequence
  Synthetic oligonucleotide
ggagaacagauccaauuga

SEQ ID NO: 2931 - RNA, 19 nt, Artificial Sequence
  Synthetic oligonucleotide
gagaacagauccaauugaa

SEQ ID NO: 2932 - RNA, 19 nt, Artificial Sequence
  Synthetic oligonucleotide
agaacagauccaauugaaa

SEQ ID NO: 2933 - RNA, 19 nt, Artificial Sequence
  Synthetic oligonucleotide
gaacagauccaauugaaag

SEQ ID NO: 2934 - RNA, 19 nt, Artificial Sequence
  Synthetic oligonucleotide
aacagauccaauugaaagg

SEQ ID NO: 2935 - RNA, 19 nt, Artificial Sequence
  Synthetic oligonucleotide
acagauccaauugaaagga

SEQ ID NO: 2936 - RNA, 19 nt, Artificial Sequence
  Synthetic oligonucleotide
cagauccaauugaaaggaa

SEQ ID NO: 2937 - RNA, 19 nt, Artificial Sequence
  Synthetic oligonucleotide
agauccaauugaaaggaac

SEQ ID NO: 2938 - RNA, 19 nt, Artificial Sequence
  Synthetic oligonucleotide
gauccaauugaaaggaacu

SEQ ID NO: 2939 - RNA, 19 nt, Artificial Sequence
  Synthetic oligonucleotide
auccaauugaaaggaacug

SEQ ID NO: 2940 - RNA, 19 nt, Artificial Sequence
  Synthetic oligonucleotide
uccaauugaaaggaacugu

SEQ ID NO: 2941 - RNA, 19 nt, Artificial Sequence
  Synthetic oligonucleotide
ccaauugaaaggaacuguu

SEQ ID NO: 2942 - RNA, 19 nt, Artificial Sequence
  Synthetic oligonucleotide
caauugaaaggaacuguuu

SEQ ID NO: 2943 - RNA, 19 nt, Artificial Sequence
  Synthetic oligonucleotide
aauugaaaggaacuguuua

SEQ ID NO: 2944 - RNA, 19 nt, Artificial Sequence
  Synthetic oligonucleotide
auugaaaggaacuguuuac

SEQ ID NO: 2945 - RNA, 19 nt, Artificial Sequence
  Synthetic oligonucleotide
uugaaaggaacuguuuaca

SEQ ID NO: 2946 - RNA, 19 nt, Artificial Sequence
  Synthetic oligonucleotide
ugaaaggaacuguuuacaa

SEQ ID NO: 2947 - RNA, 19 nt, Artificial Sequence
  Synthetic oligonucleotide
gaaaggaacuguuuacaac

SEQ ID NO: 2948 - RNA, 19 nt, Artificial Sequence
  Synthetic oligonucleotide
aaaggaacuguuuacaacu

SEQ ID NO: 2949 - RNA, 19 nt, Artificial Sequence
  Synthetic oligonucleotide
aaggaacuguuuacaacua

SEQ ID NO: 2950 - RNA, 19 nt, Artificial Sequence
  Synthetic oligonucleotide
aggaacuguuuacaacuau

SEQ ID NO: 2951 - RNA, 19 nt, Artificial Sequence
  Synthetic oligonucleotide
uguuaaaaugucugcugug

SEQ ID NO: 2952 - RNA, 19 nt, Artificial Sequence
  Synthetic oligonucleotide
guuaaaaugucugcugugg

SEQ ID NO: 2953 - RNA, 19 nt, Artificial Sequence
  Synthetic oligonucleotide
uuaaaaugucugcugugga

SEQ ID NO: 2954 - RNA, 19 nt, Artificial Sequence
  Synthetic oligonucleotide
uaaaaugucugcuguggag

SEQ ID NO: 2955 - RNA, 19 nt, Artificial Sequence
  Synthetic oligonucleotide
aaaaugucugcuguggagg

SEQ ID NO: 2956 - RNA, 19 nt, Artificial Sequence
  Synthetic oligonucleotide
gugcuuccucuggaaauug

SEQ ID NO: 2957 - RNA, 19 nt, Artificial Sequence
  Synthetic oligonucleotide
ugcuuccucuggaaauugg

SEQ ID NO: 2958 - RNA, 19 nt, Artificial Sequence
  Synthetic oligonucleotide
gcuuccucuggaaauuggc

SEQ ID NO: 2959 - RNA, 19 nt, Artificial Sequence
  Synthetic oligonucleotide
cuuccucuggaaauuggcc

SEQ ID NO: 2960 - RNA, 19 nt, Artificial Sequence
  Synthetic oligonucleotide
uuccucuggaaauuggccu

SEQ ID NO: 2961 - RNA, 19 nt, Artificial Sequence
  Synthetic oligonucleotide
uccucuggaaauuggccuu

SEQ ID NO: 2962 - RNA, 19 nt, Artificial Sequence
  Synthetic oligonucleotide
ccucuggaaauuggccuuc

SEQ ID NO: 2963 - RNA, 19 nt, Artificial Sequence
  Synthetic oligonucleotide
cucuggaaauuggccuuca

SEQ ID NO: 2964 - RNA, 19 nt, Artificial Sequence
  Synthetic oligonucleotide
cagaaaucaaaaggauuuu

SEQ ID NO: 2965 - RNA, 19 nt, Artificial Sequence
  Synthetic oligonucleotide
agaaaucaaaaggauuuug

SEQ ID NO: 2966 - RNA, 19 nt, Artificial Sequence
  Synthetic oligonucleotide
ucaaaaggauuuugagugu

SEQ ID NO: 2967 - RNA, 19 nt, Artificial Sequence
  Synthetic oligonucleotide
uauccuaacccaccucccc

SEQ ID NO: 2968 - RNA, 19 nt, Artificial Sequence
  Synthetic oligonucleotide
auccuaacccaccucccca

SEQ ID NO: 2969 - RNA, 19 nt, Artificial Sequence
  Synthetic oligonucleotide
cccaguauucuauguuuuu

SEQ ID NO: 2970 - RNA, 19 nt, Artificial Sequence
  Synthetic oligonucleotide
caggaaaucauuggaacau

SEQ ID NO: 2971 - RNA, 19 nt, Artificial Sequence
  Synthetic oligonucleotide
aggaaaucauuggaacauu

SEQ ID NO: 2972 - RNA, 19 nt, Artificial Sequence
  Synthetic oligonucleotide
ugagcauuauguccuacag

SEQ ID NO: 2973 - RNA, 19 nt, Artificial Sequence
  Synthetic oligonucleotide
acuugguuaacagcuuuug

SEQ ID NO: 2974 - RNA, 19 nt, Artificial Sequence
  Synthetic oligonucleotide
ugguuaacagcuuuugcuu

SEQ ID NO: 2975 - RNA, 19 nt, Artificial Sequence
  Synthetic oligonucleotide
gguuaacagcuuuugcuuu

SEQ ID NO: 2976 - RNA, 19 nt, Artificial Sequence
  Synthetic oligonucleotide
ugcuuuaagaguacuugga

SEQ ID NO: 2977 - RNA, 19 nt, Artificial Sequence
  Synthetic oligonucleotide
gcuuuaagaguacuuggac

SEQ ID NO: 2978 - RNA, 19 nt, Artificial Sequence
  Synthetic oligonucleotide
uuaagaguacuuggacaag

SEQ ID NO: 2979 - RNA, 19 nt, Artificial Sequence
  Synthetic oligonucleotide
uaagaguacuuggacaagu

SEQ ID NO: 2980 - RNA, 19 nt, Artificial Sequence
  Synthetic oligonucleotide
guagagcagaaccaaaauu

SEQ ID NO: 2981 - RNA, 19 nt, Artificial Sequence
  Synthetic oligonucleotide
uagagcagaaccaaaauuc

SEQ ID NO: 2982 - RNA, 19 nt, Artificial Sequence
  Synthetic oligonucleotide
agagcagaaccaaaauuca

SEQ ID NO: 2983 - RNA, 19 nt, Artificial Sequence
  Synthetic oligonucleotide
gagcagaaccaaaauucaa

SEQ ID NO: 2984 - RNA, 19 nt, Artificial Sequence
  Synthetic oligonucleotide
ucacaguaucaaccaauaa

SEQ ID NO: 2985 - RNA, 19 nt, Artificial Sequence
  Synthetic oligonucleotide
aaccaauaaaauuacaggg

SEQ ID NO: 2986 - RNA, 19 nt, Artificial Sequence
  Synthetic oligonucleotide
accaauaaaauuacagggu

SEQ ID NO: 2987 - RNA, 19 nt, Artificial Sequence
  Synthetic oligonucleotide
ccaauaaaauuacagggua

SEQ ID NO: 2988 - RNA, 19 nt, Artificial Sequence
  Synthetic oligonucleotide
acugugauuggaauuagaa

SEQ ID NO: 2989 - RNA, 19 nt, Artificial Sequence
  Synthetic oligonucleotide
cugugauuggaauuagaaa

SEQ ID NO: 2990 - RNA, 19 nt, Artificial Sequence
  Synthetic oligonucleotide
ugugauuggaauuagaaag

SEQ ID NO: 2991 - RNA, 19 nt, Artificial Sequence
  Synthetic oligonucleotide
gugauuggaauuagaaagg

SEQ ID NO: 2992 - RNA, 19 nt, Artificial Sequence
  Synthetic oligonucleotide
guucaauuguuucagcuuu

SEQ ID NO: 2993 - RNA, 19 nt, Artificial Sequence
  Synthetic oligonucleotide
ugaagagagaagcuuuggu

SEQ ID NO: 2994 - RNA, 19 nt, Artificial Sequence
  Synthetic oligonucleotide
gaagagagaagcuuugguu

SEQ ID NO: 2995 - RNA, 19 nt, Artificial Sequence
  Synthetic oligonucleotide
aagagagaagcuuugguua

SEQ ID NO: 2996 - RNA, 19 nt, Artificial Sequence
  Synthetic oligonucleotide
gagaagcuuugguuaaagg

SEQ ID NO: 2997 - RNA, 19 nt, Artificial Sequence
  Synthetic oligonucleotide
agaagcuuugguuaaaggu

SEQ ID NO: 2998 - RNA, 19 nt, Artificial Sequence
  Synthetic oligonucleotide
cccauuuaucguuuuugga

SEQ ID NO: 2999 - RNA, 19 nt, Artificial Sequence
  Synthetic oligonucleotide
ugcuuuacucaccagucug

SEQ ID NO: 3000 - RNA, 19 nt, Artificial Sequence
  Synthetic oligonucleotide
gcuuuacucaccagucuga

SEQ ID NO: 3001 - RNA, 19 nt, Artificial Sequence
  Synthetic oligonucleotide
acucaccagucugaacuug

SEQ ID NO: 3002 - RNA, 19 nt, Artificial Sequence
  Synthetic oligonucleotide
accagucugaacuugaaag

SEQ ID NO: 3003 - RNA, 19 nt, Artificial Sequence
  Synthetic oligonucleotide
agaagagcagagguaugga

SEQ ID NO: 3004 - RNA, 19 nt, Artificial Sequence
  Synthetic oligonucleotide
gaagagcagagguauggag

SEQ ID NO: 3005 - RNA, 19 nt, Artificial Sequence
  Synthetic oligonucleotide
ggaauauucacuccugguu

SEQ ID NO: 3006 - RNA, 19 nt, Artificial Sequence
  Synthetic oligonucleotide
gccuuacauaauuauaaaa

SEQ ID NO: 3007 - RNA, 19 nt, Artificial Sequence
  Synthetic oligonucleotide
acauguaacaacuguaguu

SEQ ID NO: 3008 - RNA, 19 nt, Artificial Sequence
  Synthetic oligonucleotide
ugaggaaguuugcagcuuu

SEQ ID NO: 3009 - RNA, 19 nt, Artificial Sequence
  Synthetic oligonucleotide
gaggaaguuugcagcuuuu

SEQ ID NO: 3010 - RNA, 19 nt, Artificial Sequence
  Synthetic oligonucleotide
aggaaguuugcagcuuuua

SEQ ID NO: 3011 - RNA, 19 nt, Artificial Sequence
  Synthetic oligonucleotide
ggaaguuugcagcuuuuau

SEQ ID NO: 3012 - RNA, 19 nt, Artificial Sequence
  Synthetic oligonucleotide
gaaguuugcagcuuuuauu

SEQ ID NO: 3013 - RNA, 19 nt, Artificial Sequence
  Synthetic oligonucleotide
aaguuugcagcuuuuauuu

SEQ ID NO: 3014 - RNA, 19 nt, Artificial Sequence
  Synthetic oligonucleotide
aguuugcagcuuuuauuug

SEQ ID NO: 3015 - RNA, 19 nt, Artificial Sequence
  Synthetic oligonucleotide
guuugcagcuuuuauuuga

SEQ ID NO: 3016 - RNA, 19 nt, Artificial Sequence
  Synthetic oligonucleotide
ugcagcuuuuauuugaaaa

SEQ ID NO: 3017 - RNA, 19 nt, Artificial Sequence
  Synthetic oligonucleotide
gauacucaggauauugaag

SEQ ID NO: 3018 - RNA, 19 nt, Artificial Sequence
  Synthetic oligonucleotide
ucaggauauugaagcaucc

SEQ ID NO: 3019 - RNA, 19 nt, Artificial Sequence
  Synthetic oligonucleotide
guagcaugugccagcuaca

SEQ ID NO: 3020 - RNA, 19 nt, Artificial Sequence
  Synthetic oligonucleotide
uagcaugugccagcuacaa

SEQ ID NO: 3021 - RNA, 19 nt, Artificial Sequence
  Synthetic oligonucleotide
agcaugugccagcuacaag

SEQ ID NO: 3022 - RNA, 19 nt, Artificial Sequence
  Synthetic oligonucleotide
gcaugugccagcuacaagc

SEQ ID NO: 3023 - RNA, 19 nt, Artificial Sequence
  Synthetic oligonucleotide
caugugccagcuacaagcc

SEQ ID NO: 3024 - RNA, 19 nt, Artificial Sequence
  Synthetic oligonucleotide
augugccagcuacaagccc

SEQ ID NO: 3025 - RNA, 19 nt, Artificial Sequence
  Synthetic oligonucleotide
ugugccagcuacaagccca

SEQ ID NO: 3026 - RNA, 19 nt, Artificial Sequence
  Synthetic oligonucleotide
gugccagcuacaagcccag

SEQ ID NO: 3027 - RNA, 19 nt, Artificial Sequence
  Synthetic oligonucleotide
ugccagcuacaagcccagc

SEQ ID NO: 3028 - RNA, 19 nt, Artificial Sequence
  Synthetic oligonucleotide
agauggacauguuauucug

SEQ ID NO: 3029 - RNA, 19 nt, Artificial Sequence
  Synthetic oligonucleotide
gauggacauguuauucugc

SEQ ID NO: 3030 - RNA, 19 nt, Artificial Sequence
  Synthetic oligonucleotide
uggacauguuauucugcaa

SEQ ID NO: 3031 - RNA, 19 nt, Artificial Sequence
  Synthetic oligonucleotide
gacauguuauucugcaacu

SEQ ID NO: 3032 - RNA, 19 nt, Artificial Sequence
  Synthetic oligonucleotide
acauguuauucugcaacug

SEQ ID NO: 3033 - RNA, 19 nt, Artificial Sequence
  Synthetic oligonucleotide
cauguuauucugcaacuga

SEQ ID NO: 3034 - RNA, 19 nt, Artificial Sequence
  Synthetic oligonucleotide
uauucugcaacugaauucg

SEQ ID NO: 3035 - RNA, 19 nt, Artificial Sequence
  Synthetic oligonucleotide
auucugcaacugaauucga

SEQ ID NO: 3036 - RNA, 19 nt, Artificial Sequence
  Synthetic oligonucleotide
agauaaacaguguaccaug

SEQ ID NO: 3037 - RNA, 19 nt, Artificial Sequence
  Synthetic oligonucleotide
gauaaacaguguaccaugu

SEQ ID NO: 3038 - RNA, 19 nt, Artificial Sequence
  Synthetic oligonucleotide
uaaacaguguaccauguuu

SEQ ID NO: 3039 - RNA, 19 nt, Artificial Sequence
  Synthetic oligonucleotide
aacaguguaccauguuuua

SEQ ID NO: 3040 - RNA, 19 nt, Artificial Sequence
  Synthetic oligonucleotide
uauagcacuuccaauauca

SEQ ID NO: 3041 - RNA, 19 nt, Artificial Sequence
  Synthetic oligonucleotide
auucagaaagucugugaag

SEQ ID NO: 3042 - RNA, 19 nt, Artificial Sequence
  Synthetic oligonucleotide
uucagaaagucugugaagg

SEQ ID NO: 3043 - RNA, 19 nt, Artificial Sequence
  Synthetic oligonucleotide
ucagaaagucugugaagga

SEQ ID NO: 3044 - RNA, 19 nt, Artificial Sequence
  Synthetic oligonucleotide
cagaaagucugugaaggag

SEQ ID NO: 3045 - RNA, 19 nt, Artificial Sequence
  Synthetic oligonucleotide
accagagauugcauaugcu

SEQ ID NO: 3046 - RNA, 19 nt, Artificial Sequence
  Synthetic oligonucleotide
ccagagauugcauaugcuu

SEQ ID NO: 3047 - RNA, 19 nt, Artificial Sequence
  Synthetic oligonucleotide
cagagauugcauaugcuua

SEQ ID NO: 3048 - RNA, 19 nt, Artificial Sequence
  Synthetic oligonucleotide
agagauugcauaugcuuau

SEQ ID NO: 3049 - RNA, 19 nt, Artificial Sequence
  Synthetic oligonucleotide
gagauugcauaugcuuaua

SEQ ID NO: 3050 - RNA, 19 nt, Artificial Sequence
  Synthetic oligonucleotide
uagaaaauguuuuugucaa

SEQ ID NO: 3051 - RNA, 19 nt, Artificial Sequence
  Synthetic oligonucleotide
agaaaauguuuuugucaag

SEQ ID NO: 3052 - RNA, 19 nt, Artificial Sequence
  Synthetic oligonucleotide
gaaaauguuuuugucaagu

SEQ ID NO: 3053 - RNA, 19 nt, Artificial Sequence
  Synthetic oligonucleotide
aaaauguuuuugucaagua

SEQ ID NO: 3054 - RNA, 19 nt, Artificial Sequence
  Synthetic oligonucleotide
aaauguuuuugucaaguac

SEQ ID NO: 3055 - RNA, 19 nt, Artificial Sequence
  Synthetic oligonucleotide
uccagauaaaauacaauuu

SEQ ID NO: 3056 - RNA, 19 nt, Artificial Sequence
  Synthetic oligonucleotide
cauguucaucgugucaagc

SEQ ID NO: 3057 - RNA, 19 nt, Artificial Sequence
  Synthetic oligonucleotide
ucaucgugucaagcauuuu

SEQ ID NO: 3058 - RNA, 19 nt, Artificial Sequence
  Synthetic oligonucleotide
cgugucaagcauuuuuagc

SEQ ID NO: 3059 - RNA, 19 nt, Artificial Sequence
  Synthetic oligonucleotide
caagcauuuuuagcuaauu

SEQ ID NO: 3060 - RNA, 19 nt, Artificial Sequence
  Synthetic oligonucleotide
auggaugcuaaaauuccug

SEQ ID NO: 3061 - RNA, 19 nt, Artificial Sequence
  Synthetic oligonucleotide
uauggacuccuguuguuga

SEQ ID NO: 3062 - RNA, 19 nt, Artificial Sequence
  Synthetic oligonucleotide
uggacuccuguuguugaag

SEQ ID NO: 3063 - RNA, 19 nt, Artificial Sequence
  Synthetic oligonucleotide
ggacuccuguuguugaagu

SEQ ID NO: 3064 - RNA, 19 nt, Artificial Sequence
  Synthetic oligonucleotide
cuugcuuuuauuagagaau

SEQ ID NO: 3065 - RNA, 19 nt, Artificial Sequence
  Synthetic oligonucleotide
uugcuuuuauuagagaaug

SEQ ID NO: 3066 - RNA, 19 nt, Artificial Sequence
  Synthetic oligonucleotide
ugcuuuuauuagagaauga

SEQ ID NO: 3067 - RNA, 19 nt, Artificial Sequence
  Synthetic oligonucleotide
gcuuuuauuagagaaugau

SEQ ID NO: 3068 - RNA, 19 nt, Artificial Sequence
  Synthetic oligonucleotide
acagauacuccuccaaggu

SEQ ID NO: 3069 - RNA, 19 nt, Artificial Sequence
  Synthetic oligonucleotide
ucauuaaagccugaguuug

SEQ ID NO: 3070 - RNA, 19 nt, Artificial Sequence
  Synthetic oligonucleotide
cauuaaagccugaguuugc

SEQ ID NO: 3071 - RNA, 19 nt, Artificial Sequence
  Synthetic oligonucleotide
uaaagccugaguuugcuuu

SEQ ID NO: 3072 - RNA, 19 nt, Artificial Sequence
  Synthetic oligonucleotide
aaagccugaguuugcuuuc

SEQ ID NO: 3073 - RNA, 19 nt, Artificial Sequence
  Synthetic oligonucleotide
acauaugucauuucagcac

SEQ ID NO: 3074 - RNA, 19 nt, Artificial Sequence
  Synthetic oligonucleotide
auauugugauucaaguuua

SEQ ID NO: 3075 - RNA, 19 nt, Artificial Sequence
  Synthetic oligonucleotide
uauugugauucaaguuuau

SEQ ID NO: 3076 - RNA, 19 nt, Artificial Sequence
  Synthetic oligonucleotide
auugugauucaaguuuaug

SEQ ID NO: 3077 - RNA, 19 nt, Artificial Sequence
  Synthetic oligonucleotide
uugugauucaaguuuaugg

SEQ ID NO: 3078 - RNA, 19 nt, Artificial Sequence
  Synthetic oligonucleotide
ugugauucaaguuuaugga

SEQ ID NO: 3079 - RNA, 19 nt, Artificial Sequence
  Synthetic oligonucleotide
gugauucaaguuuauggau

SEQ ID NO: 3080 - RNA, 19 nt, Artificial Sequence
  Synthetic oligonucleotide
ugauucaaguuuauggaua

SEQ ID NO: 3081 - RNA, 19 nt, Artificial Sequence
  Synthetic oligonucleotide
gauucaaguuuauggauac

SEQ ID NO: 3082 - RNA, 19 nt, Artificial Sequence
  Synthetic oligonucleotide
auucaaguuuauggauaca

SEQ ID NO: 3083 - RNA, 19 nt, Artificial Sequence
  Synthetic oligonucleotide
uucaaguuuauggauacac

SEQ ID NO: 3084 - RNA, 19 nt, Artificial Sequence
  Synthetic oligonucleotide
ucaaguuuauggauacacu

SEQ ID NO: 3085 - RNA, 19 nt, Artificial Sequence
  Synthetic oligonucleotide
caaguuuauggauacacug

SEQ ID NO: 3086 - RNA, 19 nt, Artificial Sequence
  Synthetic oligonucleotide
aguuuauggauacacugaa

SEQ ID NO: 3087 - RNA, 19 nt, Artificial Sequence
  Synthetic oligonucleotide
guuuauggauacacugaag

SEQ ID NO: 3088 - RNA, 19 nt, Artificial Sequence
  Synthetic oligonucleotide
uuauggauacacugaagca

SEQ ID NO: 3089 - RNA, 19 nt, Artificial Sequence
  Synthetic oligonucleotide
auggauacacugaagcauu

SEQ ID NO: 3090 - RNA, 19 nt, Artificial Sequence
  Synthetic oligonucleotide
uggauacacugaagcauuu

SEQ ID NO: 3091 - RNA, 19 nt, Artificial Sequence
  Synthetic oligonucleotide
ggauacacugaagcauuug

SEQ ID NO: 3092 - RNA, 19 nt, Artificial Sequence
  Synthetic oligonucleotide
gauacacugaagcauuuga

SEQ ID NO: 3093 - RNA, 19 nt, Artificial Sequence
  Synthetic oligonucleotide
auacacugaagcauuugau

SEQ ID NO: 3094 - RNA, 19 nt, Artificial Sequence
  Synthetic oligonucleotide
uacacugaagcauuugaug

SEQ ID NO: 3095 - RNA, 19 nt, Artificial Sequence
  Synthetic oligonucleotide
acacugaagcauuugaugc

SEQ ID NO: 3096 - RNA, 19 nt, Artificial Sequence
  Synthetic oligonucleotide
cacugaagcauuugaugca

SEQ ID NO: 3097 - RNA, 19 nt, Artificial Sequence
  Synthetic oligonucleotide
cugaagcauuugaugcaac

SEQ ID NO: 3098 - RNA, 19 nt, Artificial Sequence
  Synthetic oligonucleotide
gaagcauuugaugcaacaa

SEQ ID NO: 3099 - RNA, 19 nt, Artificial Sequence
  Synthetic oligonucleotide
agcauuugaugcaacaauc

SEQ ID NO: 3100 - RNA, 19 nt, Artificial Sequence
  Synthetic oligonucleotide
uuugaugcaacaaucucua

SEQ ID NO: 3101 - RNA, 19 nt, Artificial Sequence
  Synthetic oligonucleotide
uugaugcaacaaucucuau

SEQ ID NO: 3102 - RNA, 19 nt, Artificial Sequence
  Synthetic oligonucleotide
ugaugcaacaaucucuauu

SEQ ID NO: 3103 - RNA, 19 nt, Artificial Sequence
  Synthetic oligonucleotide
gaugcaacaaucucuauua

SEQ ID NO: 3104 - RNA, 19 nt, Artificial Sequence
  Synthetic oligonucleotide
caacaaucucuauuaaaag

SEQ ID NO: 3105 - RNA, 19 nt, Artificial Sequence
  Synthetic oligonucleotide
aacaaucucuauuaaaagu

SEQ ID NO: 3106 - RNA, 19 nt, Artificial Sequence
  Synthetic oligonucleotide
cucuauuaaaaguuauccu

SEQ ID NO: 3107 - RNA, 19 nt, Artificial Sequence
  Synthetic oligonucleotide
cuauuaaaaguuauccuga

SEQ ID NO: 3108 - RNA, 19 nt, Artificial Sequence
  Synthetic oligonucleotide
uuaaaaguuauccugauaa

SEQ ID NO: 3109 - RNA, 19 nt, Artificial Sequence
  Synthetic oligonucleotide
uaaaaguuauccugauaaa

SEQ ID NO: 3110 - RNA, 19 nt, Artificial Sequence
  Synthetic oligonucleotide
aaguuauccugauaaaaaa

SEQ ID NO: 3111 - RNA, 19 nt, Artificial Sequence
  Synthetic oligonucleotide
aguuauccugauaaaaaau

SEQ ID NO: 3112 - RNA, 19 nt, Artificial Sequence
  Synthetic oligonucleotide
auguucauuuauccucaga

SEQ ID NO: 3113 - RNA, 19 nt, Artificial Sequence
  Synthetic oligonucleotide
uguucauuuauccucagag

SEQ ID NO: 3114 - RNA, 19 nt, Artificial Sequence
  Synthetic oligonucleotide
guguauuuggaaguuguau

SEQ ID NO: 3115 - RNA, 19 nt, Artificial Sequence
  Synthetic oligonucleotide
uguauuuggaaguuguauc

SEQ ID NO: 3116 - RNA, 19 nt, Artificial Sequence
  Synthetic oligonucleotide
auuuggaaguuguaucaaa

SEQ ID NO: 3117 - RNA, 19 nt, Artificial Sequence
  Synthetic oligonucleotide
uuuggaaguuguaucaaag

SEQ ID NO: 3118 - RNA, 19 nt, Artificial Sequence
  Synthetic oligonucleotide
uuggaaguuguaucaaagc

SEQ ID NO: 3119 - RNA, 19 nt, Artificial Sequence
  Synthetic oligonucleotide
uggaaguuguaucaaagca

SEQ ID NO: 3120 - RNA, 19 nt, Artificial Sequence
  Synthetic oligonucleotide
ggaaguuguaucaaagcau

SEQ ID NO: 3121 - RNA, 19 nt, Artificial Sequence
  Synthetic oligonucleotide
gaaguuguaucaaagcauu

SEQ ID NO: 3122 - RNA, 19 nt, Artificial Sequence
  Synthetic oligonucleotide
aaguuguaucaaagcauuu

SEQ ID NO: 3123 - RNA, 19 nt, Artificial Sequence
  Synthetic oligonucleotide
aguuguaucaaagcauuuu

SEQ ID NO: 3124 - RNA, 19 nt, Artificial Sequence
  Synthetic oligonucleotide
guuguaucaaagcauuuuu

SEQ ID NO: 3125 - RNA, 19 nt, Artificial Sequence
  Synthetic oligonucleotide
uuguaucaaagcauuuuuc

SEQ ID NO: 3126 - RNA, 19 nt, Artificial Sequence
  Synthetic oligonucleotide
ccaauaaccuaugacaaug

SEQ ID NO: 3127 - RNA, 19 nt, Artificial Sequence
  Synthetic oligonucleotide
accuaugacaauggauuuc

SEQ ID NO: 3128 - RNA, 19 nt, Artificial Sequence
  Synthetic oligonucleotide
augacaauggauuucucuu

SEQ ID NO: 3129 - RNA, 19 nt, Artificial Sequence
  Synthetic oligonucleotide
ugacaauggauuucucuuc

SEQ ID NO: 3130 - RNA, 19 nt, Artificial Sequence
  Synthetic oligonucleotide
gacaauggauuucucuuca

SEQ ID NO: 3131 - RNA, 19 nt, Artificial Sequence
  Synthetic oligonucleotide
caauggauuucucuucauu

SEQ ID NO: 3132 - RNA, 19 nt, Artificial Sequence
  Synthetic oligonucleotide
aauggauuucucuucauuc

SEQ ID NO: 3133 - RNA, 19 nt, Artificial Sequence
  Synthetic oligonucleotide
uggauuucucuucauucau

SEQ ID NO: 3134 - RNA, 19 nt, Artificial Sequence
  Synthetic oligonucleotide
ucauucauacagacaaacc

SEQ ID NO: 3135 - RNA, 19 nt, Artificial Sequence
  Synthetic oligonucleotide
auucauacagacaaaccug

SEQ ID NO: 3136 - RNA, 19 nt, Artificial Sequence
  Synthetic oligonucleotide
uucauacagacaaaccugu

SEQ ID NO: 3137 - RNA, 19 nt, Artificial Sequence
  Synthetic oligonucleotide
ucauacagacaaaccuguu

SEQ ID NO: 3138 - RNA, 19 nt, Artificial Sequence
  Synthetic oligonucleotide
aaguuagaguuuauucguu

SEQ ID NO: 3139 - RNA, 19 nt, Artificial Sequence
  Synthetic oligonucleotide
aaugacgacuugaagccag

SEQ ID NO: 3140 - RNA, 19 nt, Artificial Sequence
  Synthetic oligonucleotide
augacgacuugaagccagc

SEQ ID NO: 3141 - RNA, 19 nt, Artificial Sequence
  Synthetic oligonucleotide
ugacgacuugaagccagcc

SEQ ID NO: 3142 - RNA, 19 nt, Artificial Sequence
  Synthetic oligonucleotide
gacgacuugaagccagcca

SEQ ID NO: 3143 - RNA, 19 nt, Artificial Sequence
  Synthetic oligonucleotide
agagaaacugucuuaacuu

SEQ ID NO: 3144 - RNA, 19 nt, Artificial Sequence
  Synthetic oligonucleotide
aaacugucuuaacuuucau

SEQ ID NO: 3145 - RNA, 19 nt, Artificial Sequence
  Synthetic oligonucleotide
aacugucuuaacuuucaua

SEQ ID NO: 3146 - RNA, 19 nt, Artificial Sequence
  Synthetic oligonucleotide
cugaaggaucagaaguuga

SEQ ID NO: 3147 - RNA, 19 nt, Artificial Sequence
  Synthetic oligonucleotide
ugaaggaucagaaguugac

SEQ ID NO: 3148 - RNA, 19 nt, Artificial Sequence
  Synthetic oligonucleotide
uugacaugguagaagaaau

SEQ ID NO: 3149 - RNA, 19 nt, Artificial Sequence
  Synthetic oligonucleotide
ugacaugguagaagaaauu

SEQ ID NO: 3150 - RNA, 19 nt, Artificial Sequence
  Synthetic oligonucleotide
augguagaagaaauugauc

SEQ ID NO: 3151 - RNA, 19 nt, Artificial Sequence
  Synthetic oligonucleotide
ugguagaagaaauugauca

SEQ ID NO: 3152 - RNA, 19 nt, Artificial Sequence
  Synthetic oligonucleotide
agaagaaauugaucauauu

SEQ ID NO: 3153 - RNA, 19 nt, Artificial Sequence
  Synthetic oligonucleotide
gaagaaauugaucauauug

SEQ ID NO: 3154 - RNA, 19 nt, Artificial Sequence
  Synthetic oligonucleotide
uuggaauuaucucuuuucc

SEQ ID NO: 3155 - RNA, 19 nt, Artificial Sequence
  Synthetic oligonucleotide
uggaauuaucucuuuuccu

SEQ ID NO: 3156 - RNA, 19 nt, Artificial Sequence
  Synthetic oligonucleotide
ggaauuaucucuuuuccug

SEQ ID NO: 3157 - RNA, 19 nt, Artificial Sequence
  Synthetic oligonucleotide
gaauuaucucuuuuccuga

SEQ ID NO: 3158 - RNA, 19 nt, Artificial Sequence
  Synthetic oligonucleotide
aauuaucucuuuuccugac

SEQ ID NO: 3159 - RNA, 19 nt, Artificial Sequence
  Synthetic oligonucleotide
auuaucucuuuuccugacu

SEQ ID NO: 3160 - RNA, 19 nt, Artificial Sequence
  Synthetic oligonucleotide
uuaucucuuuuccugacuu

SEQ ID NO: 3161 - RNA, 19 nt, Artificial Sequence
  Synthetic oligonucleotide
uaucucuuuuccugacuuc

SEQ ID NO: 3162 - RNA, 19 nt, Artificial Sequence
  Synthetic oligonucleotide
aucucuuuuccugacuuca

SEQ ID NO: 3163 - RNA, 19 nt, Artificial Sequence
  Synthetic oligonucleotide
ucucuuuuccugacuucaa

SEQ ID NO: 3164 - RNA, 19 nt, Artificial Sequence
  Synthetic oligonucleotide
cucuuuuccugacuucaag

SEQ ID NO: 3165 - RNA, 19 nt, Artificial Sequence
  Synthetic oligonucleotide
ucuuuuccugacuucaaga

SEQ ID NO: 3166 - RNA, 19 nt, Artificial Sequence
  Synthetic oligonucleotide
cuuuuccugacuucaagau

SEQ ID NO: 3167 - RNA, 19 nt, Artificial Sequence
  Synthetic oligonucleotide
uuuuccugacuucaagauu

SEQ ID NO: 3168 - RNA, 19 nt, Artificial Sequence
  Synthetic oligonucleotide
aguuaaagaauaugucuug

SEQ ID NO: 3169 - RNA, 19 nt, Artificial Sequence
  Synthetic oligonucleotide
guuaaagaauaugucuugc

SEQ ID NO: 3170 - RNA, 19 nt, Artificial Sequence
  Synthetic oligonucleotide
uuaaagaauaugucuugcc

SEQ ID NO: 3171 - RNA, 19 nt, Artificial Sequence
  Synthetic oligonucleotide
acaagaacuuuaagaauuu

SEQ ID NO: 3172 - RNA, 19 nt, Artificial Sequence
  Synthetic oligonucleotide
caagaacuuuaagaauuuu

SEQ ID NO: 3173 - RNA, 19 nt, Artificial Sequence
  Synthetic oligonucleotide
aacuuuaagaauuuugaaa

SEQ ID NO: 3174 - RNA, 19 nt, Artificial Sequence
  Synthetic oligonucleotide
aagaauuuugaaauuacua

SEQ ID NO: 3175 - RNA, 19 nt, Artificial Sequence
  Synthetic oligonucleotide
agaauuuugaaauuacuau

SEQ ID NO: 3176 - RNA, 19 nt, Artificial Sequence
  Synthetic oligonucleotide
gaauuuugaaauuacuaua

SEQ ID NO: 3177 - RNA, 19 nt, Artificial Sequence
  Synthetic oligonucleotide
uuuugaaauuacuauaaaa

SEQ ID NO: 3178 - RNA, 19 nt, Artificial Sequence
  Synthetic oligonucleotide
uuugaaauuacuauaaaag

SEQ ID NO: 3179 - RNA, 19 nt, Artificial Sequence
  Synthetic oligonucleotide
uugaaauuacuauaaaagc

SEQ ID NO: 3180 - RNA, 19 nt, Artificial Sequence
  Synthetic oligonucleotide
uaaaagcaagauauuuuua

SEQ ID NO: 3181 - RNA, 19 nt, Artificial Sequence
  Synthetic oligonucleotide
aaaagcaagauauuuuuau

SEQ ID NO: 3182 - RNA, 19 nt, Artificial Sequence
  Synthetic oligonucleotide
aaagcaagauauuuuuaua

SEQ ID NO: 3183 - RNA, 19 nt, Artificial Sequence
  Synthetic oligonucleotide
aagcaagauauuuuuauaa

SEQ ID NO: 3184 - RNA, 19 nt, Artificial Sequence
  Synthetic oligonucleotide
agcaagauauuuuuauaau

SEQ ID NO: 3185 - RNA, 19 nt, Artificial Sequence
  Synthetic oligonucleotide
gcaagauauuuuuauaaua

SEQ ID NO: 3186 - RNA, 19 nt, Artificial Sequence
  Synthetic oligonucleotide
caagauauuuuuauaauaa

SEQ ID NO: 3187 - RNA, 19 nt, Artificial Sequence
  Synthetic oligonucleotide
aagauauuuuuauaauaaa

SEQ ID NO: 3188 - RNA, 19 nt, Artificial Sequence
  Synthetic oligonucleotide
cacaauguugauaaaugga

SEQ ID NO: 3189 - RNA, 19 nt, Artificial Sequence
  Synthetic oligonucleotide
acaauguugauaaauggaa

SEQ ID NO: 3190 - RNA, 19 nt, Artificial Sequence
  Synthetic oligonucleotide
aauguugauaaauggaauu

SEQ ID NO: 3191 - RNA, 19 nt, Artificial Sequence
  Synthetic oligonucleotide
auguugauaaauggaauug

SEQ ID NO: 3192 - RNA, 19 nt, Artificial Sequence
  Synthetic oligonucleotide
uguugauaaauggaauugc

SEQ ID NO: 3193 - RNA, 19 nt, Artificial Sequence
  Synthetic oligonucleotide
ugauaaauggaauugcuca

SEQ ID NO: 3194 - RNA, 19 nt, Artificial Sequence
  Synthetic oligonucleotide
aaauggaauugcucaaguc

SEQ ID NO: 3195 - RNA, 19 nt, Artificial Sequence
  Synthetic oligonucleotide
ugcucaagucacauuugau

SEQ ID NO: 3196 - RNA, 19 nt, Artificial Sequence
  Synthetic oligonucleotide
cucaagucacauuugauuc

SEQ ID NO: 3197 - RNA, 19 nt, Artificial Sequence
  Synthetic oligonucleotide
ucaagucacauuugauucu

SEQ ID NO: 3198 - RNA, 19 nt, Artificial Sequence
  Synthetic oligonucleotide
caagucacauuugauucug

SEQ ID NO: 3199 - RNA, 19 nt, Artificial Sequence
  Synthetic oligonucleotide
cacauuugauucugaaaca

SEQ ID NO: 3200 - RNA, 19 nt, Artificial Sequence
  Synthetic oligonucleotide
cauuugauucugaaacagc

SEQ ID NO: 3201 - RNA, 19 nt, Artificial Sequence
  Synthetic oligonucleotide
auuugauucugaaacagca

SEQ ID NO: 3202 - RNA, 19 nt, Artificial Sequence
  Synthetic oligonucleotide
aacagcagucaaagaacug

SEQ ID NO: 3203 - RNA, 19 nt, Artificial Sequence
  Synthetic oligonucleotide
cagcagucaaagaacuguc

SEQ ID NO: 3204 - RNA, 19 nt, Artificial Sequence
  Synthetic oligonucleotide
cagucaaagaacugucaua

SEQ ID NO: 3205 - RNA, 19 nt, Artificial Sequence
  Synthetic oligonucleotide
caaagaacugucauacuac

SEQ ID NO: 3206 - RNA, 19 nt, Artificial Sequence
  Synthetic oligonucleotide
aaagaacugucauacuaca

SEQ ID NO: 3207 - RNA, 19 nt, Artificial Sequence
  Synthetic oligonucleotide
agaacugucauacuacagu

SEQ ID NO: 3208 - RNA, 19 nt, Artificial Sequence
  Synthetic oligonucleotide
auuuaaacaacaaguaccu

SEQ ID NO: 3209 - RNA, 19 nt, Artificial Sequence
  Synthetic oligonucleotide
uuuaaacaacaaguaccuu

SEQ ID NO: 3210 - RNA, 19 nt, Artificial Sequence
  Synthetic oligonucleotide
uuaaacaacaaguaccuuu

SEQ ID NO: 3211 - RNA, 19 nt, Artificial Sequence
  Synthetic oligonucleotide
uaaacaacaaguaccuuua

SEQ ID NO: 3212 - RNA, 19 nt, Artificial Sequence
  Synthetic oligonucleotide
aaacaacaaguaccuuuau

SEQ ID NO: 3213 - RNA, 19 nt, Artificial Sequence
  Synthetic oligonucleotide
aacaacaaguaccuuuaua

SEQ ID NO: 3214 - RNA, 19 nt, Artificial Sequence
  Synthetic oligonucleotide
acaacaaguaccuuuauau

SEQ ID NO: 3215 - RNA, 19 nt, Artificial Sequence
  Synthetic oligonucleotide
caacaaguaccuuuauauu

SEQ ID NO: 3216 - RNA, 19 nt, Artificial Sequence
  Synthetic oligonucleotide
aacaaguaccuuuauauug

SEQ ID NO: 3217 - RNA, 19 nt, Artificial Sequence
  Synthetic oligonucleotide
acaaguaccuuuauauugc

SEQ ID NO: 3218 - RNA, 19 nt, Artificial Sequence
  Synthetic oligonucleotide
caaguaccuuuauauugcu

SEQ ID NO: 3219 - RNA, 19 nt, Artificial Sequence
  Synthetic oligonucleotide
aaguaccuuuauauugcug

SEQ ID NO: 3220 - RNA, 19 nt, Artificial Sequence
  Synthetic oligonucleotide
guaccuuuauauugcugua

SEQ ID NO: 3221 - RNA, 19 nt, Artificial Sequence
  Synthetic oligonucleotide
caucaaauauguccucucu

SEQ ID NO: 3222 - RNA, 19 nt, Artificial Sequence
  Synthetic oligonucleotide
cucccuacaaacugaauuu

SEQ ID NO: 3223 - RNA, 19 nt, Artificial Sequence
  Synthetic oligonucleotide
cuacaaacugaauuugguu

SEQ ID NO: 3224 - RNA, 19 nt, Artificial Sequence
  Synthetic oligonucleotide
uacaaacugaauuugguug

SEQ ID NO: 3225 - RNA, 19 nt, Artificial Sequence
  Synthetic oligonucleotide
cacugaaugcacaaacaau

SEQ ID NO: 3226 - RNA, 19 nt, Artificial Sequence
  Synthetic oligonucleotide
acugaaugcacaaacaauu

SEQ ID NO: 3227 - RNA, 19 nt, Artificial Sequence
  Synthetic oligonucleotide
accaagagacaucugacuu

SEQ ID NO: 3228 - RNA, 19 nt, Artificial Sequence
  Synthetic oligonucleotide
ccaagagacaucugacuug

SEQ ID NO: 3229 - RNA, 19 nt, Artificial Sequence
  Synthetic oligonucleotide
aagguuaccgagcaauagc

SEQ ID NO: 3230 - RNA, 19 nt, Artificial Sequence
  Synthetic oligonucleotide
ucucagccaaaguuaccuu

SEQ ID NO: 3231 - RNA, 19 nt, Artificial Sequence
  Synthetic oligonucleotide
cucagccaaaguuaccuuu

SEQ ID NO: 3232 - RNA, 19 nt, Artificial Sequence
  Synthetic oligonucleotide
ucagccaaaguuaccuuua

SEQ ID NO: 3233 - RNA, 19 nt, Artificial Sequence
  Synthetic oligonucleotide
cagccaaaguuaccuuuau

SEQ ID NO: 3234 - RNA, 19 nt, Artificial Sequence
  Synthetic oligonucleotide
ccaaaagcccauauauuga

SEQ ID NO: 3235 - RNA, 19 nt, Artificial Sequence
  Synthetic oligonucleotide
aagcccauauauugacaaa

SEQ ID NO: 3236 - RNA, 19 nt, Artificial Sequence
  Synthetic oligonucleotide
agcccauauauugacaaaa

SEQ ID NO: 3237 - RNA, 19 nt, Artificial Sequence
  Synthetic oligonucleotide
cccauauauugacaaaaua

SEQ ID NO: 3238 - RNA, 19 nt, Artificial Sequence
  Synthetic oligonucleotide
ccauauauugacaaaauaa

SEQ ID NO: 3239 - RNA, 19 nt, Artificial Sequence
  Synthetic oligonucleotide
cauauauugacaaaauaac

SEQ ID NO: 3240 - RNA, 19 nt, Artificial Sequence
  Synthetic oligonucleotide
auauugacaaaauaacuca

SEQ ID NO: 3241 - RNA, 19 nt, Artificial Sequence
  Synthetic oligonucleotide
auugacaaaauaacucacu

SEQ ID NO: 3242 - RNA, 19 nt, Artificial Sequence
  Synthetic oligonucleotide
uugacaaaauaacucacua

SEQ ID NO: 3243 - RNA, 19 nt, Artificial Sequence
  Synthetic oligonucleotide
ugacaaaauaacucacuau

SEQ ID NO: 3244 - RNA, 19 nt, Artificial Sequence
  Synthetic oligonucleotide
gacaaaauaacucacuaua

SEQ ID NO: 3245 - RNA, 19 nt, Artificial Sequence
  Synthetic oligonucleotide
acaaaauaacucacuauaa

SEQ ID NO: 3246 - RNA, 19 nt, Artificial Sequence
  Synthetic oligonucleotide
caaaauaacucacuauaau

SEQ ID NO: 3247 - RNA, 19 nt, Artificial Sequence
  Synthetic oligonucleotide
aaaauaacucacuauaauu

SEQ ID NO: 3248 - RNA, 19 nt, Artificial Sequence
  Synthetic oligonucleotide
aaauaacucacuauaauua

SEQ ID NO: 3249 - RNA, 19 nt, Artificial Sequence
  Synthetic oligonucleotide
aauaacucacuauaauuac

SEQ ID NO: 3250 - RNA, 19 nt, Artificial Sequence
  Synthetic oligonucleotide
auaacucacuauaauuacu

SEQ ID NO: 3251 - RNA, 19 nt, Artificial Sequence
  Synthetic oligonucleotide
uaacucacuauaauuacuu

SEQ ID NO: 3252 - RNA, 19 nt, Artificial Sequence
  Synthetic oligonucleotide
aacucacuauaauuacuug

SEQ ID NO: 3253 - RNA, 19 nt, Artificial Sequence
  Synthetic oligonucleotide
acucacuauaauuacuuga

SEQ ID NO: 3254 - RNA, 19 nt, Artificial Sequence
  Synthetic oligonucleotide
cucacuauaauuacuugau

SEQ ID NO: 3255 - RNA, 19 nt, Artificial Sequence
  Synthetic oligonucleotide
ucacuauaauuacuugauu

SEQ ID NO: 3256 - RNA, 19 nt, Artificial Sequence
  Synthetic oligonucleotide
cacuauaauuacuugauuu

SEQ ID NO: 3257 - RNA, 19 nt, Artificial Sequence
  Synthetic oligonucleotide
acuauaauuacuugauuuu

SEQ ID NO: 3258 - RNA, 19 nt, Artificial Sequence
  Synthetic oligonucleotide
cuauaauuacuugauuuua

SEQ ID NO: 3259 - RNA, 19 nt, Artificial Sequence
  Synthetic oligonucleotide
uauaauuacuugauuuuau

SEQ ID NO: 3260 - RNA, 19 nt, Artificial Sequence
  Synthetic oligonucleotide
auaauuacuugauuuuauc

SEQ ID NO: 3261 - RNA, 19 nt, Artificial Sequence
  Synthetic oligonucleotide
uaauuacuugauuuuaucc

SEQ ID NO: 3262 - RNA, 19 nt, Artificial Sequence
  Synthetic oligonucleotide
gugucugauucagucuggu

SEQ ID NO: 3263 - RNA, 19 nt, Artificial Sequence
  Synthetic oligonucleotide
gucugauucagucugguua

SEQ ID NO: 3264 - RNA, 19 nt, Artificial Sequence
  Synthetic oligonucleotide
ucugauucagucugguuaa

SEQ ID NO: 3265 - RNA, 19 nt, Artificial Sequence
  Synthetic oligonucleotide
cugauucagucugguuaaa

SEQ ID NO: 3266 - RNA, 19 nt, Artificial Sequence
  Synthetic oligonucleotide
ugauucagucugguuaaau

SEQ ID NO: 3267 - RNA, 19 nt, Artificial Sequence
  Synthetic oligonucleotide
auucagucugguuaaauau

SEQ ID NO: 3268 - RNA, 19 nt, Artificial Sequence
  Synthetic oligonucleotide
uucagucugguuaaauauu

SEQ ID NO: 3269 - RNA, 19 nt, Artificial Sequence
  Synthetic oligonucleotide
ucagucugguuaaauauug

SEQ ID NO: 3270 - RNA, 19 nt, Artificial Sequence
  Synthetic oligonucleotide
cagucugguuaaauauuga

SEQ ID NO: 3271 - RNA, 19 nt, Artificial Sequence
  Synthetic oligonucleotide
agucugguuaaauauugaa

SEQ ID NO: 3272 - RNA, 19 nt, Artificial Sequence
  Synthetic oligonucleotide
gucugguuaaauauugaag

SEQ ID NO: 3273 - RNA, 19 nt, Artificial Sequence
  Synthetic oligonucleotide
ucugguuaaauauugaaga

SEQ ID NO: 3274 - RNA, 19 nt, Artificial Sequence
  Synthetic oligonucleotide
cugguuaaauauugaagaa

SEQ ID NO: 3275 - RNA, 19 nt, Artificial Sequence
  Synthetic oligonucleotide
aauguggcaaccagcucca

SEQ ID NO: 3276 - RNA, 19 nt, Artificial Sequence
  Synthetic oligonucleotide
auguggcaaccagcuccag

SEQ ID NO: 3277 - RNA, 19 nt, Artificial Sequence
  Synthetic oligonucleotide
aucugggcuguggggcagg

SEQ ID NO: 3278 - RNA, 19 nt, Artificial Sequence
  Synthetic oligonucleotide
ucugggcuguggggcaggu

SEQ ID NO: 3279 - RNA, 19 nt, Artificial Sequence
  Synthetic oligonucleotide
cugggcuguggggcaggug

SEQ ID NO: 3280 - RNA, 19 nt, Artificial Sequence
  Synthetic oligonucleotide
ugggcuguggggcaggugg

SEQ ID NO: 3281 - RNA, 19 nt, Artificial Sequence
  Synthetic oligonucleotide
gggcuguggggcagguggu

SEQ ID NO: 3282 - RNA, 19 nt, Artificial Sequence
  Synthetic oligonucleotide
ggcuguggggcagguggug

SEQ ID NO: 3283 - RNA, 19 nt, Artificial Sequence
  Synthetic oligonucleotide
gcuguggggcagguggugg

SEQ ID NO: 3284 - RNA, 19 nt, Artificial Sequence
  Synthetic oligonucleotide
caagaaaaugaugaaccuu

SEQ ID NO: 3285 - RNA, 19 nt, Artificial Sequence
  Synthetic oligonucleotide
aaaugaugaaccuuguaaa

SEQ ID NO: 3286 - RNA, 19 nt, Artificial Sequence
  Synthetic oligonucleotide
augaugaaccuuguaaaga

SEQ ID NO: 3287 - RNA, 19 nt, Artificial Sequence
  Synthetic oligonucleotide
ugaugaaccuuguaaagaa

SEQ ID NO: 3288 - RNA, 19 nt, Artificial Sequence
  Synthetic oligonucleotide
accuuguaaagaaauucuc

SEQ ID NO: 3289 - RNA, 19 nt, Artificial Sequence
  Synthetic oligonucleotide
ccuuguaaagaaauucuca

SEQ ID NO: 3290 - RNA, 19 nt, Artificial Sequence
  Synthetic oligonucleotide
ucaguagugaagaaauguu

SEQ ID NO: 3291 - RNA, 19 nt, Artificial Sequence
  Synthetic oligonucleotide
caguagugaagaaauguug

SEQ ID NO: 3292 - RNA, 19 nt, Artificial Sequence
  Synthetic oligonucleotide
augaagacccuguuaccag

SEQ ID NO: 3293 - RNA, 19 nt, Artificial Sequence
  Synthetic oligonucleotide
agcaagccagaaauucgga

SEQ ID NO: 3294 - RNA, 19 nt, Artificial Sequence
  Synthetic oligonucleotide
ugucaaggcaaagguguuc

SEQ ID NO: 3295 - RNA, 19 nt, Artificial Sequence
  Synthetic oligonucleotide
gucaaggcaaagguguuca

SEQ ID NO: 3296 - RNA, 19 nt, Artificial Sequence
  Synthetic oligonucleotide
ucaaggcaaagguguucaa

SEQ ID NO: 3297 - RNA, 19 nt, Artificial Sequence
  Synthetic oligonucleotide
caaggcaaagguguucaaa

SEQ ID NO: 3298 - RNA, 19 nt, Artificial Sequence
  Synthetic oligonucleotide
aagaugucuuccuggaaau

SEQ ID NO: 3299 - RNA, 19 nt, Artificial Sequence
  Synthetic oligonucleotide
uccuggaaaugaauauacc

SEQ ID NO: 3300 - RNA, 19 nt, Artificial Sequence
  Synthetic oligonucleotide
ccuggaaaugaauauacca

SEQ ID NO: 3301 - RNA, 19 nt, Artificial Sequence
  Synthetic oligonucleotide
cuggaaaugaauauaccau

SEQ ID NO: 3302 - RNA, 19 nt, Artificial Sequence
  Synthetic oligonucleotide
uggaaaugaauauaccaua

SEQ ID NO: 3303 - RNA, 19 nt, Artificial Sequence
  Synthetic oligonucleotide
ggaaaugaauauaccauau

SEQ ID NO: 3304 - RNA, 19 nt, Artificial Sequence
  Synthetic oligonucleotide
gaaaugaauauaccauauu

SEQ ID NO: 3305 - RNA, 19 nt, Artificial Sequence
  Synthetic oligonucleotide
aaaugaauauaccauauuc

SEQ ID NO: 3306 - RNA, 19 nt, Artificial Sequence
  Synthetic oligonucleotide
aaugaauauaccauauucu

SEQ ID NO: 3307 - RNA, 19 nt, Artificial Sequence
  Synthetic oligonucleotide
augaauauaccauauucug

SEQ ID NO: 3308 - RNA, 19 nt, Artificial Sequence
  Synthetic oligonucleotide
ugaauauaccauauucugu

SEQ ID NO: 3309 - RNA, 19 nt, Artificial Sequence
  Synthetic oligonucleotide
gaauauaccauauucuguu

SEQ ID NO: 3310 - RNA, 19 nt, Artificial Sequence
  Synthetic oligonucleotide
uacgaggagaacagaucca

SEQ ID NO: 3311 - RNA, 19 nt, Artificial Sequence
  Synthetic oligonucleotide
acgaggagaacagauccaa

SEQ ID NO: 3312 - RNA, 19 nt, Artificial Sequence
  Synthetic oligonucleotide
cgaggagaacagauccaau

SEQ ID NO: 3313 - RNA, 19 nt, Artificial Sequence
  Synthetic oligonucleotide
gaggagaacagauccaauu

SEQ ID NO: 3314 - RNA, 19 nt, Artificial Sequence
  Synthetic oligonucleotide
aggagaacagauccaauug

SEQ ID NO: 3315 - RNA, 19 nt, Artificial Sequence
  Synthetic oligonucleotide
ggagaacagauccaauuga

SEQ ID NO: 3316 - RNA, 19 nt, Artificial Sequence
  Synthetic oligonucleotide
gagaacagauccaauugaa

SEQ ID NO: 3317 - RNA, 19 nt, Artificial Sequence
  Synthetic oligonucleotide
agaacagauccaauugaaa

SEQ ID NO: 3318 - RNA, 19 nt, Artificial Sequence
  Synthetic oligonucleotide
gaacagauccaauugaaag

SEQ ID NO: 3319 - RNA, 19 nt, Artificial Sequence
  Synthetic oligonucleotide
aacagauccaauugaaagg

SEQ ID NO: 3320 - RNA, 19 nt, Artificial Sequence
  Synthetic oligonucleotide
acagauccaauugaaagga

SEQ ID NO: 3321 - RNA, 19 nt, Artificial Sequence
  Synthetic oligonucleotide
cagauccaauugaaaggaa

SEQ ID NO: 3322 - RNA, 19 nt, Artificial Sequence
  Synthetic oligonucleotide
agauccaauugaaaggaac

SEQ ID NO: 3323 - RNA, 19 nt, Artificial Sequence
  Synthetic oligonucleotide
gauccaauugaaaggaacu

SEQ ID NO: 3324 - RNA, 19 nt, Artificial Sequence
  Synthetic oligonucleotide
auccaauugaaaggaacug

SEQ ID NO: 3325 - RNA, 19 nt, Artificial Sequence
  Synthetic oligonucleotide
uccaauugaaaggaacugu

SEQ ID NO: 3326 - RNA, 19 nt, Artificial Sequence
  Synthetic oligonucleotide
ccaauugaaaggaacuguu

SEQ ID NO: 3327 - RNA, 19 nt, Artificial Sequence
  Synthetic oligonucleotide
caauugaaaggaacuguuu

SEQ ID NO: 3328 - RNA, 19 nt, Artificial Sequence
  Synthetic oligonucleotide
aauugaaaggaacuguuua

SEQ ID NO: 3329 - RNA, 19 nt, Artificial Sequence
  Synthetic oligonucleotide
auugaaaggaacuguuuac

SEQ ID NO: 3330 - RNA, 19 nt, Artificial Sequence
  Synthetic oligonucleotide
uugaaaggaacuguuuaca

SEQ ID NO: 3331 - RNA, 19 nt, Artificial Sequence
  Synthetic oligonucleotide
ugaaaggaacuguuuacaa

SEQ ID NO: 3332 - RNA, 19 nt, Artificial Sequence
  Synthetic oligonucleotide
gaaaggaacuguuuacaac

SEQ ID NO: 3333 - RNA, 19 nt, Artificial Sequence
  Synthetic oligonucleotide
aaaggaacuguuuacaacu

SEQ ID NO: 3334 - RNA, 19 nt, Artificial Sequence
  Synthetic oligonucleotide
aaggaacuguuuacaacua

SEQ ID NO: 3335 - RNA, 19 nt, Artificial Sequence
  Synthetic oligonucleotide
guguuaaaaugucugcugu

SEQ ID NO: 3336 - RNA, 19 nt, Artificial Sequence
  Synthetic oligonucleotide
uguuaaaaugucugcugug

SEQ ID NO: 3337 - RNA, 19 nt, Artificial Sequence
  Synthetic oligonucleotide
guuaaaaugucugcugugg

SEQ ID NO: 3338 - RNA, 19 nt, Artificial Sequence
  Synthetic oligonucleotide
uuaaaaugucugcugugga

SEQ ID NO: 3339 - RNA, 19 nt, Artificial Sequence
  Synthetic oligonucleotide
uaaaaugucugcuguggag

SEQ ID NO: 3340 - RNA, 19 nt, Artificial Sequence
  Synthetic oligonucleotide
ugugcuuccucuggaaauu

SEQ ID NO: 3341 - RNA, 19 nt, Artificial Sequence
  Synthetic oligonucleotide
gugcuuccucuggaaauug

SEQ ID NO: 3342 - RNA, 19 nt, Artificial Sequence
  Synthetic oligonucleotide
ugcuuccucuggaaauugg

SEQ ID NO: 3343 - RNA, 19 nt, Artificial Sequence
  Synthetic oligonucleotide
gcuuccucuggaaauuggc

SEQ ID NO: 3344 - RNA, 19 nt, Artificial Sequence
  Synthetic oligonucleotide
cuuccucuggaaauuggcc

SEQ ID NO: 3345 - RNA, 19 nt, Artificial Sequence
  Synthetic oligonucleotide
uuccucuggaaauuggccu

SEQ ID NO: 3346 - RNA, 19 nt, Artificial Sequence
  Synthetic oligonucleotide
uccucuggaaauuggccuu

SEQ ID NO: 3347 - RNA, 19 nt, Artificial Sequence
  Synthetic oligonucleotide
ccucuggaaauuggccuuc

SEQ ID NO: 3348 - RNA, 19 nt, Artificial Sequence
  Synthetic oligonucleotide
acagaaaucaaaaggauuu

SEQ ID NO: 3349 - RNA, 19 nt, Artificial Sequence
  Synthetic oligonucleotide
cagaaaucaaaaggauuuu

SEQ ID NO: 3350 - RNA, 19 nt, Artificial Sequence
  Synthetic oligonucleotide
aucaaaaggauuuugagug

SEQ ID NO: 3351 - RNA, 19 nt, Artificial Sequence
  Synthetic oligonucleotide
auauccuaacccaccuccc

SEQ ID NO: 3352 - RNA, 19 nt, Artificial Sequence
  Synthetic oligonucleotide
uauccuaacccaccucccc

SEQ ID NO: 3353 - RNA, 19 nt, Artificial Sequence
  Synthetic oligonucleotide
ucccaguauucuauguuuu

SEQ ID NO: 3354 - RNA, 19 nt, Artificial Sequence
  Synthetic oligonucleotide
acaggaaaucauuggaaca

SEQ ID NO: 3355 - RNA, 19 nt, Artificial Sequence
  Synthetic oligonucleotide
caggaaaucauuggaacau

SEQ ID NO: 3356 - RNA, 19 nt, Artificial Sequence
  Synthetic oligonucleotide
uugagcauuauguccuaca

SEQ ID NO: 3357 - RNA, 19 nt, Artificial Sequence
  Synthetic oligonucleotide
cacuugguuaacagcuuuu

SEQ ID NO: 3358 - RNA, 19 nt, Artificial Sequence
  Synthetic oligonucleotide
uugguuaacagcuuuugcu

SEQ ID NO: 3359 - RNA, 19 nt, Artificial Sequence
  Synthetic oligonucleotide
ugguuaacagcuuuugcuu

SEQ ID NO: 3360 - RNA, 19 nt, Artificial Sequence
  Synthetic oligonucleotide
uugcuuuaagaguacuugg

SEQ ID NO: 3361 - RNA, 19 nt, Artificial Sequence
  Synthetic oligonucleotide
ugcuuuaagaguacuugga

SEQ ID NO: 3362 - RNA, 19 nt, Artificial Sequence
  Synthetic oligonucleotide
uuuaagaguacuuggacaa

SEQ ID NO: 3363 - RNA, 19 nt, Artificial Sequence
  Synthetic oligonucleotide
uuaagaguacuuggacaag

SEQ ID NO: 3364 - RNA, 19 nt, Artificial Sequence
  Synthetic oligonucleotide
cguagagcagaaccaaaau

SEQ ID NO: 3365 - RNA, 19 nt, Artificial Sequence
  Synthetic oligonucleotide
guagagcagaaccaaaauu

SEQ ID NO: 3366 - RNA, 19 nt, Artificial Sequence
  Synthetic oligonucleotide
uagagcagaaccaaaauuc

SEQ ID NO: 3367 - RNA, 19 nt, Artificial Sequence
  Synthetic oligonucleotide
agagcagaaccaaaauuca

SEQ ID NO: 3368 - RNA, 19 nt, Artificial Sequence
  Synthetic oligonucleotide
uucacaguaucaaccaaua

SEQ ID NO: 3369 - RNA, 19 nt, Artificial Sequence
  Synthetic oligonucleotide
caaccaauaaaauuacagg

SEQ ID NO: 3370 - RNA, 19 nt, Artificial Sequence
  Synthetic oligonucleotide
aaccaauaaaauuacaggg

SEQ ID NO: 3371 - RNA, 19 nt, Artificial Sequence
  Synthetic oligonucleotide
accaauaaaauuacagggu

SEQ ID NO: 3372 - RNA, 19 nt, Artificial Sequence
  Synthetic oligonucleotide
uacugugauuggaauuaga

SEQ ID NO: 3373 - RNA, 19 nt, Artificial Sequence
  Synthetic oligonucleotide
acugugauuggaauuagaa

SEQ ID NO: 3374 - RNA, 19 nt, Artificial Sequence
  Synthetic oligonucleotide
cugugauuggaauuagaaa

SEQ ID NO: 3375 - RNA, 19 nt, Artificial Sequence
  Synthetic oligonucleotide
ugugauuggaauuagaaag

SEQ ID NO: 3376 - RNA, 19 nt, Artificial Sequence
  Synthetic oligonucleotide
cguucaauuguuucagcuu

SEQ ID NO: 3377 - RNA, 19 nt, Artificial Sequence
  Synthetic oligonucleotide
uugaagagagaagcuuugg

SEQ ID NO: 3378 - RNA, 19 nt, Artificial Sequence
  Synthetic oligonucleotide
ugaagagagaagcuuuggu

SEQ ID NO: 3379 - RNA, 19 nt, Artificial Sequence
  Synthetic oligonucleotide
gaagagagaagcuuugguu

SEQ ID NO: 3380 - RNA, 19 nt, Artificial Sequence
  Synthetic oligonucleotide
agagaagcuuugguuaaag

SEQ ID NO: 3381 - RNA, 19 nt, Artificial Sequence
  Synthetic oligonucleotide
gagaagcuuugguuaaagg

SEQ ID NO: 3382 - RNA, 19 nt, Artificial Sequence
  Synthetic oligonucleotide
acccauuuaucguuuuugg

SEQ ID NO: 3383 - RNA, 19 nt, Artificial Sequence
  Synthetic oligonucleotide
augcuuuacucaccagucu

SEQ ID NO: 3384 - RNA, 19 nt, Artificial Sequence
  Synthetic oligonucleotide
ugcuuuacucaccagucug

SEQ ID NO: 3385 - RNA, 19 nt, Artificial Sequence
  Synthetic oligonucleotide
uacucaccagucugaacuu

SEQ ID NO: 3386 - RNA, 19 nt, Artificial Sequence
  Synthetic oligonucleotide
caccagucugaacuugaaa

SEQ ID NO: 3387 - RNA, 19 nt, Artificial Sequence
  Synthetic oligonucleotide
cagaagagcagagguaugg

SEQ ID NO: 3388 - RNA, 19 nt, Artificial Sequence
  Synthetic oligonucleotide
agaagagcagagguaugga

SEQ ID NO: 3389 - RNA, 19 nt, Artificial Sequence
  Synthetic oligonucleotide
cggaauauucacuccuggu

SEQ ID NO: 3390 - RNA, 19 nt, Artificial Sequence
  Synthetic oligonucleotide
ugccuuacauaauuauaaa

SEQ ID NO: 3391 - RNA, 19 nt, Artificial Sequence
  Synthetic oligonucleotide
uacauguaacaacuguagu

SEQ ID NO: 3392 - RNA, 19 nt, Artificial Sequence
  Synthetic oligonucleotide
cugaggaaguuugcagcuu

SEQ ID NO: 3393 - RNA, 19 nt, Artificial Sequence
  Synthetic oligonucleotide
ugaggaaguuugcagcuuu

SEQ ID NO: 3394 - RNA, 19 nt, Artificial Sequence
  Synthetic oligonucleotide
gaggaaguuugcagcuuuu

SEQ ID NO: 3395 - RNA, 19 nt, Artificial Sequence
  Synthetic oligonucleotide
aggaaguuugcagcuuuua

SEQ ID NO: 3396 - RNA, 19 nt, Artificial Sequence
  Synthetic oligonucleotide
ggaaguuugcagcuuuuau

SEQ ID NO: 3397 - RNA, 19 nt, Artificial Sequence
  Synthetic oligonucleotide
gaaguuugcagcuuuuauu

SEQ ID NO: 3398 - RNA, 19 nt, Artificial Sequence
  Synthetic oligonucleotide
aaguuugcagcuuuuauuu

SEQ ID NO: 3399 - RNA, 19 nt, Artificial Sequence
  Synthetic oligonucleotide
aguuugcagcuuuuauuug

SEQ ID NO: 3400 - RNA, 19 nt, Artificial Sequence
  Synthetic oligonucleotide
uugcagcuuuuauuugaaa

SEQ ID NO: 3401 - RNA, 19 nt, Artificial Sequence
  Synthetic oligonucleotide
cgauacucaggauauugaa

SEQ ID NO: 3402 - RNA, 19 nt, Artificial Sequence
  Synthetic oligonucleotide
cucaggauauugaagcauc

SEQ ID NO: 3403 - RNA, 19 nt, Artificial Sequence
  Synthetic oligonucleotide
aguagcaugugccagcuac

SEQ ID NO: 3404 - RNA, 19 nt, Artificial Sequence
  Synthetic oligonucleotide
guagcaugugccagcuaca

SEQ ID NO: 3405 - RNA, 19 nt, Artificial Sequence
  Synthetic oligonucleotide
uagcaugugccagcuacaa

SEQ ID NO: 3406 - RNA, 19 nt, Artificial Sequence
  Synthetic oligonucleotide
agcaugugccagcuacaag

SEQ ID NO: 3407 - RNA, 19 nt, Artificial Sequence
  Synthetic oligonucleotide
gcaugugccagcuacaagc

SEQ ID NO: 3408 - RNA, 19 nt, Artificial Sequence
  Synthetic oligonucleotide
caugugccagcuacaagcc

SEQ ID NO: 3409 - RNA, 19 nt, Artificial Sequence
  Synthetic oligonucleotide
augugccagcuacaagccc

SEQ ID NO: 3410 - RNA, 19 nt, Artificial Sequence
  Synthetic oligonucleotide
ugugccagcuacaagccca

SEQ ID NO: 3411 - RNA, 19 nt, Artificial Sequence
  Synthetic oligonucleotide
gugccagcuacaagcccag

SEQ ID NO: 3412 - RNA, 19 nt, Artificial Sequence
  Synthetic oligonucleotide
aagauggacauguuauucu

SEQ ID NO: 3413 - RNA, 19 nt, Artificial Sequence
  Synthetic oligonucleotide
agauggacauguuauucug

SEQ ID NO: 3414 - RNA, 19 nt, Artificial Sequence
  Synthetic oligonucleotide
auggacauguuauucugca

SEQ ID NO: 3415 - RNA, 19 nt, Artificial Sequence
  Synthetic oligonucleotide
ggacauguuauucugcaac

SEQ ID NO: 3416 - RNA, 19 nt, Artificial Sequence
  Synthetic oligonucleotide
gacauguuauucugcaacu

SEQ ID NO: 3417 - RNA, 19 nt, Artificial Sequence
  Synthetic oligonucleotide
acauguuauucugcaacug

SEQ ID NO: 3418 - RNA, 19 nt, Artificial Sequence
  Synthetic oligonucleotide
uuauucugcaacugaauuc

SEQ ID NO: 3419 - RNA, 19 nt, Artificial Sequence
  Synthetic oligonucleotide
uauucugcaacugaauucg

SEQ ID NO: 3420 - RNA, 19 nt, Artificial Sequence
  Synthetic oligonucleotide
cagauaaacaguguaccau

SEQ ID NO: 3421 - RNA, 19 nt, Artificial Sequence
  Synthetic oligonucleotide
agauaaacaguguaccaug

SEQ ID NO: 3422 - RNA, 19 nt, Artificial Sequence
  Synthetic oligonucleotide
auaaacaguguaccauguu

SEQ ID NO: 3423 - RNA, 19 nt, Artificial Sequence
  Synthetic oligonucleotide
aaacaguguaccauguuuu

SEQ ID NO: 3424 - RNA, 19 nt, Artificial Sequence
  Synthetic oligonucleotide
uuauagcacuuccaauauc

SEQ ID NO: 3425 - RNA, 19 nt, Artificial Sequence
  Synthetic oligonucleotide
aauucagaaagucugugaa

SEQ ID NO: 3426 - RNA, 19 nt, Artificial Sequence
  Synthetic oligonucleotide
auucagaaagucugugaag

SEQ ID NO: 3427 - RNA, 19 nt, Artificial Sequence
  Synthetic oligonucleotide
uucagaaagucugugaagg

SEQ ID NO: 3428 - RNA, 19 nt, Artificial Sequence
  Synthetic oligonucleotide
ucagaaagucugugaagga

SEQ ID NO: 3429 - RNA, 19 nt, Artificial Sequence
  Synthetic oligonucleotide
aaccagagauugcauaugc

SEQ ID NO: 3430 - RNA, 19 nt, Artificial Sequence
  Synthetic oligonucleotide
accagagauugcauaugcu

SEQ ID NO: 3431 - RNA, 19 nt, Artificial Sequence
  Synthetic oligonucleotide
ccagagauugcauaugcuu

SEQ ID NO: 3432 - RNA, 19 nt, Artificial Sequence
  Synthetic oligonucleotide
cagagauugcauaugcuua

SEQ ID NO: 3433 - RNA, 19 nt, Artificial Sequence
  Synthetic oligonucleotide
agagauugcauaugcuuau

SEQ ID NO: 3434 - RNA, 19 nt, Artificial Sequence
  Synthetic oligonucleotide
guagaaaauguuuuuguca

SEQ ID NO: 3435 - RNA, 19 nt, Artificial Sequence
  Synthetic oligonucleotide
uagaaaauguuuuugucaa

SEQ ID NO: 3436 - RNA, 19 nt, Artificial Sequence
  Synthetic oligonucleotide
agaaaauguuuuugucaag

SEQ ID NO: 3437 - RNA, 19 nt, Artificial Sequence
  Synthetic oligonucleotide
gaaaauguuuuugucaagu

SEQ ID NO: 3438 - RNA, 19 nt, Artificial Sequence
  Synthetic oligonucleotide
aaaauguuuuugucaagua

SEQ ID NO: 3439 - RNA, 19 nt, Artificial Sequence
  Synthetic oligonucleotide
cuccagauaaaauacaauu

SEQ ID NO: 3440 - RNA, 19 nt, Artificial Sequence
  Synthetic oligonucleotide
acauguucaucgugucaag

SEQ ID NO: 3441 - RNA, 19 nt, Artificial Sequence
  Synthetic oligonucleotide
uucaucgugucaagcauuu

SEQ ID NO: 3442 - RNA, 19 nt, Artificial Sequence
  Synthetic oligonucleotide
ucgugucaagcauuuuuag

SEQ ID NO: 3443 - RNA, 19 nt, Artificial Sequence
  Synthetic oligonucleotide
ucaagcauuuuuagcuaau

SEQ ID NO: 3444 - RNA, 19 nt, Artificial Sequence
  Synthetic oligonucleotide
aauggaugcuaaaauuccu

SEQ ID NO: 3445 - RNA, 19 nt, Artificial Sequence
  Synthetic oligonucleotide
uuauggacuccuguuguug

SEQ ID NO: 3446 - RNA, 19 nt, Artificial Sequence
  Synthetic oligonucleotide
auggacuccuguuguugaa

SEQ ID NO: 3447 - RNA, 19 nt, Artificial Sequence
  Synthetic oligonucleotide
uggacuccuguuguugaag

SEQ ID NO: 3448 - RNA, 19 nt, Artificial Sequence
  Synthetic oligonucleotide
acuugcuuuuauuagagaa

SEQ ID NO: 3449 - RNA, 19 nt, Artificial Sequence
  Synthetic oligonucleotide
cuugcuuuuauuagagaau

SEQ ID NO: 3450 - RNA, 19 nt, Artificial Sequence
  Synthetic oligonucleotide
uugcuuuuauuagagaaug

SEQ ID NO: 3451 - RNA, 19 nt, Artificial Sequence
  Synthetic oligonucleotide
ugcuuuuauuagagaauga

SEQ ID NO: 3452 - RNA, 19 nt, Artificial Sequence
  Synthetic oligonucleotide
gacagauacuccuccaagg

SEQ ID NO: 3453 - RNA, 19 nt, Artificial Sequence
  Synthetic oligonucleotide
aucauuaaagccugaguuu

SEQ ID NO: 3454 - RNA, 19 nt, Artificial Sequence
  Synthetic oligonucleotide
ucauuaaagccugaguuug

SEQ ID NO: 3455 - RNA, 19 nt, Artificial Sequence
  Synthetic oligonucleotide
uuaaagccugaguuugcuu

SEQ ID NO: 3456 - RNA, 19 nt, Artificial Sequence
  Synthetic oligonucleotide
uaaagccugaguuugcuuu

SEQ ID NO: 3457 - RNA, 21 nt, Artificial Sequence
  Synthetic oligonucleotide
aagagacaucugacuuggauc

SEQ ID NO: 3458 - RNA, 21 nt, Artificial Sequence
  Synthetic oligonucleotide
uccaagucagaugucucuugg

SEQ ID NO: 3459 - RNA, 27 nt, Artificial Sequence
  Synthetic oligonucleotide
ccaagagacaucugacuuggauccaca

SEQ ID NO: 3460 - RNA, 21 nt, Artificial Sequence
  Synthetic oligonucleotide
ccaagagacaucugacuugac

SEQ ID NO: 3461 - DNA, 25 bp, Artificial Sequence
  Synthetic oligonucleotide
aagagacaucugacuugguuccaag

SEQ ID NO: 3462 - DNA, 25 bp, Artificial Sequence
  Synthetic oligonucleotide
aagagacaucugacuuggaaccaag

SEQ ID NO: 3463 - DNA, 25 bp, Artificial Sequence
  Synthetic oligonucleotide
aagagacaucugacuuggauacaag

SEQ ID NO: 3464 - DNA, 25 bp, Artificial Sequence
  Synthetic oligonucleotide
aagagacaucugacuuggaucuaag

SEQ ID NO: 3465 - DNA, 25 bp, Artificial Sequence
  Synthetic oligonucleotide
aagagacaucugacuuggauccuag

SEQ ID NO: 3466 - DNA, 25 bp, Artificial Sequence
  Synthetic oligonucleotide
aagagacaucugacuuggauccagg

SEQ ID NO: 3467 - DNA, 25 bp, Artificial Sequence
  Synthetic oligonucleotide
aagagacaucugacuuggauccaaa

SEQ ID NO: 3468 - RNA, 27 nt, Artificial Sequence
  Synthetic oligonucleotide
uuuggauccaagucagaugucucuugg

SEQ ID NO: 3469 - RNA, 27 nt, Artificial Sequence
  Synthetic oligonucleotide
ccuggauccaagucagaugucucuugg

SEQ ID NO: 3470 - RNA, 27 nt, Artificial Sequence
  Synthetic oligonucleotide
cuaggauccaagucagaugucucuugg

SEQ ID NO: 3471 - RNA, 27 nt, Artificial Sequence
  Synthetic oligonucleotide
cuuagauccaagucagaugucucuugg

SEQ ID NO: 3472 - RNA, 27 nt, Artificial Sequence
  Synthetic oligonucleotide
cuuguauccaagucagaugucucuugg

SEQ ID NO: 3473 - RNA, 27 nt, Artificial Sequence
  Synthetic oligonucleotide
cuugguuccaagucagaugucucuugg

SEQ ID NO: 3474 - RNA, 27 nt, Artificial Sequence
  Synthetic oligonucleotide
cuuggaaccaagucagaugucucuugg

SEQ ID NO: 3475 - DNA, 25 bp, Artificial Sequence
  Synthetic oligonucleotide
  misc_feature (19)..(25): n is a, c, g, t or u
aagagacaucugacuuggnnnnnnn

SEQ ID NO: 3476 - RNA, 27 nt, Artificial Sequence
  Synthetic oligonucleotide
  misc_feature (1)..(7): n is a, c, g, or u
nnnnnnnccaagucagaugucucuugg

SEQ ID NO: 3477 - DNA, 27 bp, Artificial Sequence
  Synthetic oligonucleotide
  misc_feature (21)..(27): n is a, c, g, or t
ccaagagacatctgacttggnnnnnnn

SEQ ID NO: 3478 - DNA, 32 bp, Artificial Sequence
  Synthetic oligonucleotide
atgacaatggatttctcttcattcatacagac

SEQ ID NO: 3479 - DNA, 37 bp, Artificial Sequence
  Synthetic oligonucleotide
  misc_feature (1)..(27): n is a, c, g, t or u
nnnnnnnnnnnnnnnnnnnnnnnnnnnuagcuaucgt

SEQ ID NO: 3480 - DNA, 25 bp, Artificial Sequence
  Synthetic oligonucleotide
cugcuaccuccaaccaugggccutt

SEQ ID NO: 3481 - DNA, 25 bp, Artificial Sequence
  Synthetic oligonucleotide
ugcuaccuccaaccaugggccuutt

SEQ ID NO: 3482 - DNA, 25 bp, Artificial Sequence
  Synthetic oligonucleotide
gcuaccuccaaccaugggccuuutg

SEQ ID NO: 3483 - DNA, 25 bp, Artificial Sequence
  Synthetic oligonucleotide
cuaccuccaaccaugggccuuuugg

SEQ ID NO: 3484 - DNA, 25 bp, Artificial Sequence
  Synthetic oligonucleotide
ccuccaaccaugggccuuuugggaa

SEQ ID NO: 3485 - DNA, 25 bp, Artificial Sequence
  Synthetic oligonucleotide
cuccaaccaugggccuuuugggaat

SEQ ID NO: 3486 - DNA, 25 bp, Artificial Sequence
  Synthetic oligonucleotide
uccaaccaugggccuuuugggaata

SEQ ID NO: 3487 - DNA, 25 bp, Artificial Sequence
  Synthetic oligonucleotide
ccaaccaugggccuuuugggaauac

SEQ ID NO: 3488 - DNA, 25 bp, Artificial Sequence
  Synthetic oligonucleotide
caaccaugggccuuuugggaauact

SEQ ID NO: 3489 - DNA, 25 bp, Artificial Sequence
  Synthetic oligonucleotide
aaccaugggccuuuugggaauactt

SEQ ID NO: 3490 - DNA, 25 bp, Artificial Sequence
  Synthetic oligonucleotide
accaugggccuuuugggaauacutt

SEQ ID NO: 3491 - DNA, 25 bp, Artificial Sequence
  Synthetic oligonucleotide
ccaugggccuuuugggaauacuutg

SEQ ID NO: 3492 - DNA, 25 bp, Artificial Sequence
  Synthetic oligonucleotide
caugggccuuuugggaauacuuugt

SEQ ID NO: 3493 - DNA, 25 bp, Artificial Sequence
  Synthetic oligonucleotide
augggccuuuugggaauacuuugtt

SEQ ID NO: 3494 - DNA, 25 bp, Artificial Sequence
  Synthetic oligonucleotide
ugggccuuuugggaauacuuugutt

SEQ ID NO: 3495 - DNA, 25 bp, Artificial Sequence
  Synthetic oligonucleotide
gggccuuuugggaauacuuuguutt

SEQ ID NO: 3496 - DNA, 25 bp, Artificial Sequence
  Synthetic oligonucleotide
ggccuuuugggaauacuuuguuutt

SEQ ID NO: 3497 - DNA, 25 bp, Artificial Sequence
  Synthetic oligonucleotide
gccuuuugggaauacuuuguuuutt

SEQ ID NO: 3498 - DNA, 25 bp, Artificial Sequence
  Synthetic oligonucleotide
ccuuuugggaauacuuuguuuuuta

SEQ ID NO: 3499 - DNA, 25 bp, Artificial Sequence
  Synthetic oligonucleotide
cuuuugggaauacuuuguuuuuuaa

SEQ ID NO: 3500 - DNA, 25 bp, Artificial Sequence
  Synthetic oligonucleotide
uuuugggaauacuuuguuuuuuaat

SEQ ID NO: 3501 - DNA, 25 bp, Artificial Sequence
  Synthetic oligonucleotide
uuugggaauacuuuguuuuuuaatc

SEQ ID NO: 3502 - DNA, 25 bp, Artificial Sequence
  Synthetic oligonucleotide
uugggaauacuuuguuuuuuaauct

SEQ ID NO: 3503 - DNA, 25 bp, Artificial Sequence
  Synthetic oligonucleotide
ugggaauacuuuguuuuuuaauctt

SEQ ID NO: 3504 - DNA, 25 bp, Artificial Sequence
  Synthetic oligonucleotide
gggaauacuuuguuuuuuaaucutc

SEQ ID NO: 3505 - DNA, 25 bp, Artificial Sequence
  Synthetic oligonucleotide
ggaauacuuuguuuuuuaaucuucc

SEQ ID NO: 3506 - DNA, 25 bp, Artificial Sequence
  Synthetic oligonucleotide
gaauacuuuguuuuuuaaucuucct

SEQ ID NO: 3507 - DNA, 25 bp, Artificial Sequence
  Synthetic oligonucleotide
aauacuuuguuuuuuaaucuucctg

SEQ ID NO: 3508 - DNA, 25 bp, Artificial Sequence
  Synthetic oligonucleotide
auacuuuguuuuuuaaucuuccugg

SEQ ID NO: 3509 - DNA, 25 bp, Artificial Sequence
  Synthetic oligonucleotide
uacuuuguuuuuuaaucuuccuggg

SEQ ID NO: 3510 - DNA, 25 bp, Artificial Sequence
  Synthetic oligonucleotide
acuuuguuuuuuaaucuuccugggg

SEQ ID NO: 3511 - DNA, 25 bp, Artificial Sequence
  Synthetic oligonucleotide
cuuuguuuuuuaaucuuccugggga

SEQ ID NO: 3512 - DNA, 25 bp, Artificial Sequence
  Synthetic oligonucleotide
uuuguuuuuuaaucuuccuggggaa

SEQ ID NO: 3513 - DNA, 25 bp, Artificial Sequence
  Synthetic oligonucleotide
uuguuuuuuaaucuuccuggggaaa

SEQ ID NO: 3514 - DNA, 25 bp, Artificial Sequence
  Synthetic oligonucleotide
uguuuuuuaaucuuccuggggaaaa

SEQ ID NO: 3515 - DNA, 25 bp, Artificial Sequence
  Synthetic oligonucleotide
guuuuuuaaucuuccuggggaaaac

SEQ ID NO: 3516 - DNA, 25 bp, Artificial Sequence
  Synthetic oligonucleotide
uggggacaggagcaaacauauguca

SEQ ID NO: 3517 - DNA, 25 bp, Artificial Sequence
  Synthetic oligonucleotide
ggggacaggagcaaacauaugucat

SEQ ID NO: 3518 - DNA, 25 bp, Artificial Sequence
  Synthetic oligonucleotide
gggacaggagcaaacauaugucatt

SEQ ID NO: 3519 - DNA, 25 bp, Artificial Sequence
  Synthetic oligonucleotide
ggacaggagcaaacauaugucautt

SEQ ID NO: 3520 - DNA, 25 bp, Artificial Sequence
  Synthetic oligonucleotide
gacaggagcaaacauaugucauutc

SEQ ID NO: 3521 - DNA, 25 bp, Artificial Sequence
  Synthetic oligonucleotide
acaggagcaaacauaugucauuuca

SEQ ID NO: 3522 - DNA, 25 bp, Artificial Sequence
  Synthetic oligonucleotide
caggagcaaacauaugucauuucag

SEQ ID NO: 3523 - DNA, 25 bp, Artificial Sequence
  Synthetic oligonucleotide
aggagcaaacauaugucauuucagc

SEQ ID NO: 3524 - DNA, 25 bp, Artificial Sequence
  Synthetic oligonucleotide
ggagcaaacauaugucauuucagca

SEQ ID NO: 3525 - DNA, 25 bp, Artificial Sequence
  Synthetic oligonucleotide
gagcaaacauaugucauuucagcac

SEQ ID NO: 3526 - DNA, 25 bp, Artificial Sequence
  Synthetic oligonucleotide
agcaaacauaugucauuucagcacc

SEQ ID NO: 3527 - DNA, 25 bp, Artificial Sequence
  Synthetic oligonucleotide
gcaaacauaugucauuucagcacca

SEQ ID NO: 3528 - DNA, 25 bp, Artificial Sequence
  Synthetic oligonucleotide
caaacauaugucauuucagcaccaa

SEQ ID NO: 3529 - DNA, 25 bp, Artificial Sequence
  Synthetic oligonucleotide
aaacauaugucauuucagcaccaaa

SEQ ID NO: 3530 - DNA, 25 bp, Artificial Sequence
  Synthetic oligonucleotide
aacauaugucauuucagcaccaaaa

SEQ ID NO: 3531 - DNA, 25 bp, Artificial Sequence
  Synthetic oligonucleotide
acauaugucauuucagcaccaaaaa

SEQ ID NO: 3532 - DNA, 25 bp, Artificial Sequence
  Synthetic oligonucleotide
cauaugucauuucagcaccaaaaat

SEQ ID NO: 3533 - DNA, 25 bp, Artificial Sequence
  Synthetic oligonucleotide
uaugucauuucagcaccaaaaauat

SEQ ID NO: 3534 - DNA, 25 bp, Artificial Sequence
  Synthetic oligonucleotide
augucauuucagcaccaaaaauatt

SEQ ID NO: 3535 - DNA, 25 bp, Artificial Sequence
  Synthetic oligonucleotide
ugucauuucagcaccaaaaauautc

SEQ ID NO: 3536 - DNA, 25 bp, Artificial Sequence
  Synthetic oligonucleotide
gucauuucagcaccaaaaauauucc

SEQ ID NO: 3537 - DNA, 25 bp, Artificial Sequence
  Synthetic oligonucleotide
ucauuucagcaccaaaaauauuccg

SEQ ID NO: 3538 - DNA, 25 bp, Artificial Sequence
  Synthetic oligonucleotide
cauuucagcaccaaaaauauuccgt

SEQ ID NO: 3539 - DNA, 25 bp, Artificial Sequence
  Synthetic oligonucleotide
auuucagcaccaaaaauauuccgtg

SEQ ID NO: 3540 - DNA, 25 bp, Artificial Sequence
  Synthetic oligonucleotide
uuucagcaccaaaaauauuccgugt

SEQ ID NO: 3541 - DNA, 25 bp, Artificial Sequence
  Synthetic oligonucleotide
uucagcaccaaaaauauuccgugtt

SEQ ID NO: 3542 - DNA, 25 bp, Artificial Sequence
  Synthetic oligonucleotide
ucagcaccaaaaauauuccgugutg

SEQ ID NO: 3543 - DNA, 25 bp, Artificial Sequence
  Synthetic oligonucleotide
cagcaccaaaaauauuccguguugg

SEQ ID NO: 3544 - DNA, 25 bp, Artificial Sequence
  Synthetic oligonucleotide
agcaccaaaaauauuccguguugga

SEQ ID NO: 3545 - DNA, 25 bp, Artificial Sequence
  Synthetic oligonucleotide
gcaccaaaaauauuccguguuggag

SEQ ID NO: 3546 - DNA, 25 bp, Artificial Sequence
  Synthetic oligonucleotide
caccaaaaauauuccguguuggagc

SEQ ID NO: 3547 - DNA, 25 bp, Artificial Sequence
  Synthetic oligonucleotide
accaaaaauauuccguguuggagca

SEQ ID NO: 3548 - DNA, 25 bp, Artificial Sequence
  Synthetic oligonucleotide
ccaaaaauauuccguguuggagcat

SEQ ID NO: 3549 - DNA, 25 bp, Artificial Sequence
  Synthetic oligonucleotide
caaaaauauuccguguuggagcatc

SEQ ID NO: 3550 - DNA, 25 bp, Artificial Sequence
  Synthetic oligonucleotide
aaaaauauuccguguuggagcauct

SEQ ID NO: 3551 - DNA, 25 bp, Artificial Sequence
  Synthetic oligonucleotide
aaaauauuccguguuggagcauctg

SEQ ID NO: 3552 - DNA, 25 bp, Artificial Sequence
  Synthetic oligonucleotide
aaauauuccguguuggagcaucuga

SEQ ID NO: 3553 - DNA, 25 bp, Artificial Sequence
  Synthetic oligonucleotide
aauauuccguguuggagcaucugaa

SEQ ID NO: 3554 - DNA, 25 bp, Artificial Sequence
  Synthetic oligonucleotide
auauuccguguuggagcaucugaaa

SEQ ID NO: 3555 - DNA, 25 bp, Artificial Sequence
  Synthetic oligonucleotide
uauuccguguuggagcaucugaaaa

SEQ ID NO: 3556 - DNA, 25 bp, Artificial Sequence
  Synthetic oligonucleotide
auuccguguuggagcaucugaaaat

SEQ ID NO: 3557 - DNA, 25 bp, Artificial Sequence
  Synthetic oligonucleotide
uuccguguuggagcaucugaaaata

SEQ ID NO: 3558 - DNA, 25 bp, Artificial Sequence
  Synthetic oligonucleotide
uccguguuggagcaucugaaaauat

SEQ ID NO: 3559 - DNA, 25 bp, Artificial Sequence
  Synthetic oligonucleotide
ccguguuggagcaucugaaaauatt

SEQ ID NO: 3560 - DNA, 25 bp, Artificial Sequence
  Synthetic oligonucleotide
cguguuggagcaucugaaaauautg

SEQ ID NO: 3561 - DNA, 25 bp, Artificial Sequence
  Synthetic oligonucleotide
guguuggagcaucugaaaauauugt

SEQ ID NO: 3562 - DNA, 25 bp, Artificial Sequence
  Synthetic oligonucleotide
guuuauggauacacugaagcauutg

SEQ ID NO: 3563 - DNA, 25 bp, Artificial Sequence
  Synthetic oligonucleotide
uauggauacacugaagcauuugatg

SEQ ID NO: 3564 - DNA, 25 bp, Artificial Sequence
  Synthetic oligonucleotide
uggauacacugaagcauuugaugca

SEQ ID NO: 3565 - DNA, 25 bp, Artificial Sequence
  Synthetic oligonucleotide
ugaagcauuugaugcaacaaucuct

SEQ ID NO: 3566 - DNA, 25 bp, Artificial Sequence
  Synthetic oligonucleotide
aagcauuugaugcaacaaucucuat

SEQ ID NO: 3567 - DNA, 25 bp, Artificial Sequence
  Synthetic oligonucleotide
gcauuugaugcaacaaucucuauta

SEQ ID NO: 3568 - DNA, 25 bp, Artificial Sequence
  Synthetic oligonucleotide
auuugaugcaacaaucucuauuaaa

SEQ ID NO: 3569 - DNA, 25 bp, Artificial Sequence
  Synthetic oligonucleotide
uuugaugcaacaaucucuauuaaaa

SEQ ID NO: 3570 - DNA, 25 bp, Artificial Sequence
  Synthetic oligonucleotide
uugaugcaacaaucucuauuaaaag

SEQ ID NO: 3571 - DNA, 25 bp, Artificial Sequence
  Synthetic oligonucleotide
gcaacaaucucuauuaaaaguuatc

SEQ ID NO: 3572 - DNA, 25 bp, Artificial Sequence
  Synthetic oligonucleotide
caacaaucucuauuaaaaguuaucc

SEQ ID NO: 3573 - DNA, 25 bp, Artificial Sequence
  Synthetic oligonucleotide
aacaaucucuauuaaaaguuaucct

SEQ ID NO: 3574 - DNA, 25 bp, Artificial Sequence
  Synthetic oligonucleotide
aaucucuauuaaaaguuauccugat

SEQ ID NO: 3575 - DNA, 25 bp, Artificial Sequence
  Synthetic oligonucleotide
aucucuauuaaaaguuauccugata

SEQ ID NO: 3576 - DNA, 25 bp, Artificial Sequence
  Synthetic oligonucleotide
ucucuauuaaaaguuauccugauaa

SEQ ID NO: 3577 - DNA, 25 bp, Artificial Sequence
  Synthetic oligonucleotide
cucuauuaaaaguuauccugauaaa

SEQ ID NO: 3578 - DNA, 25 bp, Artificial Sequence
  Synthetic oligonucleotide
ucuauuaaaaguuauccugauaaaa

SEQ ID NO: 3579 - DNA, 25 bp, Artificial Sequence
  Synthetic oligonucleotide
uauuaaaaguuauccugauaaaaaa

SEQ ID NO: 3580 - DNA, 25 bp, Artificial Sequence
  Synthetic oligonucleotide
uuaaaaguuauccugauaaaaaatt

SEQ ID NO: 3581 - DNA, 25 bp, Artificial Sequence
  Synthetic oligonucleotide
uaaaaguuauccugauaaaaaautt

SEQ ID NO: 3582 - DNA, 25 bp, Artificial Sequence
  Synthetic oligonucleotide
aaguuauccugauaaaaaauuuagt

SEQ ID NO: 3583 - DNA, 25 bp, Artificial Sequence
  Synthetic oligonucleotide
aguuauccugauaaaaaauuuagtt

SEQ ID NO: 3584 - DNA, 25 bp, Artificial Sequence
  Synthetic oligonucleotide
uauccugauaaaaaauuuaguuact

SEQ ID NO: 3585 - DNA, 25 bp, Artificial Sequence
  Synthetic oligonucleotide
auccugauaaaaaauuuaguuactc

SEQ ID NO: 3586 - DNA, 25 bp, Artificial Sequence
  Synthetic oligonucleotide
uccugauaaaaaauuuaguuacucc

SEQ ID NO: 3587 - DNA, 25 bp, Artificial Sequence
  Synthetic oligonucleotide
ccugauaaaaaauuuaguuacucct

SEQ ID NO: 3588 - DNA, 25 bp, Artificial Sequence
  Synthetic oligonucleotide
cugauaaaaaauuuaguuacucctc

SEQ ID NO: 3589 - DNA, 25 bp, Artificial Sequence
  Synthetic oligonucleotide
ugauaaaaaauuuaguuacuccuca

SEQ ID NO: 3590 - DNA, 25 bp, Artificial Sequence
  Synthetic oligonucleotide
gauaaaaaauuuaguuacuccucag

SEQ ID NO: 3591 - DNA, 25 bp, Artificial Sequence
  Synthetic oligonucleotide
auaaaaaauuuaguuacuccucagg

SEQ ID NO: 3592 - DNA, 25 bp, Artificial Sequence
  Synthetic oligonucleotide
uaaaaaauuuaguuacuccucaggc

SEQ ID NO: 3593 - DNA, 25 bp, Artificial Sequence
  Synthetic oligonucleotide
aaaaaauuuaguuacuccucaggcc

SEQ ID NO: 3594 - DNA, 25 bp, Artificial Sequence
  Synthetic oligonucleotide
aaaaauuuaguuacuccucaggcca

SEQ ID NO: 3595 - DNA, 25 bp, Artificial Sequence
  Synthetic oligonucleotide
aaaauuuaguuacuccucaggccat

SEQ ID NO: 3596 - DNA, 25 bp, Artificial Sequence
  Synthetic oligonucleotide
aaauuuaguuacuccucaggccatg

SEQ ID NO: 3597 - DNA, 25 bp, Artificial Sequence
  Synthetic oligonucleotide
aauuuaguuacuccucaggccaugt

SEQ ID NO: 3598 - DNA, 25 bp, Artificial Sequence
  Synthetic oligonucleotide
auuuaguuacuccucaggccaugtt

SEQ ID NO: 3599 - DNA, 25 bp, Artificial Sequence
  Synthetic oligonucleotide
uuuaguuacuccucaggccaugutc

SEQ ID NO: 3600 - DNA, 25 bp, Artificial Sequence
  Synthetic oligonucleotide
uuaguuacuccucaggccauguuca

SEQ ID NO: 3601 - DNA, 25 bp, Artificial Sequence
  Synthetic oligonucleotide
uaguuacuccucaggccauguucat

SEQ ID NO: 3602 - DNA, 25 bp, Artificial Sequence
  Synthetic oligonucleotide
aguuacuccucaggccauguucatt

SEQ ID NO: 3603 - DNA, 25 bp, Artificial Sequence
  Synthetic oligonucleotide
guuacuccucaggccauguucautt

SEQ ID NO: 3604 - DNA, 25 bp, Artificial Sequence
  Synthetic oligonucleotide
uuacuccucaggccauguucauuta

SEQ ID NO: 3605 - DNA, 25 bp, Artificial Sequence
  Synthetic oligonucleotide
uacuccucaggccauguucauuuat

SEQ ID NO: 3606 - DNA, 25 bp, Artificial Sequence
  Synthetic oligonucleotide
acuccucaggccauguucauuuatc

SEQ ID NO: 3607 - DNA, 25 bp, Artificial Sequence
  Synthetic oligonucleotide
cuccucaggccauguucauuuaucc

SEQ ID NO: 3608 - DNA, 25 bp, Artificial Sequence
  Synthetic oligonucleotide
uccucaggccauguucauuuaucct

SEQ ID NO: 3609 - DNA, 25 bp, Artificial Sequence
  Synthetic oligonucleotide
ccucaggccauguucauuuaucctc

SEQ ID NO: 3610 - DNA, 25 bp, Artificial Sequence
  Synthetic oligonucleotide
cucaggccauguucauuuauccuca

SEQ ID NO: 3611 - DNA, 25 bp, Artificial Sequence
  Synthetic oligonucleotide
ucaggccauguucauuuauccucag

SEQ ID NO: 3612 - DNA, 25 bp, Artificial Sequence
  Synthetic oligonucleotide
caggccauguucauuuauccucaga

SEQ ID NO: 3613 - DNA, 25 bp, Artificial Sequence
  Synthetic oligonucleotide
aggccauguucauuuauccucagag

SEQ ID NO: 3614 - DNA, 25 bp, Artificial Sequence
  Synthetic oligonucleotide
ggccauguucauuuauccucagaga

SEQ ID NO: 3615 - DNA, 25 bp, Artificial Sequence
  Synthetic oligonucleotide
gccauguucauuuauccucagagaa

SEQ ID NO: 3616 - DNA, 25 bp, Artificial Sequence
  Synthetic oligonucleotide
ccauguucauuuauccucagagaat

SEQ ID NO: 3617 - DNA, 25 bp, Artificial Sequence
  Synthetic oligonucleotide
cauguucauuuauccucagagaata

SEQ ID NO: 3618 - DNA, 25 bp, Artificial Sequence
  Synthetic oligonucleotide
auguucauuuauccucagagaauaa

SEQ ID NO: 3619 - DNA, 25 bp, Artificial Sequence
  Synthetic oligonucleotide
uguucauuuauccucagagaauaaa

SEQ ID NO: 3620 - DNA, 25 bp, Artificial Sequence
  Synthetic oligonucleotide
ucauuuauccucagagaauaaautc

SEQ ID NO: 3621 - DNA, 25 bp, Artificial Sequence
  Synthetic oligonucleotide
cauuuauccucagagaauaaauucc

SEQ ID NO: 3622 - DNA, 25 bp, Artificial Sequence
  Synthetic oligonucleotide
auuuauccucagagaauaaauucca

SEQ ID NO: 3623 - DNA, 25 bp, Artificial Sequence
  Synthetic oligonucleotide
uuuauccucagagaauaaauuccaa

SEQ ID NO: 3624 - DNA, 25 bp, Artificial Sequence
  Synthetic oligonucleotide
uuauccucagagaauaaauuccaaa

SEQ ID NO: 3625 - DNA, 25 bp, Artificial Sequence
  Synthetic oligonucleotide
uauccucagagaauaaauuccaaaa

SEQ ID NO: 3626 - DNA, 25 bp, Artificial Sequence
  Synthetic oligonucleotide
auccucagagaauaaauuccaaaac

SEQ ID NO: 3627 - DNA, 25 bp, Artificial Sequence
  Synthetic oligonucleotide
uccucagagaauaaauuccaaaact

SEQ ID NO: 3628 - DNA, 25 bp, Artificial Sequence
  Synthetic oligonucleotide
ccucagagaauaaauuccaaaactc

SEQ ID NO: 3629 - DNA, 25 bp, Artificial Sequence
  Synthetic oligonucleotide
cucagagaauaaauuccaaaacuct

SEQ ID NO: 3630 - DNA, 25 bp, Artificial Sequence
  Synthetic oligonucleotide
ucagagaauaaauuccaaaacuctg

SEQ ID NO: 3631 - DNA, 25 bp, Artificial Sequence
  Synthetic oligonucleotide
cagagaauaaauuccaaaacucugc

SEQ ID NO: 3632 - DNA, 25 bp, Artificial Sequence
  Synthetic oligonucleotide
agagaauaaauuccaaaacucugca

SEQ ID NO: 3633 - DNA, 25 bp, Artificial Sequence
  Synthetic oligonucleotide
gagaauaaauuccaaaacucugcaa

SEQ ID NO: 3634 - DNA, 25 bp, Artificial Sequence
  Synthetic oligonucleotide
agaauaaauuccaaaacucugcaat

SEQ ID NO: 3635 - DNA, 25 bp, Artificial Sequence
  Synthetic oligonucleotide
ucuuaacaauacaaccaaaacaatt

SEQ ID NO: 3636 - DNA, 25 bp, Artificial Sequence
  Synthetic oligonucleotide
cuuaacaauacaaccaaaacaautg

SEQ ID NO: 3637 - DNA, 25 bp, Artificial Sequence
  Synthetic oligonucleotide
uuaacaauacaaccaaaacaauugc

SEQ ID NO: 3638 - DNA, 25 bp, Artificial Sequence
  Synthetic oligonucleotide
uaacaauacaaccaaaacaauugcc

SEQ ID NO: 3639 - DNA, 25 bp, Artificial Sequence
  Synthetic oligonucleotide
aacaauacaaccaaaacaauugcct

SEQ ID NO: 3640 - DNA, 25 bp, Artificial Sequence
  Synthetic oligonucleotide
acaauacaaccaaaacaauugcctg

SEQ ID NO: 3641 - DNA, 25 bp, Artificial Sequence
  Synthetic oligonucleotide
caauacaaccaaaacaauugccugg

SEQ ID NO: 3642 - DNA, 25 bp, Artificial Sequence
  Synthetic oligonucleotide
auuuggaaguuguaucaaagcautt

SEQ ID NO: 3643 - DNA, 25 bp, Artificial Sequence
  Synthetic oligonucleotide
uuuggaaguuguaucaaagcauutt

SEQ ID NO: 3644 - DNA, 25 bp, Artificial Sequence
  Synthetic oligonucleotide
uaucaaagcauuuuucaaaaucaaa

SEQ ID NO: 3645 - DNA, 25 bp, Artificial Sequence
  Synthetic oligonucleotide
aucaaagcauuuuucaaaaucaaaa

SEQ ID NO: 3646 - DNA, 25 bp, Artificial Sequence
  Synthetic oligonucleotide
ucaaagcauuuuucaaaaucaaaaa

SEQ ID NO: 3647 - DNA, 25 bp, Artificial Sequence
  Synthetic oligonucleotide
caaagcauuuuucaaaaucaaaaag

SEQ ID NO: 3648 - DNA, 25 bp, Artificial Sequence
  Synthetic oligonucleotide
aaagcauuuuucaaaaucaaaaaga

SEQ ID NO: 3649 - DNA, 25 bp, Artificial Sequence
  Synthetic oligonucleotide
ccaauaaccuaugacaauggauutc

SEQ ID NO: 3650 - DNA, 25 bp, Artificial Sequence
  Synthetic oligonucleotide
caauaaccuaugacaauggauuuct

SEQ ID NO: 3651 - DNA, 25 bp, Artificial Sequence
  Synthetic oligonucleotide
auaaccuaugacaauggauuucuct

SEQ ID NO: 3652 - DNA, 25 bp, Artificial Sequence
  Synthetic oligonucleotide
uaaccuaugacaauggauuucuctt

SEQ ID NO: 3653 - DNA, 25 bp, Artificial Sequence
  Synthetic oligonucleotide
aaccuaugacaauggauuucucutc

SEQ ID NO: 3654 - DNA, 25 bp, Artificial Sequence
  Synthetic oligonucleotide
accuaugacaauggauuucucuuca

SEQ ID NO: 3655 - DNA, 25 bp, Artificial Sequence
  Synthetic oligonucleotide
ccuaugacaauggauuucucuucat

SEQ ID NO: 3656 - DNA, 25 bp, Artificial Sequence
  Synthetic oligonucleotide
uaugacaauggauuucucuucautc

SEQ ID NO: 3657 - DNA, 25 bp, Artificial Sequence
  Synthetic oligonucleotide
augacaauggauuucucuucauuca

SEQ ID NO: 3658 - DNA, 25 bp, Artificial Sequence
  Synthetic oligonucleotide
ugacaauggauuucucuucauucat

SEQ ID NO: 3659 - DNA, 25 bp, Artificial Sequence
  Synthetic oligonucleotide
aauggauuucucuucauucauacag

SEQ ID NO: 3660 - DNA, 25 bp, Artificial Sequence
  Synthetic oligonucleotide
ggauuucucuucauucauacagaca

SEQ ID NO: 3661 - DNA, 25 bp, Artificial Sequence
  Synthetic oligonucleotide
auuucucuucauucauacagacaaa

SEQ ID NO: 3662 - DNA, 25 bp, Artificial Sequence
  Synthetic oligonucleotide
uuucucuucauucauacagacaaac

SEQ ID NO: 3663 - DNA, 25 bp, Artificial Sequence
  Synthetic oligonucleotide
uucucuucauucauacagacaaacc

SEQ ID NO: 3664 - DNA, 25 bp, Artificial Sequence
  Synthetic oligonucleotide
ucucuucauucauacagacaaacct

SEQ ID NO: 3665 - DNA, 25 bp, Artificial Sequence
  Synthetic oligonucleotide
cucuucauucauacagacaaacctg

SEQ ID NO: 3666 - DNA, 25 bp, Artificial Sequence
  Synthetic oligonucleotide
ucuucauucauacagacaaaccugt

SEQ ID NO: 3667 - DNA, 25 bp, Artificial Sequence
  Synthetic oligonucleotide
cuucauucauacagacaaaccugtt

SEQ ID NO: 3668 - DNA, 25 bp, Artificial Sequence
  Synthetic oligonucleotide
uucauucauacagacaaaccugutt

SEQ ID NO: 3669 - DNA, 25 bp, Artificial Sequence
  Synthetic oligonucleotide
ucauucauacagacaaaccuguuta

SEQ ID NO: 3670 - DNA, 25 bp, Artificial Sequence
  Synthetic oligonucleotide
cauucauacagacaaaccuguuuat

SEQ ID NO: 3671 - DNA, 25 bp, Artificial Sequence
  Synthetic oligonucleotide
uucauacagacaaaccuguuuauac

SEQ ID NO: 3672 - DNA, 25 bp, Artificial Sequence
  Synthetic oligonucleotide
uacagacaaaccuguuuauacucca

SEQ ID NO: 3673 - DNA, 25 bp, Artificial Sequence
  Synthetic oligonucleotide
acagacaaaccuguuuauacuccag

SEQ ID NO: 3674 - DNA, 25 bp, Artificial Sequence
  Synthetic oligonucleotide
cagacaaaccuguuuauacuccaga

SEQ ID NO: 3675 - DNA, 25 bp, Artificial Sequence
  Synthetic oligonucleotide
agacaaaccuguuuauacuccagac

SEQ ID NO: 3676 - DNA, 25 bp, Artificial Sequence
  Synthetic oligonucleotide
gacaaaccuguuuauacuccagacc

SEQ ID NO: 3677 - DNA, 25 bp, Artificial Sequence
  Synthetic oligonucleotide
acaaaccuguuuauacuccagacca

SEQ ID NO: 3678 - DNA, 25 bp, Artificial Sequence
  Synthetic oligonucleotide
caaaccuguuuauacuccagaccag

SEQ ID NO: 3679 - DNA, 25 bp, Artificial Sequence
  Synthetic oligonucleotide
aaaccuguuuauacuccagaccagt

SEQ ID NO: 3680 - DNA, 25 bp, Artificial Sequence
  Synthetic oligonucleotide
aaccuguuuauacuccagaccagtc

SEQ ID NO: 3681 - DNA, 25 bp, Artificial Sequence
  Synthetic oligonucleotide
accuguuuauacuccagaccaguca

SEQ ID NO: 3682 - DNA, 25 bp, Artificial Sequence
  Synthetic oligonucleotide
ccuguuuauacuccagaccagucag

SEQ ID NO: 3683 - DNA, 25 bp, Artificial Sequence
  Synthetic oligonucleotide
cuguuuauacuccagaccagucagt

SEQ ID NO: 3684 - DNA, 25 bp, Artificial Sequence
  Synthetic oligonucleotide
uuagaguuuauucguugaaugacga

SEQ ID NO: 3685 - DNA, 25 bp, Artificial Sequence
  Synthetic oligonucleotide
uagaguuuauucguugaaugacgac

SEQ ID NO: 3686 - DNA, 25 bp, Artificial Sequence
  Synthetic oligonucleotide
agaguuuauucguugaaugacgact

SEQ ID NO: 3687 - DNA, 25 bp, Artificial Sequence
  Synthetic oligonucleotide
gaguuuauucguugaaugacgactt

SEQ ID NO: 3688 - DNA, 25 bp, Artificial Sequence
  Synthetic oligonucleotide
gacuugaagccagccaaaagagaaa

SEQ ID NO: 3689 - DNA, 25 bp, Artificial Sequence
  Synthetic oligonucleotide
acuugaagccagccaaaagagaaac

SEQ ID NO: 3690 - DNA, 25 bp, Artificial Sequence
  Synthetic oligonucleotide
cuugaagccagccaaaagagaaact

SEQ ID NO: 3691 - DNA, 25 bp, Artificial Sequence
  Synthetic oligonucleotide
uugaagccagccaaaagagaaactg

SEQ ID NO: 3692 - DNA, 25 bp, Artificial Sequence
  Synthetic oligonucleotide
ugaagccagccaaaagagaaacugt

SEQ ID NO: 3693 - DNA, 25 bp, Artificial Sequence
  Synthetic oligonucleotide
gaagccagccaaaagagaaacugtc

SEQ ID NO: 3694 - DNA, 25 bp, Artificial Sequence
  Synthetic oligonucleotide
aagccagccaaaagagaaacuguct

SEQ ID NO: 3695 - DNA, 25 bp, Artificial Sequence
  Synthetic oligonucleotide
agccagccaaaagagaaacuguctt

SEQ ID NO: 3696 - DNA, 25 bp, Artificial Sequence
  Synthetic oligonucleotide
gccagccaaaagagaaacugucuta

SEQ ID NO: 3697 - DNA, 25 bp, Artificial Sequence
  Synthetic oligonucleotide
ccagccaaaagagaaacugucuuaa

SEQ ID NO: 3698 - DNA, 25 bp, Artificial Sequence
  Synthetic oligonucleotide
cagccaaaagagaaacugucuuaac

SEQ ID NO: 3699 - DNA, 25 bp, Artificial Sequence
  Synthetic oligonucleotide
agccaaaagagaaacugucuuaact

SEQ ID NO: 3700 - DNA, 25 bp, Artificial Sequence
  Synthetic oligonucleotide
gccaaaagagaaacugucuuaactt

SEQ ID NO: 3701 - DNA, 25 bp, Artificial Sequence
  Synthetic oligonucleotide
ccaaaagagaaacugucuuaacutt

SEQ ID NO: 3702 - DNA, 25 bp, Artificial Sequence
  Synthetic oligonucleotide
caaaagagaaacugucuuaacuutc

SEQ ID NO: 3703 - DNA, 25 bp, Artificial Sequence
  Synthetic oligonucleotide
aaaagagaaacugucuuaacuuuca

SEQ ID NO: 3704 - DNA, 25 bp, Artificial Sequence
  Synthetic oligonucleotide
aaagagaaacugucuuaacuuucat

SEQ ID NO: 3705 - DNA, 25 bp, Artificial Sequence
  Synthetic oligonucleotide
aagagaaacugucuuaacuuucata

SEQ ID NO: 3706 - DNA, 25 bp, Artificial Sequence
  Synthetic oligonucleotide
agagaaacugucuuaacuuucauag

SEQ ID NO: 3707 - DNA, 25 bp, Artificial Sequence
  Synthetic oligonucleotide
gagaaacugucuuaacuuucauaga

SEQ ID NO: 3708 - DNA, 25 bp, Artificial Sequence
  Synthetic oligonucleotide
gaaacugucuuaacuuucauagatc

SEQ ID NO: 3709 - DNA, 25 bp, Artificial Sequence
  Synthetic oligonucleotide
aaacugucuuaacuuucauagaucc

SEQ ID NO: 3710 - DNA, 25 bp, Artificial Sequence
  Synthetic oligonucleotide
aacugucuuaacuuucauagaucct

SEQ ID NO: 3711 - DNA, 25 bp, Artificial Sequence
  Synthetic oligonucleotide
ugucuuaacuuucauagauccugaa

SEQ ID NO: 3712 - DNA, 25 bp, Artificial Sequence
  Synthetic oligonucleotide
gucuuaacuuucauagauccugaag

SEQ ID NO: 3713 - DNA, 25 bp, Artificial Sequence
  Synthetic oligonucleotide
ucuuaacuuucauagauccugaagg

SEQ ID NO: 3714 - DNA, 25 bp, Artificial Sequence
  Synthetic oligonucleotide
cuuaacuuucauagauccugaagga

SEQ ID NO: 3715 - DNA, 25 bp, Artificial Sequence
  Synthetic oligonucleotide
uuaacuuucauagauccugaaggat

SEQ ID NO: 3716 - DNA, 25 bp, Artificial Sequence
  Synthetic oligonucleotide
uaacuuucauagauccugaaggatc

SEQ ID NO: 3717 - DNA, 25 bp, Artificial Sequence
  Synthetic oligonucleotide
aacuuucauagauccugaaggauca

SEQ ID NO: 3718 - DNA, 25 bp, Artificial Sequence
  Synthetic oligonucleotide
acuuucauagauccugaaggaucag

SEQ ID NO: 3719 - DNA, 25 bp, Artificial Sequence
  Synthetic oligonucleotide
cuuucauagauccugaaggaucaga

SEQ ID NO: 3720 - DNA, 25 bp, Artificial Sequence
  Synthetic oligonucleotide
uuucauagauccugaaggaucagaa

SEQ ID NO: 3721 - DNA, 25 bp, Artificial Sequence
  Synthetic oligonucleotide
uucauagauccugaaggaucagaag

SEQ ID NO: 3722 - DNA, 25 bp, Artificial Sequence
  Synthetic oligonucleotide
ucauagauccugaaggaucagaagt

SEQ ID NO: 3723 - DNA, 25 bp, Artificial Sequence
  Synthetic oligonucleotide
cauagauccugaaggaucagaagtt

SEQ ID NO: 3724 - DNA, 25 bp, Artificial Sequence
  Synthetic oligonucleotide
auagauccugaaggaucagaagutg

SEQ ID NO: 3725 - DNA, 25 bp, Artificial Sequence
  Synthetic oligonucleotide
uagauccugaaggaucagaaguuga

SEQ ID NO: 3726 - DNA, 25 bp, Artificial Sequence
  Synthetic oligonucleotide
agauccugaaggaucagaaguugac

SEQ ID NO: 3727 - DNA, 25 bp, Artificial Sequence
  Synthetic oligonucleotide
uugacaugguagaagaaauugauca

SEQ ID NO: 3728 - DNA, 25 bp, Artificial Sequence
  Synthetic oligonucleotide
ugacaugguagaagaaauugaucat

SEQ ID NO: 3729 - DNA, 25 bp, Artificial Sequence
  Synthetic oligonucleotide
caugguagaagaaauugaucauatt

SEQ ID NO: 3730 - DNA, 25 bp, Artificial Sequence
  Synthetic oligonucleotide
augguagaagaaauugaucauautg

SEQ ID NO: 3731 - DNA, 25 bp, Artificial Sequence
  Synthetic oligonucleotide
ugguagaagaaauugaucauauugg

SEQ ID NO: 3732 - DNA, 25 bp, Artificial Sequence
  Synthetic oligonucleotide
uagaagaaauugaucauauuggaat

SEQ ID NO: 3733 - DNA, 25 bp, Artificial Sequence
  Synthetic oligonucleotide
agaagaaauugaucauauuggaatt

SEQ ID NO: 3734 - DNA, 25 bp, Artificial Sequence
  Synthetic oligonucleotide
gaagaaauugaucauauuggaauta

SEQ ID NO: 3735 - DNA, 25 bp, Artificial Sequence
  Synthetic oligonucleotide
gaaauugaucauauuggaauuauct

SEQ ID NO: 3736 - DNA, 25 bp, Artificial Sequence
  Synthetic oligonucleotide
aaauugaucauauuggaauuauctc

SEQ ID NO: 3737 - DNA, 25 bp, Artificial Sequence
  Synthetic oligonucleotide
aauugaucauauuggaauuaucuct

SEQ ID NO: 3738 - DNA, 25 bp, Artificial Sequence
  Synthetic oligonucleotide
auugaucauauuggaauuaucuctt

SEQ ID NO: 3739 - DNA, 25 bp, Artificial Sequence
  Synthetic oligonucleotide
uugaucauauuggaauuaucucutt

SEQ ID NO: 3740 - DNA, 25 bp, Artificial Sequence
  Synthetic oligonucleotide
ugaucauauuggaauuaucucuutt

SEQ ID NO: 3741 - DNA, 25 bp, Artificial Sequence
  Synthetic oligonucleotide
gaucauauuggaauuaucucuuutc

SEQ ID NO: 3742 - DNA, 25 bp, Artificial Sequence
  Synthetic oligonucleotide
aucauauuggaauuaucucuuuucc

SEQ ID NO: 3743 - DNA, 25 bp, Artificial Sequence
  Synthetic oligonucleotide
ucauauuggaauuaucucuuuucct

SEQ ID NO: 3744 - DNA, 25 bp, Artificial Sequence
  Synthetic oligonucleotide
cauauuggaauuaucucuuuucctg

SEQ ID NO: 3745 - DNA, 25 bp, Artificial Sequence
  Synthetic oligonucleotide
auauuggaauuaucucuuuuccuga

SEQ ID NO: 3746 - DNA, 25 bp, Artificial Sequence
  Synthetic oligonucleotide
uauuggaauuaucucuuuuccugac

SEQ ID NO: 3747 - DNA, 25 bp, Artificial Sequence
  Synthetic oligonucleotide
auuggaauuaucucuuuuccugact

SEQ ID NO: 3748 - DNA, 25 bp, Artificial Sequence
  Synthetic oligonucleotide
uuggaauuaucucuuuuccugactt

SEQ ID NO: 3749 - DNA, 25 bp, Artificial Sequence
  Synthetic oligonucleotide
uggaauuaucucuuuuccugacutc

SEQ ID NO: 3750 - DNA, 25 bp, Artificial Sequence
  Synthetic oligonucleotide
uccugacuucaagauuccgucuaat

SEQ ID NO: 3751 - DNA, 25 bp, Artificial Sequence
  Synthetic oligonucleotide
ccugacuucaagauuccgucuaatc

SEQ ID NO: 3752 - DNA, 25 bp, Artificial Sequence
  Synthetic oligonucleotide
cugacuucaagauuccgucuaaucc

SEQ ID NO: 3753 - DNA, 25 bp, Artificial Sequence
  Synthetic oligonucleotide
ugacuucaagauuccgucuaaucct

SEQ ID NO: 3754 - DNA, 25 bp, Artificial Sequence
  Synthetic oligonucleotide
gacuucaagauuccgucuaauccta

SEQ ID NO: 3755 - DNA, 25 bp, Artificial Sequence
  Synthetic oligonucleotide
acuucaagauuccgucuaauccuag

SEQ ID NO: 3756 - DNA, 25 bp, Artificial Sequence
  Synthetic oligonucleotide
cuucaagauuccgucuaauccuaga

SEQ ID NO: 3757 - DNA, 25 bp, Artificial Sequence
  Synthetic oligonucleotide
uucaagauuccgucuaauccuagat

SEQ ID NO: 3758 - DNA, 25 bp, Artificial Sequence
  Synthetic oligonucleotide
ucaagauuccgucuaauccuagata

SEQ ID NO: 3759 - DNA, 25 bp, Artificial Sequence
  Synthetic oligonucleotide
caagauuccgucuaauccuagauat

SEQ ID NO: 3760 - DNA, 25 bp, Artificial Sequence
  Synthetic oligonucleotide
aagauuccgucuaauccuagauatg

SEQ ID NO: 3761 - DNA, 25 bp, Artificial Sequence
  Synthetic oligonucleotide
agauuccgucuaauccuagauaugg

SEQ ID NO: 3762 - DNA, 25 bp, Artificial Sequence
  Synthetic oligonucleotide
gauuccgucuaauccuagauauggt

SEQ ID NO: 3763 - DNA, 25 bp, Artificial Sequence
  Synthetic oligonucleotide
auuccgucuaauccuagauauggta

SEQ ID NO: 3764 - DNA, 25 bp, Artificial Sequence
  Synthetic oligonucleotide
uuccgucuaauccuagauaugguat

SEQ ID NO: 3765 - DNA, 25 bp, Artificial Sequence
  Synthetic oligonucleotide
uccgucuaauccuagauaugguatg

SEQ ID NO: 3766 - DNA, 25 bp, Artificial Sequence
  Synthetic oligonucleotide
ccgucuaauccuagauaugguaugt

SEQ ID NO: 3767 - DNA, 25 bp, Artificial Sequence
  Synthetic oligonucleotide
cgucuaauccuagauaugguaugtg

SEQ ID NO: 3768 - DNA, 25 bp, Artificial Sequence
  Synthetic oligonucleotide
gucuaauccuagauaugguaugugg

SEQ ID NO: 3769 - DNA, 25 bp, Artificial Sequence
  Synthetic oligonucleotide
ucuaauccuagauaugguaugugga

SEQ ID NO: 3770 - DNA, 25 bp, Artificial Sequence
  Synthetic oligonucleotide
cuaauccuagauaugguauguggac

SEQ ID NO: 3771 - DNA, 25 bp, Artificial Sequence
  Synthetic oligonucleotide
uaauccuagauaugguauguggacg

SEQ ID NO: 3772 - DNA, 25 bp, Artificial Sequence
  Synthetic oligonucleotide
aauccuagauaugguauguggacga

SEQ ID NO: 3773 - DNA, 25 bp, Artificial Sequence
  Synthetic oligonucleotide
auccuagauaugguauguggacgat

SEQ ID NO: 3774 - DNA, 25 bp, Artificial Sequence
  Synthetic oligonucleotide
uccuagauaugguauguggacgatc

SEQ ID NO: 3775 - DNA, 25 bp, Artificial Sequence
  Synthetic oligonucleotide
ccuagauaugguauguggacgauca

SEQ ID NO: 3776 - DNA, 25 bp, Artificial Sequence
  Synthetic oligonucleotide
aggcuaaauauaaagaggacuuutc

SEQ ID NO: 3777 - DNA, 25 bp, Artificial Sequence
  Synthetic oligonucleotide
ggcuaaauauaaagaggacuuuuca

SEQ ID NO: 3778 - DNA, 25 bp, Artificial Sequence
  Synthetic oligonucleotide
gcuaaauauaaagaggacuuuucaa

SEQ ID NO: 3779 - DNA, 25 bp, Artificial Sequence
  Synthetic oligonucleotide
cuaaauauaaagaggacuuuucaac

SEQ ID NO: 3780 - DNA, 25 bp, Artificial Sequence
  Synthetic oligonucleotide
uaaauauaaagaggacuuuucaaca

SEQ ID NO: 3781 - DNA, 25 bp, Artificial Sequence
  Synthetic oligonucleotide
aaauauaaagaggacuuuucaacaa

SEQ ID NO: 3782 - DNA, 25 bp, Artificial Sequence
  Synthetic oligonucleotide
aauauaaagaggacuuuucaacaac

SEQ ID NO: 3783 - DNA, 25 bp, Artificial Sequence
  Synthetic oligonucleotide
auauaaagaggacuuuucaacaact

SEQ ID NO: 3784 - DNA, 25 bp, Artificial Sequence
  Synthetic oligonucleotide
uauaaagaggacuuuucaacaactg

SEQ ID NO: 3785 - DNA, 25 bp, Artificial Sequence
  Synthetic oligonucleotide
auaaagaggacuuuucaacaacugg

SEQ ID NO: 3786 - DNA, 25 bp, Artificial Sequence
  Synthetic oligonucleotide
uaaagaggacuuuucaacaacugga

SEQ ID NO: 3787 - DNA, 25 bp, Artificial Sequence
  Synthetic oligonucleotide
aaagaggacuuuucaacaacuggaa

SEQ ID NO: 3788 - DNA, 25 bp, Artificial Sequence
  Synthetic oligonucleotide
aagaggacuuuucaacaacuggaac

SEQ ID NO: 3789 - DNA, 25 bp, Artificial Sequence
  Synthetic oligonucleotide
agaggacuuuucaacaacuggaacc

SEQ ID NO: 3790 - DNA, 25 bp, Artificial Sequence
  Synthetic oligonucleotide
gaggacuuuucaacaacuggaaccg

SEQ ID NO: 3791 - DNA, 25 bp, Artificial Sequence
  Synthetic oligonucleotide
aggacuuuucaacaacuggaaccgc

SEQ ID NO: 3792 - DNA, 25 bp, Artificial Sequence
  Synthetic oligonucleotide
ggacuuuucaacaacuggaaccgca

SEQ ID NO: 3793 - DNA, 25 bp, Artificial Sequence
  Synthetic oligonucleotide
gacuuuucaacaacuggaaccgcat

SEQ ID NO: 3794 - DNA, 25 bp, Artificial Sequence
  Synthetic oligonucleotide
acuuuucaacaacuggaaccgcata

SEQ ID NO: 3795 - DNA, 25 bp, Artificial Sequence
  Synthetic oligonucleotide
uuuugaaguuaaagaauaugucutg

SEQ ID NO: 3796 - DNA, 25 bp, Artificial Sequence
  Synthetic oligonucleotide
uuugaaguuaaagaauaugucuugc

SEQ ID NO: 3797 - DNA, 25 bp, Artificial Sequence
  Synthetic oligonucleotide
uugaaguuaaagaauaugucuugcc

SEQ ID NO: 3798 - DNA, 25 bp, Artificial Sequence
  Synthetic oligonucleotide
ugaaguuaaagaauaugucuugcca

SEQ ID NO: 3799 - DNA, 25 bp, Artificial Sequence
  Synthetic oligonucleotide
gaaguuaaagaauaugucuugccac

SEQ ID NO: 3800 - DNA, 25 bp, Artificial Sequence
  Synthetic oligonucleotide
aaguuaaagaauaugucuugccaca

SEQ ID NO: 3801 - DNA, 25 bp, Artificial Sequence
  Synthetic oligonucleotide
aguuaaagaauaugucuugccacat

SEQ ID NO: 3802 - DNA, 25 bp, Artificial Sequence
  Synthetic oligonucleotide
guuaaagaauaugucuugccacatt

SEQ ID NO: 3803 - DNA, 25 bp, Artificial Sequence
  Synthetic oligonucleotide
aagaauaugucuugccacauuuutc

SEQ ID NO: 3804 - DNA, 25 bp, Artificial Sequence
  Synthetic oligonucleotide
agaauaugucuugccacauuuuuct

SEQ ID NO: 3805 - DNA, 25 bp, Artificial Sequence
  Synthetic oligonucleotide
gaauaugucuugccacauuuuuctg

SEQ ID NO: 3806 - DNA, 25 bp, Artificial Sequence
  Synthetic oligonucleotide
aauaugucuugccacauuuuucugt

SEQ ID NO: 3807 - DNA, 25 bp, Artificial Sequence
  Synthetic oligonucleotide
auaugucuugccacauuuuucugtc

SEQ ID NO: 3808 - DNA, 25 bp, Artificial Sequence
  Synthetic oligonucleotide
uaugucuugccacauuuuucuguct

SEQ ID NO: 3809 - DNA, 25 bp, Artificial Sequence
  Synthetic oligonucleotide
augucuugccacauuuuucuguctc

SEQ ID NO: 3810 - DNA, 25 bp, Artificial Sequence
  Synthetic oligonucleotide
ugucuugccacauuuuucugucuca

SEQ ID NO: 3811 - DNA, 25 bp, Artificial Sequence
  Synthetic oligonucleotide
gucuugccacauuuuucugucucaa

SEQ ID NO: 3812 - DNA, 25 bp, Artificial Sequence
  Synthetic oligonucleotide
ucuugccacauuuuucugucucaat

SEQ ID NO: 3813 - DNA, 25 bp, Artificial Sequence
  Synthetic oligonucleotide
cuugccacauuuuucugucucaatc

SEQ ID NO: 3814 - DNA, 25 bp, Artificial Sequence
  Synthetic oligonucleotide
uugccacauuuuucugucucaaucg

SEQ ID NO: 3815 - DNA, 25 bp, Artificial Sequence
  Synthetic oligonucleotide
ugccacauuuuucugucucaaucga

SEQ ID NO: 3816 - DNA, 25 bp, Artificial Sequence
  Synthetic oligonucleotide
gccacauuuuucugucucaaucgag

SEQ ID NO: 3817 - DNA, 25 bp, Artificial Sequence
  Synthetic oligonucleotide
gaacuuuaagaauuuugaaauuact

SEQ ID NO: 3818 - DNA, 25 bp, Artificial Sequence
  Synthetic oligonucleotide
aacuuuaagaauuuugaaauuacta

SEQ ID NO: 3819 - DNA, 25 bp, Artificial Sequence
  Synthetic oligonucleotide
acuuuaagaauuuugaaauuacuat

SEQ ID NO: 3820 - DNA, 25 bp, Artificial Sequence
  Synthetic oligonucleotide
uuuaagaauuuugaaauuacuauaa

SEQ ID NO: 3821 - DNA, 25 bp, Artificial Sequence
  Synthetic oligonucleotide
uuaagaauuuugaaauuacuauaaa

SEQ ID NO: 3822 - DNA, 25 bp, Artificial Sequence
  Synthetic oligonucleotide
uaagaauuuugaaauuacuauaaaa

SEQ ID NO: 3823 - DNA, 25 bp, Artificial Sequence
  Synthetic oligonucleotide
aagaauuuugaaauuacuauaaaag

SEQ ID NO: 3824 - DNA, 25 bp, Artificial Sequence
  Synthetic oligonucleotide
agaauuuugaaauuacuauaaaagc

SEQ ID NO: 3825 - DNA, 25 bp, Artificial Sequence
  Synthetic oligonucleotide
uuuugaaauuacuauaaaagcaaga

SEQ ID NO: 3826 - DNA, 25 bp, Artificial Sequence
  Synthetic oligonucleotide
uuugaaauuacuauaaaagcaagat

SEQ ID NO: 3827 - DNA, 25 bp, Artificial Sequence
  Synthetic oligonucleotide
aaauuacuauaaaagcaagauautt

SEQ ID NO: 3828 - DNA, 25 bp, Artificial Sequence
  Synthetic oligonucleotide
aauuacuauaaaagcaagauauutt

SEQ ID NO: 3829 - DNA, 25 bp, Artificial Sequence
  Synthetic oligonucleotide
auuacuauaaaagcaagauauuutt

SEQ ID NO: 3830 - DNA, 25 bp, Artificial Sequence
  Synthetic oligonucleotide
uuacuauaaaagcaagauauuuuta

SEQ ID NO: 3831 - DNA, 25 bp, Artificial Sequence
  Synthetic oligonucleotide
uacuauaaaagcaagauauuuuuat

SEQ ID NO: 3832 - DNA, 25 bp, Artificial Sequence
  Synthetic oligonucleotide
acuauaaaagcaagauauuuuuata

SEQ ID NO: 3833 - DNA, 25 bp, Artificial Sequence
  Synthetic oligonucleotide
cuauaaaagcaagauauuuuuauaa

SEQ ID NO: 3834 - DNA, 25 bp, Artificial Sequence
  Synthetic oligonucleotide
uauaaaagcaagauauuuuuauaat

SEQ ID NO: 3835 - DNA, 25 bp, Artificial Sequence
  Synthetic oligonucleotide
auaaaagcaagauauuuuuauaata

SEQ ID NO: 3836 - DNA, 25 bp, Artificial Sequence
  Synthetic oligonucleotide
uaaaagcaagauauuuuuauaauaa

SEQ ID NO: 3837 - DNA, 25 bp, Artificial Sequence
  Synthetic oligonucleotide
aaaagcaagauauuuuuauaauaaa

SEQ ID NO: 3838 - DNA, 25 bp, Artificial Sequence
  Synthetic oligonucleotide
auauuuuuauaauaaaguagucact

SEQ ID NO: 3839 - DNA, 25 bp, Artificial Sequence
  Synthetic oligonucleotide
uauuuuuauaauaaaguagucactg

SEQ ID NO: 3840 - DNA, 25 bp, Artificial Sequence
  Synthetic oligonucleotide
auuuuuauaauaaaguagucacuga

SEQ ID NO: 3841 - DNA, 25 bp, Artificial Sequence
  Synthetic oligonucleotide
uuuuuauaauaaaguagucacugag

SEQ ID NO: 3842 - DNA, 25 bp, Artificial Sequence
  Synthetic oligonucleotide
uuuuauaauaaaguagucacugagg

SEQ ID NO: 3843 - DNA, 25 bp, Artificial Sequence
  Synthetic oligonucleotide
uuuauaauaaaguagucacugaggc

SEQ ID NO: 3844 - DNA, 25 bp, Artificial Sequence
  Synthetic oligonucleotide
uuauaauaaaguagucacugaggct

SEQ ID NO: 3845 - DNA, 25 bp, Artificial Sequence
  Synthetic oligonucleotide
uauaauaaaguagucacugaggctg

SEQ ID NO: 3846 - DNA, 25 bp, Artificial Sequence
  Synthetic oligonucleotide
auaauaaaguagucacugaggcuga

SEQ ID NO: 3847 - DNA, 25 bp, Artificial Sequence
  Synthetic oligonucleotide
uaauaaaguagucacugaggcugac

SEQ ID NO: 3848 - DNA, 25 bp, Artificial Sequence
  Synthetic oligonucleotide
aauaaaguagucacugaggcugacg

SEQ ID NO: 3849 - DNA, 25 bp, Artificial Sequence
  Synthetic oligonucleotide
auaaaguagucacugaggcugacgt

SEQ ID NO: 3850 - DNA, 25 bp, Artificial Sequence
  Synthetic oligonucleotide
uaaaguagucacugaggcugacgtt

SEQ ID NO: 3851 - DNA, 25 bp, Artificial Sequence
  Synthetic oligonucleotide
aaaguagucacugaggcugacgutt

SEQ ID NO: 3852 - DNA, 25 bp, Artificial Sequence
  Synthetic oligonucleotide
aaguagucacugaggcugacguuta

SEQ ID NO: 3853 - DNA, 25 bp, Artificial Sequence
  Synthetic oligonucleotide
guuuauaucacauuuggaauaagag

SEQ ID NO: 3854 - DNA, 25 bp, Artificial Sequence
  Synthetic oligonucleotide
uuuauaucacauuuggaauaagaga

SEQ ID NO: 3855 - DNA, 25 bp, Artificial Sequence
  Synthetic oligonucleotide
uuauaucacauuuggaauaagagaa

SEQ ID NO: 3856 - DNA, 25 bp, Artificial Sequence
  Synthetic oligonucleotide
uauaucacauuuggaauaagagaag

SEQ ID NO: 3857 - DNA, 25 bp, Artificial Sequence
  Synthetic oligonucleotide
auaucacauuuggaauaagagaaga

SEQ ID NO: 3858 - DNA, 25 bp, Artificial Sequence
  Synthetic oligonucleotide
uaucacauuuggaauaagagaagac

SEQ ID NO: 3859 - DNA, 25 bp, Artificial Sequence
  Synthetic oligonucleotide
aucacauuuggaauaagagaagact

SEQ ID NO: 3860 - DNA, 25 bp, Artificial Sequence
  Synthetic oligonucleotide
ucacauuuggaauaagagaagactt

SEQ ID NO: 3861 - DNA, 25 bp, Artificial Sequence
  Synthetic oligonucleotide
cacauuuggaauaagagaagacuta

SEQ ID NO: 3862 - DNA, 25 bp, Artificial Sequence
  Synthetic oligonucleotide
acauuuggaauaagagaagacuuaa

SEQ ID NO: 3863 - DNA, 25 bp, Artificial Sequence
  Synthetic oligonucleotide
cauuuggaauaagagaagacuuaaa

SEQ ID NO: 3864 - DNA, 25 bp, Artificial Sequence
  Synthetic oligonucleotide
auuuggaauaagagaagacuuaaaa

SEQ ID NO: 3865 - DNA, 25 bp, Artificial Sequence
  Synthetic oligonucleotide
uuuggaauaagagaagacuuaaaag

SEQ ID NO: 3866 - DNA, 25 bp, Artificial Sequence
  Synthetic oligonucleotide
uuggaauaagagaagacuuaaaaga

SEQ ID NO: 3867 - DNA, 25 bp, Artificial Sequence
  Synthetic oligonucleotide
uggaauaagagaagacuuaaaagat

SEQ ID NO: 3868 - DNA, 25 bp, Artificial Sequence
  Synthetic oligonucleotide
ggaauaagagaagacuuaaaagatg

SEQ ID NO: 3869 - DNA, 25 bp, Artificial Sequence
  Synthetic oligonucleotide
gaauaagagaagacuuaaaagauga

SEQ ID NO: 3870 - DNA, 25 bp, Artificial Sequence
  Synthetic oligonucleotide
aauaagagaagacuuaaaagaugat

SEQ ID NO: 3871 - DNA, 25 bp, Artificial Sequence
  Synthetic oligonucleotide
auaagagaagacuuaaaagaugatc

SEQ ID NO: 3872 - DNA, 25 bp, Artificial Sequence
  Synthetic oligonucleotide
uaagagaagacuuaaaagaugauca

SEQ ID NO: 3873 - DNA, 25 bp, Artificial Sequence
  Synthetic oligonucleotide
aagagaagacuuaaaagaugaucaa

SEQ ID NO: 3874 - DNA, 25 bp, Artificial Sequence
  Synthetic oligonucleotide
agagaagacuuaaaagaugaucaaa

SEQ ID NO: 3875 - DNA, 25 bp, Artificial Sequence
  Synthetic oligonucleotide
gagaagacuuaaaagaugaucaaaa

SEQ ID NO: 3876 - DNA, 25 bp, Artificial Sequence
  Synthetic oligonucleotide
agaagacuuaaaagaugaucaaaaa

SEQ ID NO: 3877 - DNA, 25 bp, Artificial Sequence
  Synthetic oligonucleotide
gaagacuuaaaagaugaucaaaaag

SEQ ID NO: 3878 - DNA, 25 bp, Artificial Sequence
  Synthetic oligonucleotide
aagacuuaaaagaugaucaaaaaga

SEQ ID NO: 3879 - DNA, 25 bp, Artificial Sequence
  Synthetic oligonucleotide
agacuuaaaagaugaucaaaaagaa

SEQ ID NO: 3880 - DNA, 25 bp, Artificial Sequence
  Synthetic oligonucleotide
gacuuaaaagaugaucaaaaagaaa

SEQ ID NO: 3881 - DNA, 25 bp, Artificial Sequence
  Synthetic oligonucleotide
acuuaaaagaugaucaaaaagaaat

SEQ ID NO: 3882 - DNA, 25 bp, Artificial Sequence
  Synthetic oligonucleotide
cuuaaaagaugaucaaaaagaaatg

SEQ ID NO: 3883 - DNA, 25 bp, Artificial Sequence
  Synthetic oligonucleotide
uuaaaagaugaucaaaaagaaauga

SEQ ID NO: 3884 - DNA, 25 bp, Artificial Sequence
  Synthetic oligonucleotide
uaaaagaugaucaaaaagaaaugat

SEQ ID NO: 3885 - DNA, 25 bp, Artificial Sequence
  Synthetic oligonucleotide
aaaagaugaucaaaaagaaaugatg

SEQ ID NO: 3886 - DNA, 25 bp, Artificial Sequence
  Synthetic oligonucleotide
aaagaugaucaaaaagaaaugaugc

SEQ ID NO: 3887 - DNA, 25 bp, Artificial Sequence
  Synthetic oligonucleotide
aagaugaucaaaaagaaaugaugca

SEQ ID NO: 3888 - DNA, 25 bp, Artificial Sequence
  Synthetic oligonucleotide
agaugaucaaaaagaaaugaugcaa

SEQ ID NO: 3889 - DNA, 25 bp, Artificial Sequence
  Synthetic oligonucleotide
gaugaucaaaaagaaaugaugcaaa

SEQ ID NO: 3890 - DNA, 25 bp, Artificial Sequence
  Synthetic oligonucleotide
augaucaaaaagaaaugaugcaaac

SEQ ID NO: 3891 - DNA, 25 bp, Artificial Sequence
  Synthetic oligonucleotide
ugaucaaaaagaaaugaugcaaaca

SEQ ID NO: 3892 - DNA, 25 bp, Artificial Sequence
  Synthetic oligonucleotide
gaucaaaaagaaaugaugcaaacag

SEQ ID NO: 3893 - DNA, 25 bp, Artificial Sequence
  Synthetic oligonucleotide
aucaaaaagaaaugaugcaaacagc

SEQ ID NO: 3894 - DNA, 25 bp, Artificial Sequence
  Synthetic oligonucleotide
ucaaaaagaaaugaugcaaacagca

SEQ ID NO: 3895 - DNA, 25 bp, Artificial Sequence
  Synthetic oligonucleotide
caaaaagaaaugaugcaaacagcaa

SEQ ID NO: 3896 - DNA, 25 bp, Artificial Sequence
  Synthetic oligonucleotide
aaaaagaaaugaugcaaacagcaat

SEQ ID NO: 3897 - DNA, 25 bp, Artificial Sequence
  Synthetic oligonucleotide
aaaagaaaugaugcaaacagcaatg

SEQ ID NO: 3898 - DNA, 25 bp, Artificial Sequence
  Synthetic oligonucleotide
aaagaaaugaugcaaacagcaaugc

SEQ ID NO: 3899 - DNA, 25 bp, Artificial Sequence
  Synthetic oligonucleotide
aagaaaugaugcaaacagcaaugca

SEQ ID NO: 3900 - DNA, 25 bp, Artificial Sequence
  Synthetic oligonucleotide
agaaaugaugcaaacagcaaugcaa

SEQ ID NO: 3901 - DNA, 25 bp, Artificial Sequence
  Synthetic oligonucleotide
gaaaugaugcaaacagcaaugcaaa

SEQ ID NO: 3902 - DNA, 25 bp, Artificial Sequence
  Synthetic oligonucleotide
aaaugaugcaaacagcaaugcaaaa

SEQ ID NO: 3903 - DNA, 25 bp, Artificial Sequence
  Synthetic oligonucleotide
aaugaugcaaacagcaaugcaaaac

SEQ ID NO: 3904 - DNA, 25 bp, Artificial Sequence
  Synthetic oligonucleotide
augaugcaaacagcaaugcaaaaca

SEQ ID NO: 3905 - DNA, 25 bp, Artificial Sequence
  Synthetic oligonucleotide
ugaugcaaacagcaaugcaaaacac

SEQ ID NO: 3906 - DNA, 25 bp, Artificial Sequence
  Synthetic oligonucleotide
auguugauaaauggaauugcucaag

SEQ ID NO: 3907 - DNA, 25 bp, Artificial Sequence
  Synthetic oligonucleotide
ugauaaauggaauugcucaagucac

SEQ ID NO: 3908 - DNA, 25 bp, Artificial Sequence
  Synthetic oligonucleotide
gauaaauggaauugcucaagucaca

SEQ ID NO: 3909 - DNA, 25 bp, Artificial Sequence
  Synthetic oligonucleotide
uaaauggaauugcucaagucacatt

SEQ ID NO: 3910 - DNA, 25 bp, Artificial Sequence
  Synthetic oligonucleotide
aaauggaauugcucaagucacautt

SEQ ID NO: 3911 - DNA, 25 bp, Artificial Sequence
  Synthetic oligonucleotide
aauggaauugcucaagucacauutg

SEQ ID NO: 3912 - DNA, 25 bp, Artificial Sequence
  Synthetic oligonucleotide
uggaauugcucaagucacauuugat

SEQ ID NO: 3913 - DNA, 25 bp, Artificial Sequence
  Synthetic oligonucleotide
ggaauugcucaagucacauuugatt

SEQ ID NO: 3914 - DNA, 25 bp, Artificial Sequence
  Synthetic oligonucleotide
gaauugcucaagucacauuugautc

SEQ ID NO: 3915 - DNA, 25 bp, Artificial Sequence
  Synthetic oligonucleotide
aauugcucaagucacauuugauuct

SEQ ID NO: 3916 - DNA, 25 bp, Artificial Sequence
  Synthetic oligonucleotide
auugcucaagucacauuugauuctg

SEQ ID NO: 3917 - DNA, 25 bp, Artificial Sequence
  Synthetic oligonucleotide
uugcucaagucacauuugauucuga

SEQ ID NO: 3918 - DNA, 25 bp, Artificial Sequence
  Synthetic oligonucleotide
ugcucaagucacauuugauucugaa

SEQ ID NO: 3919 - DNA, 25 bp, Artificial Sequence
  Synthetic oligonucleotide
gcucaagucacauuugauucugaaa

SEQ ID NO: 3920 - DNA, 25 bp, Artificial Sequence
  Synthetic oligonucleotide
ucaagucacauuugauucugaaaca

SEQ ID NO: 3921 - DNA, 25 bp, Artificial Sequence
  Synthetic oligonucleotide
gucacauuugauucugaaacagcag

SEQ ID NO: 3922 - DNA, 25 bp, Artificial Sequence
  Synthetic oligonucleotide
ucacauuugauucugaaacagcagt

SEQ ID NO: 3923 - DNA, 25 bp, Artificial Sequence
  Synthetic oligonucleotide
cacauuugauucugaaacagcagtc

SEQ ID NO: 3924 - DNA, 25 bp, Artificial Sequence
  Synthetic oligonucleotide
acauuugauucugaaacagcaguca

SEQ ID NO: 3925 - DNA, 25 bp, Artificial Sequence
  Synthetic oligonucleotide
auuugauucugaaacagcagucaaa

SEQ ID NO: 3926 - DNA, 25 bp, Artificial Sequence
  Synthetic oligonucleotide
ugauucugaaacagcagucaaagaa

SEQ ID NO: 3927 - DNA, 25 bp, Artificial Sequence
  Synthetic oligonucleotide
gauucugaaacagcagucaaagaac

SEQ ID NO: 3928 - DNA, 25 bp, Artificial Sequence
  Synthetic oligonucleotide
auucugaaacagcagucaaagaact

SEQ ID NO: 3929 - DNA, 25 bp, Artificial Sequence
  Synthetic oligonucleotide
uucugaaacagcagucaaagaactg

SEQ ID NO: 3930 - DNA, 25 bp, Artificial Sequence
  Synthetic oligonucleotide
ucugaaacagcagucaaagaacugt

SEQ ID NO: 3931 - DNA, 25 bp, Artificial Sequence
  Synthetic oligonucleotide
cugaaacagcagucaaagaacugtc

SEQ ID NO: 3932 - DNA, 25 bp, Artificial Sequence
  Synthetic oligonucleotide
ugaaacagcagucaaagaacuguca

SEQ ID NO: 3933 - DNA, 25 bp, Artificial Sequence
  Synthetic oligonucleotide
gaaacagcagucaaagaacugucat

SEQ ID NO: 3934 - DNA, 25 bp, Artificial Sequence
  Synthetic oligonucleotide
aaacagcagucaaagaacugucata

SEQ ID NO: 3935 - DNA, 25 bp, Artificial Sequence
  Synthetic oligonucleotide
aacagcagucaaagaacugucauac

SEQ ID NO: 3936 - DNA, 25 bp, Artificial Sequence
  Synthetic oligonucleotide
acagcagucaaagaacugucauact

SEQ ID NO: 3937 - DNA, 25 bp, Artificial Sequence
  Synthetic oligonucleotide
agcagucaaagaacugucauacuac

SEQ ID NO: 3938 - DNA, 25 bp, Artificial Sequence
  Synthetic oligonucleotide
cagucaaagaacugucauacuacag

SEQ ID NO: 3939 - DNA, 25 bp, Artificial Sequence
  Synthetic oligonucleotide
agucaaagaacugucauacuacagt

SEQ ID NO: 3940 - DNA, 25 bp, Artificial Sequence
  Synthetic oligonucleotide
ucaaagaacugucauacuacagutt

SEQ ID NO: 3941 - DNA, 25 bp, Artificial Sequence
  Synthetic oligonucleotide
caaagaacugucauacuacaguuta

SEQ ID NO: 3942 - DNA, 25 bp, Artificial Sequence
  Synthetic oligonucleotide
aaagaacugucauacuacaguuuag

SEQ ID NO: 3943 - DNA, 25 bp, Artificial Sequence
  Synthetic oligonucleotide
gaacugucauacuacaguuuagaag

SEQ ID NO: 3944 - DNA, 25 bp, Artificial Sequence
  Synthetic oligonucleotide
acugucauacuacaguuuagaagat

SEQ ID NO: 3945 - DNA, 25 bp, Artificial Sequence
  Synthetic oligonucleotide
cugucauacuacaguuuagaagatt

SEQ ID NO: 3946 - DNA, 25 bp, Artificial Sequence
  Synthetic oligonucleotide
ugucauacuacaguuuagaagautt

SEQ ID NO: 3947 - DNA, 25 bp, Artificial Sequence
  Synthetic oligonucleotide
gucauacuacaguuuagaagauuta

SEQ ID NO: 3948 - DNA, 25 bp, Artificial Sequence
  Synthetic oligonucleotide
ucauacuacaguuuagaagauuuaa

SEQ ID NO: 3949 - DNA, 25 bp, Artificial Sequence
  Synthetic oligonucleotide
cauacuacaguuuagaagauuuaaa

SEQ ID NO: 3950 - DNA, 25 bp, Artificial Sequence
  Synthetic oligonucleotide
auacuacaguuuagaagauuuaaac

SEQ ID NO: 3951 - DNA, 25 bp, Artificial Sequence
  Synthetic oligonucleotide
uacuacaguuuagaagauuuaaaca

SEQ ID NO: 3952 - DNA, 25 bp, Artificial Sequence
  Synthetic oligonucleotide
acuacaguuuagaagauuuaaacaa

SEQ ID NO: 3953 - DNA, 25 bp, Artificial Sequence
  Synthetic oligonucleotide
cuacaguuuagaagauuuaaacaac

SEQ ID NO: 3954 - DNA, 25 bp, Artificial Sequence
  Synthetic oligonucleotide
uacaguuuagaagauuuaaacaaca

SEQ ID NO: 3955 - DNA, 25 bp, Artificial Sequence
  Synthetic oligonucleotide
acaguuuagaagauuuaaacaacaa

SEQ ID NO: 3956 - DNA, 25 bp, Artificial Sequence
  Synthetic oligonucleotide
caguuuagaagauuuaaacaacaag

SEQ ID NO: 3957 - DNA, 25 bp, Artificial Sequence
  Synthetic oligonucleotide
aguuuagaagauuuaaacaacaagt

SEQ ID NO: 3958 - DNA, 25 bp, Artificial Sequence
  Synthetic oligonucleotide
guuuagaagauuuaaacaacaagta

SEQ ID NO: 3959 - DNA, 25 bp, Artificial Sequence
  Synthetic oligonucleotide
uuuagaagauuuaaacaacaaguac

SEQ ID NO: 3960 - DNA, 25 bp, Artificial Sequence
  Synthetic oligonucleotide
uuagaagauuuaaacaacaaguacc

SEQ ID NO: 3961 - DNA, 25 bp, Artificial Sequence
  Synthetic oligonucleotide
uagaagauuuaaacaacaaguacct

SEQ ID NO: 3962 - DNA, 25 bp, Artificial Sequence
  Synthetic oligonucleotide
agaagauuuaaacaacaaguacctt

SEQ ID NO: 3963 - DNA, 25 bp, Artificial Sequence
  Synthetic oligonucleotide
gaagauuuaaacaacaaguaccutt

SEQ ID NO: 3964 - DNA, 25 bp, Artificial Sequence
  Synthetic oligonucleotide
aagauuuaaacaacaaguaccuuta

SEQ ID NO: 3965 - DNA, 25 bp, Artificial Sequence
  Synthetic oligonucleotide
agauuuaaacaacaaguaccuuuat

SEQ ID NO: 3966 - DNA, 25 bp, Artificial Sequence
  Synthetic oligonucleotide
gauuuaaacaacaaguaccuuuata

SEQ ID NO: 3967 - DNA, 25 bp, Artificial Sequence
  Synthetic oligonucleotide
auuuaaacaacaaguaccuuuauat

SEQ ID NO: 3968 - DNA, 25 bp, Artificial Sequence
  Synthetic oligonucleotide
uuuaaacaacaaguaccuuuauatt

SEQ ID NO: 3969 - DNA, 25 bp, Artificial Sequence
  Synthetic oligonucleotide
uaccuuuauauugcuguaacaguca

SEQ ID NO: 3970 - DNA, 25 bp, Artificial Sequence
  Synthetic oligonucleotide
ccuuuauauugcuguaacagucata

SEQ ID NO: 3971 - DNA, 25 bp, Artificial Sequence
  Synthetic oligonucleotide
cuuuauauugcuguaacagucauag

SEQ ID NO: 3972 - DNA, 25 bp, Artificial Sequence
  Synthetic oligonucleotide
uuuauauugcuguaacagucauaga

SEQ ID NO: 3973 - DNA, 25 bp, Artificial Sequence
  Synthetic oligonucleotide
uuauauugcuguaacagucauagag

SEQ ID NO: 3974 - DNA, 25 bp, Artificial Sequence
  Synthetic oligonucleotide
uauauugcuguaacagucauagagt

SEQ ID NO: 3975 - DNA, 25 bp, Artificial Sequence
  Synthetic oligonucleotide
auauugcuguaacagucauagagtc

SEQ ID NO: 3976 - DNA, 25 bp, Artificial Sequence
  Synthetic oligonucleotide
uauugcuguaacagucauagaguct

SEQ ID NO: 3977 - DNA, 25 bp, Artificial Sequence
  Synthetic oligonucleotide
auugcuguaacagucauagagucta

SEQ ID NO: 3978 - DNA, 25 bp, Artificial Sequence
  Synthetic oligonucleotide
uugcuguaacagucauagagucuac

SEQ ID NO: 3979 - DNA, 25 bp, Artificial Sequence
  Synthetic oligonucleotide
ugcuguaacagucauagagucuaca

SEQ ID NO: 3980 - DNA, 25 bp, Artificial Sequence
  Synthetic oligonucleotide
gcuguaacagucauagagucuacag

SEQ ID NO: 3981 - DNA, 25 bp, Artificial Sequence
  Synthetic oligonucleotide
cuguaacagucauagagucuacagg

SEQ ID NO: 3982 - DNA, 25 bp, Artificial Sequence
  Synthetic oligonucleotide
uguaacagucauagagucuacaggt

SEQ ID NO: 3983 - DNA, 25 bp, Artificial Sequence
  Synthetic oligonucleotide
guaacagucauagagucuacaggtg

SEQ ID NO: 3984 - DNA, 25 bp, Artificial Sequence
  Synthetic oligonucleotide
uaacagucauagagucuacaggugg

SEQ ID NO: 3985 - DNA, 25 bp, Artificial Sequence
  Synthetic oligonucleotide
aacagucauagagucuacaggugga

SEQ ID NO: 3986 - DNA, 25 bp, Artificial Sequence
  Synthetic oligonucleotide
acagucauagagucuacagguggat

SEQ ID NO: 3987 - DNA, 25 bp, Artificial Sequence
  Synthetic oligonucleotide
cagucauagagucuacagguggatt

SEQ ID NO: 3988 - DNA, 25 bp, Artificial Sequence
  Synthetic oligonucleotide
agucauagagucuacagguggautt

SEQ ID NO: 3989 - DNA, 25 bp, Artificial Sequence
  Synthetic oligonucleotide
gucauagagucuacagguggauutt

SEQ ID NO: 3990 - DNA, 25 bp, Artificial Sequence
  Synthetic oligonucleotide
ucauagagucuacagguggauuutc

SEQ ID NO: 3991 - DNA, 25 bp, Artificial Sequence
  Synthetic oligonucleotide
cauagagucuacagguggauuuuct

SEQ ID NO: 3992 - DNA, 25 bp, Artificial Sequence
  Synthetic oligonucleotide
auagagucuacagguggauuuuctg

SEQ ID NO: 3993 - DNA, 25 bp, Artificial Sequence
  Synthetic oligonucleotide
uagagucuacagguggauuuucuga

SEQ ID NO: 3994 - DNA, 25 bp, Artificial Sequence
  Synthetic oligonucleotide
agagucuacagguggauuuucugaa

SEQ ID NO: 3995 - DNA, 25 bp, Artificial Sequence
  Synthetic oligonucleotide
gagucuacagguggauuuucugaag

SEQ ID NO: 3996 - DNA, 25 bp, Artificial Sequence
  Synthetic oligonucleotide
agucuacagguggauuuucugaaga

SEQ ID NO: 3997 - DNA, 25 bp, Artificial Sequence
  Synthetic oligonucleotide
gucuacagguggauuuucugaagag

SEQ ID NO: 3998 - DNA, 25 bp, Artificial Sequence
  Synthetic oligonucleotide
ucuacagguggauuuucugaagagg

SEQ ID NO: 3999 - DNA, 25 bp, Artificial Sequence
  Synthetic oligonucleotide
cuacagguggauuuucugaagaggc

SEQ ID NO: 4000 - DNA, 25 bp, Artificial Sequence
  Synthetic oligonucleotide
uacagguggauuuucugaagaggca

SEQ ID NO: 4001 - DNA, 25 bp, Artificial Sequence
  Synthetic oligonucleotide
acagguggauuuucugaagaggcag

SEQ ID NO: 4002 - DNA, 25 bp, Artificial Sequence
  Synthetic oligonucleotide
cagguggauuuucugaagaggcaga

SEQ ID NO: 4003 - DNA, 25 bp, Artificial Sequence
  Synthetic oligonucleotide
agguggauuuucugaagaggcagaa

SEQ ID NO: 4004 - DNA, 25 bp, Artificial Sequence
  Synthetic oligonucleotide
gguggauuuucugaagaggcagaaa

SEQ ID NO: 4005 - DNA, 25 bp, Artificial Sequence
  Synthetic oligonucleotide
guggauuuucugaagaggcagaaat

SEQ ID NO: 4006 - DNA, 25 bp, Artificial Sequence
  Synthetic oligonucleotide
uggauuuucugaagaggcagaaata

SEQ ID NO: 4007 - DNA, 25 bp, Artificial Sequence
  Synthetic oligonucleotide
ggauuuucugaagaggcagaaauac

SEQ ID NO: 4008 - DNA, 25 bp, Artificial Sequence
  Synthetic oligonucleotide
gauuuucugaagaggcagaaauacc

SEQ ID NO: 4009 - DNA, 25 bp, Artificial Sequence
  Synthetic oligonucleotide
auuuucugaagaggcagaaauacct

SEQ ID NO: 4010 - DNA, 25 bp, Artificial Sequence
  Synthetic oligonucleotide
uuuucugaagaggcagaaauacctg

SEQ ID NO: 4011 - DNA, 25 bp, Artificial Sequence
  Synthetic oligonucleotide
uuucugaagaggcagaaauaccugg

SEQ ID NO: 4012 - DNA, 25 bp, Artificial Sequence
  Synthetic oligonucleotide
uucugaagaggcagaaauaccuggc

SEQ ID NO: 4013 - DNA, 25 bp, Artificial Sequence
  Synthetic oligonucleotide
ucugaagaggcagaaauaccuggca

SEQ ID NO: 4014 - DNA, 25 bp, Artificial Sequence
  Synthetic oligonucleotide
cugaagaggcagaaauaccuggcat

SEQ ID NO: 4015 - DNA, 25 bp, Artificial Sequence
  Synthetic oligonucleotide
ugaagaggcagaaauaccuggcatc

SEQ ID NO: 4016 - DNA, 25 bp, Artificial Sequence
  Synthetic oligonucleotide
gaagaggcagaaauaccuggcauca

SEQ ID NO: 4017 - DNA, 25 bp, Artificial Sequence
  Synthetic oligonucleotide
aagaggcagaaauaccuggcaucaa

SEQ ID NO: 4018 - DNA, 25 bp, Artificial Sequence
  Synthetic oligonucleotide
agaggcagaaauaccuggcaucaaa

SEQ ID NO: 4019 - DNA, 25 bp, Artificial Sequence
  Synthetic oligonucleotide
gaggcagaaauaccuggcaucaaat

SEQ ID NO: 4020 - DNA, 25 bp, Artificial Sequence
  Synthetic oligonucleotide
aggcagaaauaccuggcaucaaata

SEQ ID NO: 4021 - DNA, 25 bp, Artificial Sequence
  Synthetic oligonucleotide
ggcagaaauaccuggcaucaaauat

SEQ ID NO: 4022 - DNA, 25 bp, Artificial Sequence
  Synthetic oligonucleotide
gcagaaauaccuggcaucaaauatg

SEQ ID NO: 4023 - DNA, 25 bp, Artificial Sequence
  Synthetic oligonucleotide
cagaaauaccuggcaucaaauaugt

SEQ ID NO: 4024 - DNA, 25 bp, Artificial Sequence
  Synthetic oligonucleotide
agaaauaccuggcaucaaauaugtc

SEQ ID NO: 4025 - DNA, 25 bp, Artificial Sequence
  Synthetic oligonucleotide
gaaauaccuggcaucaaauaugucc

SEQ ID NO: 4026 - DNA, 25 bp, Artificial Sequence
  Synthetic oligonucleotide
aaauaccuggcaucaaauaugucct

SEQ ID NO: 4027 - DNA, 25 bp, Artificial Sequence
  Synthetic oligonucleotide
aauaccuggcaucaaauaugucctc

SEQ ID NO: 4028 - DNA, 25 bp, Artificial Sequence
  Synthetic oligonucleotide
auaccuggcaucaaauauguccuct

SEQ ID NO: 4029 - DNA, 25 bp, Artificial Sequence
  Synthetic oligonucleotide
uaccuggcaucaaauauguccuctc

SEQ ID NO: 4030 - DNA, 25 bp, Artificial Sequence
  Synthetic oligonucleotide
accuggcaucaaauauguccucuct

SEQ ID NO: 4031 - DNA, 25 bp, Artificial Sequence
  Synthetic oligonucleotide
ccuggcaucaaauauguccucuctc

SEQ ID NO: 4032 - DNA, 25 bp, Artificial Sequence
  Synthetic oligonucleotide
cuggcaucaaauauguccucucucc

SEQ ID NO: 4033 - DNA, 25 bp, Artificial Sequence
  Synthetic oligonucleotide
uggcaucaaauauguccucucuccc

SEQ ID NO: 4034 - DNA, 25 bp, Artificial Sequence
  Synthetic oligonucleotide
ggcaucaaauauguccucucuccct

SEQ ID NO: 4035 - DNA, 25 bp, Artificial Sequence
  Synthetic oligonucleotide
gcaucaaauauguccucucucccta

SEQ ID NO: 4036 - DNA, 25 bp, Artificial Sequence
  Synthetic oligonucleotide
caucaaauauguccucucucccuac

SEQ ID NO: 4037 - DNA, 25 bp, Artificial Sequence
  Synthetic oligonucleotide
aucaaauauguccucucucccuaca

SEQ ID NO: 4038 - DNA, 25 bp, Artificial Sequence
  Synthetic oligonucleotide
caaauauguccucucucccuacaaa

SEQ ID NO: 4039 - DNA, 25 bp, Artificial Sequence
  Synthetic oligonucleotide
aaauauguccucucucccuacaaac

SEQ ID NO: 4040 - DNA, 25 bp, Artificial Sequence
  Synthetic oligonucleotide
aauauguccucucucccuacaaact

SEQ ID NO: 4041 - DNA, 25 bp, Artificial Sequence
  Synthetic oligonucleotide
auauguccucucucccuacaaactg

SEQ ID NO: 4042 - DNA, 25 bp, Artificial Sequence
  Synthetic oligonucleotide
uauguccucucucccuacaaacuga

SEQ ID NO: 4043 - DNA, 25 bp, Artificial Sequence
  Synthetic oligonucleotide
auguccucucucccuacaaacugaa

SEQ ID NO: 4044 - DNA, 25 bp, Artificial Sequence
  Synthetic oligonucleotide
uguccucucucccuacaaacugaat

SEQ ID NO: 4045 - DNA, 25 bp, Artificial Sequence
  Synthetic oligonucleotide
guccucucucccuacaaacugaatt

SEQ ID NO: 4046 - DNA, 25 bp, Artificial Sequence
  Synthetic oligonucleotide
uccucucucccuacaaacugaautt

SEQ ID NO: 4047 - DNA, 25 bp, Artificial Sequence
  Synthetic oligonucleotide
ccucucucccuacaaacugaauutg

SEQ ID NO: 4048 - DNA, 25 bp, Artificial Sequence
  Synthetic oligonucleotide
cucucucccuacaaacugaauuugg

SEQ ID NO: 4049 - DNA, 25 bp, Artificial Sequence
  Synthetic oligonucleotide
ucucucccuacaaacugaauuuggt

SEQ ID NO: 4050 - DNA, 25 bp, Artificial Sequence
  Synthetic oligonucleotide
cucucccuacaaacugaauuuggtt

SEQ ID NO: 4051 - DNA, 25 bp, Artificial Sequence
  Synthetic oligonucleotide
ucucccuacaaacugaauuuggutg

SEQ ID NO: 4052 - DNA, 25 bp, Artificial Sequence
  Synthetic oligonucleotide
cucccuacaaacugaauuugguugc

SEQ ID NO: 4053 - DNA, 25 bp, Artificial Sequence
  Synthetic oligonucleotide
ucccuacaaacugaauuugguugct

SEQ ID NO: 4054 - DNA, 25 bp, Artificial Sequence
  Synthetic oligonucleotide
ccuacaaacugaauuugguugcuac

SEQ ID NO: 4055 - DNA, 25 bp, Artificial Sequence
  Synthetic oligonucleotide
cuacaaacugaauuugguugcuact

SEQ ID NO: 4056 - DNA, 25 bp, Artificial Sequence
  Synthetic oligonucleotide
uacaaacugaauuugguugcuactc

SEQ ID NO: 4057 - DNA, 25 bp, Artificial Sequence
  Synthetic oligonucleotide
aaacugaauuugguugcuacucctc

SEQ ID NO: 4058 - DNA, 25 bp, Artificial Sequence
  Synthetic oligonucleotide
aacugaauuugguugcuacuccuct

SEQ ID NO: 4059 - DNA, 25 bp, Artificial Sequence
  Synthetic oligonucleotide
acugaauuugguugcuacuccuctt

SEQ ID NO: 4060 - DNA, 25 bp, Artificial Sequence
  Synthetic oligonucleotide
cugaauuugguugcuacuccucutt

SEQ ID NO: 4061 - DNA, 25 bp, Artificial Sequence
  Synthetic oligonucleotide
ugaauuugguugcuacuccucuutt

SEQ ID NO: 4062 - DNA, 25 bp, Artificial Sequence
  Synthetic oligonucleotide
gaauuugguugcuacuccucuuutc

SEQ ID NO: 4063 - DNA, 25 bp, Artificial Sequence
  Synthetic oligonucleotide
aauuugguugcuacuccucuuuucc

SEQ ID NO: 4064 - DNA, 25 bp, Artificial Sequence
  Synthetic oligonucleotide
auuugguugcuacuccucuuuucct

SEQ ID NO: 4065 - DNA, 25 bp, Artificial Sequence
  Synthetic oligonucleotide
uuugguugcuacuccucuuuucctg

SEQ ID NO: 4066 - DNA, 25 bp, Artificial Sequence
  Synthetic oligonucleotide
uugguugcuacuccucuuuuccuga

SEQ ID NO: 4067 - DNA, 25 bp, Artificial Sequence
  Synthetic oligonucleotide
ugguugcuacuccucuuuuccugaa

SEQ ID NO: 4068 - DNA, 25 bp, Artificial Sequence
  Synthetic oligonucleotide
gguugcuacuccucuuuuccugaag

SEQ ID NO: 4069 - DNA, 25 bp, Artificial Sequence
  Synthetic oligonucleotide
guugcuacuccucuuuuccugaagc

SEQ ID NO: 4070 - DNA, 25 bp, Artificial Sequence
  Synthetic oligonucleotide
uugcuacuccucuuuuccugaagcc

SEQ ID NO: 4071 - DNA, 25 bp, Artificial Sequence
  Synthetic oligonucleotide
ugcuacuccucuuuuccugaagcct

SEQ ID NO: 4072 - DNA, 25 bp, Artificial Sequence
  Synthetic oligonucleotide
gcuacuccucuuuuccugaagcctg

SEQ ID NO: 4073 - DNA, 25 bp, Artificial Sequence
  Synthetic oligonucleotide
cuacuccucuuuuccugaagccugg

SEQ ID NO: 4074 - DNA, 25 bp, Artificial Sequence
  Synthetic oligonucleotide
uacuccucuuuuccugaagccuggg

SEQ ID NO: 4075 - DNA, 25 bp, Artificial Sequence
  Synthetic oligonucleotide
acuccucuuuuccugaagccuggga

SEQ ID NO: 4076 - DNA, 25 bp, Artificial Sequence
  Synthetic oligonucleotide
cuccucuuuuccugaagccugggat

SEQ ID NO: 4077 - DNA, 25 bp, Artificial Sequence
  Synthetic oligonucleotide
uccucuuuuccugaagccugggatt

SEQ ID NO: 4078 - DNA, 25 bp, Artificial Sequence
  Synthetic oligonucleotide
ccucuuuuccugaagccugggautc

SEQ ID NO: 4079 - DNA, 25 bp, Artificial Sequence
  Synthetic oligonucleotide
cucuuuuccugaagccugggauucc

SEQ ID NO: 4080 - DNA, 25 bp, Artificial Sequence
  Synthetic oligonucleotide
ucuuuuccugaagccugggauucca

SEQ ID NO: 4081 - DNA, 25 bp, Artificial Sequence
  Synthetic oligonucleotide
cuuuuccugaagccugggauuccat

SEQ ID NO: 4082 - DNA, 25 bp, Artificial Sequence
  Synthetic oligonucleotide
uuuuccugaagccugggauuccata

SEQ ID NO: 4083 - DNA, 25 bp, Artificial Sequence
  Synthetic oligonucleotide
uuuccugaagccugggauuccauat

SEQ ID NO: 4084 - DNA, 25 bp, Artificial Sequence
  Synthetic oligonucleotide
uuccugaagccugggauuccauatc

SEQ ID NO: 4085 - DNA, 25 bp, Artificial Sequence
  Synthetic oligonucleotide
uccugaagccugggauuccauaucc

SEQ ID NO: 4086 - DNA, 25 bp, Artificial Sequence
  Synthetic oligonucleotide
ccugaagccugggauuccauauccc

SEQ ID NO: 4087 - DNA, 25 bp, Artificial Sequence
  Synthetic oligonucleotide
cugaagccugggauuccauauccca

SEQ ID NO: 4088 - DNA, 25 bp, Artificial Sequence
  Synthetic oligonucleotide
ugaagccugggauuccauaucccat

SEQ ID NO: 4089 - DNA, 25 bp, Artificial Sequence
  Synthetic oligonucleotide
gaagccugggauuccauaucccatc

SEQ ID NO: 4090 - DNA, 25 bp, Artificial Sequence
  Synthetic oligonucleotide
ccaucaaggugcagguuaaagautc

SEQ ID NO: 4091 - DNA, 25 bp, Artificial Sequence
  Synthetic oligonucleotide
caucaaggugcagguuaaagauucg

SEQ ID NO: 4092 - DNA, 25 bp, Artificial Sequence
  Synthetic oligonucleotide
aucaaggugcagguuaaagauucgc

SEQ ID NO: 4093 - DNA, 25 bp, Artificial Sequence
  Synthetic oligonucleotide
ucaaggugcagguuaaagauucgct

SEQ ID NO: 4094 - DNA, 25 bp, Artificial Sequence
  Synthetic oligonucleotide
caaggugcagguuaaagauucgctt

SEQ ID NO: 4095 - DNA, 25 bp, Artificial Sequence
  Synthetic oligonucleotide
cgcuugaccaguugguaggaggagt

SEQ ID NO: 4096 - DNA, 25 bp, Artificial Sequence
  Synthetic oligonucleotide
gcuugaccaguugguaggaggagtc

SEQ ID NO: 4097 - DNA, 25 bp, Artificial Sequence
  Synthetic oligonucleotide
cuugaccaguugguaggaggagucc

SEQ ID NO: 4098 - DNA, 25 bp, Artificial Sequence
  Synthetic oligonucleotide
uugaccaguugguaggaggaguccc

SEQ ID NO: 4099 - DNA, 25 bp, Artificial Sequence
  Synthetic oligonucleotide
gucccaguaacacugaaugcacaaa

SEQ ID NO: 4100 - DNA, 25 bp, Artificial Sequence
  Synthetic oligonucleotide
ucccaguaacacugaaugcacaaac

SEQ ID NO: 4101 - DNA, 25 bp, Artificial Sequence
  Synthetic oligonucleotide
cccaguaacacugaaugcacaaaca

SEQ ID NO: 4102 - DNA, 25 bp, Artificial Sequence
  Synthetic oligonucleotide
ccaguaacacugaaugcacaaacaa

SEQ ID NO: 4103 - DNA, 25 bp, Artificial Sequence
  Synthetic oligonucleotide
caguaacacugaaugcacaaacaat

SEQ ID NO: 4104 - DNA, 25 bp, Artificial Sequence
  Synthetic oligonucleotide
aguaacacugaaugcacaaacaatt

SEQ ID NO: 4105 - DNA, 25 bp, Artificial Sequence
  Synthetic oligonucleotide
guaacacugaaugcacaaacaautg

SEQ ID NO: 4106 - DNA, 25 bp, Artificial Sequence
  Synthetic oligonucleotide
uaacacugaaugcacaaacaauuga

SEQ ID NO: 4107 - DNA, 25 bp, Artificial Sequence
  Synthetic oligonucleotide
aacacugaaugcacaaacaauugat

SEQ ID NO: 4108 - DNA, 25 bp, Artificial Sequence
  Synthetic oligonucleotide
acacugaaugcacaaacaauugatg

SEQ ID NO: 4109 - DNA, 25 bp, Artificial Sequence
  Synthetic oligonucleotide
cacugaaugcacaaacaauugaugt

SEQ ID NO: 4110 - DNA, 25 bp, Artificial Sequence
  Synthetic oligonucleotide
acugaaugcacaaacaauugaugta

SEQ ID NO: 4111 - DNA, 25 bp, Artificial Sequence
  Synthetic oligonucleotide
gaaugcacaaacaauugauguaaac

SEQ ID NO: 4112 - DNA, 25 bp, Artificial Sequence
  Synthetic oligonucleotide
aaugcacaaacaauugauguaaacc

SEQ ID NO: 4113 - DNA, 25 bp, Artificial Sequence
  Synthetic oligonucleotide
augcacaaacaauugauguaaacca

SEQ ID NO: 4114 - DNA, 25 bp, Artificial Sequence
  Synthetic oligonucleotide
aaccaagagacaucugacuuggatc

SEQ ID NO: 4115 - DNA, 25 bp, Artificial Sequence
  Synthetic oligonucleotide
accaagagacaucugacuuggaucc

SEQ ID NO: 4116 - DNA, 25 bp, Artificial Sequence
  Synthetic oligonucleotide
ccaagagacaucugacuuggaucca

SEQ ID NO: 4117 - DNA, 25 bp, Artificial Sequence
  Synthetic oligonucleotide
aaaaguguaacacguguugaugatg

SEQ ID NO: 4118 - DNA, 25 bp, Artificial Sequence
  Synthetic oligonucleotide
aaaguguaacacguguugaugaugg

SEQ ID NO: 4119 - DNA, 25 bp, Artificial Sequence
  Synthetic oligonucleotide
aaguguaacacguguugaugaugga

SEQ ID NO: 4120 - DNA, 25 bp, Artificial Sequence
  Synthetic oligonucleotide
aguguaacacguguugaugauggag

SEQ ID NO: 4121 - DNA, 25 bp, Artificial Sequence
  Synthetic oligonucleotide
guguaacacguguugaugauggagt

SEQ ID NO: 4122 - DNA, 25 bp, Artificial Sequence
  Synthetic oligonucleotide
uguaacacguguugaugauggagta

SEQ ID NO: 4123 - DNA, 25 bp, Artificial Sequence
  Synthetic oligonucleotide
guaacacguguugaugauggaguag

SEQ ID NO: 4124 - DNA, 25 bp, Artificial Sequence
  Synthetic oligonucleotide
uaacacguguugaugauggaguagc

SEQ ID NO: 4125 - DNA, 25 bp, Artificial Sequence
  Synthetic oligonucleotide
aacacguguugaugauggaguagct

SEQ ID NO: 4126 - DNA, 25 bp, Artificial Sequence
  Synthetic oligonucleotide
acacguguugaugauggaguagctt

SEQ ID NO: 4127 - DNA, 25 bp, Artificial Sequence
  Synthetic oligonucleotide
cacguguugaugauggaguagcutc

SEQ ID NO: 4128 - DNA, 25 bp, Artificial Sequence
  Synthetic oligonucleotide
acguguugaugauggaguagcuucc

SEQ ID NO: 4129 - DNA, 25 bp, Artificial Sequence
  Synthetic oligonucleotide
cguguugaugauggaguagcuucct

SEQ ID NO: 4130 - DNA, 25 bp, Artificial Sequence
  Synthetic oligonucleotide
guguugaugauggaguagcuucctt

SEQ ID NO: 4131 - DNA, 25 bp, Artificial Sequence
  Synthetic oligonucleotide
uguugaugauggaguagcuuccutt

(The sequence listing continues in the following parts.)

We claim:

1. A nucleic acid comprising an oligonucleotide strand of up to 80 nucleotides in length, wherein said oligonucleotide strand is complementary to a target C5 mRNA sequence set forth as SEQ ID NO: 2024 along at least 20 consecutive nucleotides of said oligonucleotide strand length to reduce C5 target mRNA expression when said nucleic acid is introduced into a mammalian cell, wherein said dsNA comprises a modified nucleotide.

2. The nucleic acid of claim 1, wherein said oligonucleotide strand is up to 35 nucleotides in length.

3. A double stranded nucleic acid (dsNA) comprising first and second nucleic acid strands comprising RNA, wherein said first strand is 15-66 nucleotides in length and said second strand of said dsNA is 20-66 nucleotides in length, wherein said second strand is complementary to a target C5 mRNA sequence set forth as SEQ ID NO: 2024 along at least 20 consecutive nucleotides of said second oligonucleotide strand length to reduce C5 target mRNA expression when said double stranded nucleic acid is introduced into a mammalian cell, wherein said dsNA comprises a modified nucleotide.

4. The dsNA of claim 3, wherein said first strand is 15-35 nucleotides in length.

5. The dsNA of claim 3, wherein said second strand is 20-35 nucleotides in length.

6. The dsNA of claim 3 comprising a duplex region of at least 25 base pairs in length.

7. The dsNA of claim 3, wherein said second strand comprises a sequence set forth as SEQ ID NO: 488.

8. The dsNA of claim 3, wherein said first strand comprises a sequence set forth as SEQ ID NO: 104.

9. The dsNA of claim 3 comprising a modified nucleotide selected from the group consisting of a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC) and a monophosphate nucleotide of 2',3'-didehydro-2',3'-dideoxythymidine (d4T), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, and a locked nucleic acid.

10. The isolated nucleic acid of claim 3 comprising a phosphate backbone modification selected from the group consisting of a phosphonate, a phosphorothioate and a phosphotriester.

11. A composition selected from the group consisting of:
a dsNA comprising first and second nucleic acid strands, wherein said first strand is 15-35 nucleotides in length and said second strand of said dsNA is 20-35 nucleotides in length, wherein said dsNA comprises a modified nucleotide, wherein said second oligonucleotide strand is complementary to a target C5 mRNA sequence set forth as SEQ ID NO: 2024 along at least 20 consecutive nucleotides of said second oligonucleotide strand length to reduce C5 target mRNA expression when said double stranded nucleic acid is introduced into a mammalian cell;
a dsNA comprising first and second nucleic acid strands, wherein said first strand is 15-35 nucleotides in length and said second strand of said dsNA is 20-35 nucleotides in length, wherein said dsNA comprises a modified nucleotide, wherein said second oligonucleotide strand is complementary to a target C5 mRNA sequence set forth as SEQ ID NO: 2024 along at least 20 consecutive nucleotides of said second oligonucleotide strand length to reduce C5 target mRNA expression, and wherein, starting from the 5' end of the C5 mRNA sequence set forth as SEQ ID NO: 2024 (position 1), mammalian Ago2 cleaves said mRNA at a site between positions 9 and 10 of said sequence, when said double stranded nucleic acid is introduced into a mammalian cell;

a dsNA molecule, consisting of: (a) a sense region and an antisense region, wherein said sense region and said antisense region together form a duplex region consisting of 25-35 base pairs and said antisense region comprises a sequence that is the complement of a sequence set forth as SEQ ID NO: 2024; and (b) from zero to two 3' overhang regions, wherein each overhang region is six or fewer nucleotides in length, wherein said dsNA molecule comprises a modified nucleotide, and wherein, starting from the 5' end of the C5 mRNA sequence set forth as SEQ ID NO: 2024 (position 1), mammalian Ago2 cleaves said mRNA at a site between positions 9 and 10 of said sequence, when said double stranded nucleic acid is introduced into a mammalian cell;

a dsNA comprising first and second nucleic acid strands and a duplex region of at least 25 base pairs, wherein said first strand is 25-34 nucleotides in length and said second strand of said dsNA is 26-35 nucleotides in length and comprises 1-5 single-stranded nucleotides at its 3' terminus, wherein said dsNA comprises a modified nucleotide, wherein said second oligonucleotide strand is complementary to a target C5 mRNA sequence set forth as SEQ ID NO: 2024 along at least 20 consecutive nucleotides of said second oligonucleotide strand length to reduce C5 target gene expression when said double stranded nucleic acid is introduced into a mammalian cell;

a dsNA comprising first and second nucleic acid strands and a duplex region of at least 25 base pairs, wherein said first strand is 25-34 nucleotides in length and said second strand of said dsNA is 26-35 nucleotides in length and comprises 1-5 single-stranded nucleotides at its 3' terminus, wherein the 3' terminus of said first oligonucleotide strand and the 5' terminus of said second oligonucleotide strand form a blunt end, wherein said dsNA comprises a modified nucleotide, and said second oligonucleotide strand is complementary to a target C5 sequence set forth as SEQ ID NO: 2024 along at least 20 consecutive nucleotides of said second oligonucleotide strand length to reduce C5 mRNA expression when said double stranded nucleic acid is introduced into a mammalian cell;

a nucleic acid comprising an oligonucleotide strand of 20-35 nucleotides in length, wherein said nucleic acid comprises a modified nucleotide, wherein said oligonucleotide strand is complementary to a target C5 mRNA sequence set forth as SEQ ID NO: 2024 along at least 20 consecutive nucleotides of said oligonucleotide strand length to reduce C5 target mRNA expression when said nucleic acid is introduced into a mammalian cell;

a nucleic acid comprising an oligonucleotide strand of 15-35 nucleotides in length, wherein said nucleic acid comprises a modified nucleotide, wherein said oligonucleotide strand is hybridizable to a target C5 mRNA sequence set forth as SEQ ID NO: 2024 along at least 20 consecutive nucleotides of said oligonucleotide strand length;

a dsNA comprising first and second nucleic acid strands comprising RNA, wherein said first strand is 15-35 nucleotides in length and said second strand of said dsNA is 20-35 nucleotides in length, wherein said dsNA comprises a modified nucleotide, wherein said second oligonucleotide strand is hybridizable to a target C5 mRNA sequence set forth as SEQ ID NO: 2024 along at least 20 consecutive nucleotides of said second oligonucleotide strand length;

a dsNA comprising first and second nucleic acid strands comprising RNA, wherein said first strand is 15-35 nucleotides in length and said second strand of said dsNA is at least 35 nucleotides in length and optionally comprises a sequence of at least 25 nucleotides in length of SEQ ID NO: 488, wherein said dsNA comprises a modified nucleotide, wherein said second oligonucleotide strand is sufficiently complementary to a target C5 mRNA sequence set forth as SEQ ID NO: 2024 along at least 20 consecutive nucleotides of said second oligonucleotide strand length to reduce C5 target mRNA expression when said double stranded nucleic acid is introduced into a mammalian cell;

a dsNA comprising a first oligonucleotide strand having a 5' terminus and a 3' terminus and a second oligonucleotide strand having a 5' terminus and a 3' terminus, wherein said dsNA comprises a modified nucleotide, wherein said first strand is 25 to 53 nucleotide residues in length, wherein starting from the first nucleotide (position 1) at the 5' terminus of the first strand, positions 1 to 23 of said first strand are ribonucleotides or modified ribonucleotides; said second strand is 27 to 53 nucleotide residues in length and comprises 23 consecutive ribonucleotides or modified ribonucleotides that base pair with the ribonucleotides or ribonucleotides of positions 1 to 23 of said first strand to form a duplex; the 5' terminus of the first strand and the 3' terminus of the second strand form a structure selected from the group consisting of a blunt end, a 1-6 nucleotide 5' overhang and a 1-6 nucleotide 3' overhang; the 3' terminus of said first strand and the 5' terminus of said second strand form a structure selected from the group consisting of a blunt end, a 1-6 nucleotide 5' overhang and a 1-6 nucleotide 3' overhang; at least one of positions 24 to the 3' terminal nucleotide residue of said first strand is a deoxyribonucleotide or modified ribonucleotide that optionally base pairs with a deoxyribonucleotide of the second strand; and the second strand is sufficiently complementary to a target C5 mRNA sequence set forth as SEQ ID NO: 2024 along at least 20 consecutive nucleotides of the second oligonucleotide strand length to reduce C5 target mRNA expression when the double stranded nucleic acid is introduced into a mammalian cell;

a dsNA comprising a first oligonucleotide strand having a 5' terminus and a 3' terminus and a second oligonucleotide strand having a 5' terminus and a 3' terminus, wherein said dsNA comprises a modified nucleotide, wherein the second strand is 27 to 53 nucleotide residues in length, wherein starting from the first nucleotide (position 1) at the 5' terminus of the second strand, positions 1 to 23 of the second strand are ribonucleotides or modified ribonucleotides; the first strand is 25 to 53 nucleotide residues in length and comprises 23 consecutive ribonucleotides or modified ribonucleotides that base pair sufficiently with the ribonucleotides of positions 1 to 23 of the second strand to form a duplex; at least one of positions 24 to the 3' terminal nucleotide residue of the second strand is a deoxyribonucleotide or modified ribonucleotide, optionally that base pairs with a deoxyribonucleotide or modified ribonucleotide of the first strand; and the second strand is sufficiently complementary to a target C5 mRNA sequence set forth as SEQ ID NO: 2024 along at least 20 consecutive nucleotides of the second oligonucleotide strand length to reduce C5 target mRNA expression when the double stranded nucleic acid is introduced into a mammalian cell;

a dsNA comprising a first oligonucleotide strand having a 5' terminus and a 3' terminus and a second oligonucleotide strand having a 5' terminus and a 3' terminus, wherein said dsNA comprises a modified nucleotide, wherein each of the 5' termini has a 5' terminal nucleotide and each of the 3' termini has a 3' terminal nucleotide, where the first strand (or the second strand) is 25-30 nucleotide residues in length, where starting from the 5' terminal nucleotide (position 1) positions 1 to 23 of the first strand (or the second strand) include at least 8 ribonucleotides; the second strand (or the first strand) is 36-66 nucleotide residues in length and, starting from the 3' terminal nucleotide, includes at least 8 ribonucleotides in the positions paired with positions 1-23 of the first strand to form a duplex; where at least the 3' terminal nucleotide of the second strand (or the first strand) is unpaired with the first strand (or the second strand), and up to 6 consecutive 3' terminal nucleotides are unpaired with the first strand (or the second strand), thereby forming a 3' single stranded overhang of 1-6 nucleotides; where the 5' terminus of the second strand (or the first strand) includes from 10-30 consecutive nucleotides which are unpaired with the first strand (or the second strand), thereby forming a 10-30 nucleotide single stranded 5' overhang; where at least the first strand (or the second strand) 5' terminal and 3' terminal nucleotides are base paired with nucleotides of the second strand (or first strand) when the first and second strands are aligned for maximum complementarity, thereby forming a substantially duplexed region between the first and second strands; and the second strand is sufficiently complementary to a target RNA sequence set forth as SEQ ID NO: 2024 along at least 20 consecutive ribonucleotides of the second strand length to reduce target gene expression when the double stranded nucleic acid is introduced into a mammalian cell;

a dsNA comprising a first oligonucleotide strand having a 5' terminus and a 3' terminus and a second oligonucleotide strand having a 5' terminus and a 3' terminus, wherein said dsNA comprises a modified nucleotide, wherein each of the 5' termini has a 5' terminal nucleotide and each of the 3' termini has a 3' terminal nucleotide, wherein the first strand is 25-35 nucleotide residues in length, wherein starting from the 5' terminal nucleotide (position 1) positions 1 to 25 of the second strand include at least 8 ribonucleotides; the second strand is 30-66 nucleotide residues in length and, starting from the 3' terminal nucleotide, comprises at least 8 ribonucleotides in the positions paired with positions 1-25 of the first strand to form a duplex; wherein the 5' terminus of the second strand comprises from 5-35 consecutive nucleotides which are unpaired with the first strand, thereby forming a 5-35 nucleotide single stranded 5' overhang; wherein at least the first strand 5' terminal and 3' terminal nucleotides are base paired with nucleotides of the second strand when the first and second strands are aligned for maximum complementarity, thereby forming a substantially duplexed region between the first and second strands; and the second strand is sufficiently complementary to a target C5 mRNA sequence set forth as SEQ ID NO: 2024 along at least 20 consecutive nucleotides of the second oligonucleotide strand length to reduce C5 target mRNA expression when the double stranded nucleic acid is introduced into a mammalian cell;

a dsNA comprising a first oligonucleotide strand having a 5' terminus and a 3' terminus and a second oligonucleotide strand having a 5' terminus and a 3' terminus, wherein said dsNA comprises a modified nucleotide, wherein each of the 5' termini has a 5' terminal nucleotide and each of the 3' termini has a 3' terminal nucleotide, wherein the second strand is 20-30 nucleotide residues in length and optionally 25-30 nucleotide residues in length, wherein starting from the 5' terminal nucleotide (position 1) positions 1 to 17 (optionally positions 1 to 23) of the second strand include at least 8 ribonucleotides; the first strand is 24-66 nucleotide residues in length (optionally 30-66 nucleotide residues in length) and, starting from the 3' terminal nucleotide, comprises at least 8 ribonucleotides in the positions paired with positions 1 to 17 (optionally positions 1 to 23) of the second strand to form a duplex; wherein the 3' terminus of the first strand and the 5' terminus of the second strand comprise a structure selected from the group consisting of a blunt end, a 3' overhang and a 5' overhang, optionally wherein the overhang is 1-6 nucleotides in length; wherein the 5' terminus of the first strand comprises from 5-35 consecutive nucleotides which are unpaired with the second strand, thereby forming a 5-35 nucleotide single-stranded 5' overhang; where at least the second strand 5' terminal and 3' terminal nucleotides are base paired with nucleotides of the first strand when the first and second strands are aligned for maximum complementarity, thereby forming a substantially duplexed region between the first and second strands; and the second strand is sufficiently complementary to a target C5 mRNA sequence set forth as SEQ ID NO: 2024 along at least 20 consecutive nucleotides of the second oligonucleotide strand length to reduce C5 target mRNA expression when the double stranded nucleic acid is introduced into a mammalian cell;

a dsNA comprising a first strand and a second strand, wherein the first strand and the second strand form a duplex region of 19-25 nucleotides in length, wherein said dsNA comprises a modified nucleotide, wherein the first strand comprises a 3' region that extends beyond the first strand-second strand duplex region and comprises a tetraloop, and the dsNA further comprises a discontinuity between the 3' terminus of the first strand and the 5' terminus of the second strand, and the first or second strand is sufficiently complementary to a target C5 mRNA sequence set forth as SEQ ID NO: 2024 along at least 20 consecutive nucleotides of the first or second strand length to reduce C5 target mRNA expression when the dsNA is introduced into a mammalian cell;

a dsNA comprising a first oligonucleotide strand having a 5' terminus and a 3' terminus and a second oligonucleotide strand having a 5' terminus and a 3' terminus, wherein said dsNA comprises a modified nucleotide, wherein each of the 5' termini has a 5' terminal nucleotide and each of the 3' termini has a 3' terminal nucleotide, wherein the first oligonucleotide strand is 25-53 nucleotides in length and the second oligonucleotide strand is 25-53 nucleotides in length, wherein the second oligonucleotide strand is sufficiently complementary to a target C5 mRNA sequence set forth as SEQ ID NO: 2024, and wherein the dsNA is sufficiently highly modified to substantially prevent dicer cleavage of the dsNA, optionally wherein the dsNA is cleaved by non-dicer nucleases to yield one or more 19-23 nucleotide strand length dsNAs capable of reducing C5 mRNA expression in a mammalian cell;

an in vivo hybridization complex present within a cell, the in vivo hybridization complex comprising an exogenous nucleic acid and a target C5 mRNA sequence set forth as SEQ ID NO: 2024, wherein the in vivo hybridization complex has a duplex region of at least 20 consecutive nucleotides in length along the target C5 mRNA sequence, and wherein said exogenous nucleic acid comprises a modified nucleotide; and an in vitro hybridization complex present within a cell, the in vitro hybridization complex comprising an exogenous nucleic acid and a target C5 mRNA sequence set forth as SEQ ID NO: 2024, wherein the in vitro hybridization complex has a duplex region of at least 20 consecutive nucleotides in length along the target C5 mRNA sequence, wherein said exogenous nucleic acid comprises a modified nucleotide.

12. A method for reducing expression of a target C5 gene in a mammalian cell comprising contacting a mammalian cell in vitro with a dsNA of claim 3 in an amount sufficient to reduce expression of a target C5 mRNA in said cell.

13. A method for reducing expression of a target C5 mRNA in a mammal comprising administering a dsNA of claim 3 to a mammal in an amount sufficient to reduce expression of a target C5 mRNA in the mammal.

14. A formulation comprising the dsNA of claim 3, wherein said-dsNA is present in an amount effective to reduce target C5 mRNA levels when said dsNA is introduced into a mammalian cell in vitro by an amount (expressed by %) of at least 10%.

15. A formulation comprising the dsNA of claim 3, wherein said dsNA is present in an amount effective to reduce target C5 mRNA levels when said dsNA is introduced into a cell of a mammalian subject by an amount (expressed by %) of at least 10%.

16. A dsNA of claim 3 contained within a mammalian cell.

17. A pharmaceutical composition comprising the dsNA of claim 3 and a pharmaceutically acceptable carrier.

18. A kit comprising the dsNA of claim 3 and instructions for its use.

19. The dsNA of claim 3 comprising a duplex region in the range of 21-25 base pairs in length.

20. The dsNA of claim 3 comprising a duplex region in the range of 19-21 base pairs in length.

21. A formulation comprising the dsNA of claim 3, wherein said dsNA is present in an amount effective to reduce target C5 mRNA levels when said dsNA is introduced into a mammalian cell in vitro by an amount (expressed by %) of at least 50%.

22. A formulation comprising the dsNA of claim 3, wherein said dsNA is present in an amount effective to reduce target C5 mRNA levels when said dsNA is introduced into a mammalian cell in vitro by an amount (expressed by %) of at least 80%.

23. A formulation comprising the dsNA of claim 3, wherein said dsNA is present in an amount effective to reduce target C5 mRNA levels when said dsNA is introduced into a cell of a mammalian subject by an amount (expressed by %) of at least 50%.

24. A formulation comprising the dsNA of claim 3, wherein said dsNA is present in an amount effective to reduce target C5 mRNA levels when said dsNA is introduced into a cell of a mammalian subject by an amount (expressed by %) of at least 80%.

\* \* \* \* \*